United States Patent 11,001,841 (CCCTC-BINDING FACTOR (CTCF) RNA INTERACTOME) - sequence listing, part 49

SEQ ID NO: 116065 - DNA, 1076 bp, Homo sapiens
tcttttactgcagtaggtacactagaaaacataattatttgtccagatctccatcttatttagtgttggacccaggccctcaatgacagaaggtcccctttaatagggcagtgactatgtgtaccaattccacgggtctagccagcttttcataagtgacaacagaccagagagcatacttacgtcactatttcctatttctctcatctttattttcagttacagtttctgtctttggggaaaagcaggcaaaatctaatttgtaatggatagaactagctgtccacttaaacaatagaaaactgagtcataaattctgtctttataaaactcctccatacttttggaaaatgactcacttttaggcagcgtctgccatagatatttgccagaaagtgatctaacttggataagcttgatgctttgtacaagtttcagagcccctgtagagaaagctcttaggaaccagagaccatcgtgtgcctgtctgtgtcccgtgactttcagtccatcaacacacgtcactgtagcattttggaatgttctggttcagttgctctcagatgttagctacttcagaaccacctggagggcttgttagaacacagatgattgtgtaccactcccagaatttctggttctatagatctgggataggtctgagaatttacattttgaataagttccaggcattactgaggctgctagtttggggcctgcttggagatcaattcctctaatttctgtgtttgtgtcattcaaaagaattgataattaaaaaaaaaaatgcaaccaacagaatctctataaaatcatatatgtttacaattaaatcattcttacaagtaatgagatggtatggatttgttctcaagttattggatggaaacagaaacttctccactaaggagccctgtccatagctgatgtgagagagaaaacaaagctgggccacattgctttctgccttcttcttttatgtaaccaggagggagcatatccctagaatttttttttttttttctaaaggcggagtgtttctctgtcgcccagtctggagtacagtggcgcaatct

SEQ ID NO: 116066 - DNA, 1050 bp, Homo sapiens
tgtgaaatcagtgaggcaatggagcttcagggtttccttgtcccttgggtcatggctaacaccccatttaatgtctccttttcatcaaaaccagatttgtcgtctcacttatttcccagtgtctggccaagatagtgatctttatgaaaacaaactggaagtaatgcaagccagaaaagatgggagagcttcgcctctgcagaaggaagctgttaaggggaacagatggagacagggtctaaacagcttcaagaaagtgtgcacttgctagtctcagaggtgctccctgtcccccaagagctgtttgaatcaggagctgcttaaggacctgaatgacttctccaactctgccagggatccttcattagccctgcacttctgagatcactcagtgccccccatagacctctcctgctcttctgaatgcagaagcaggagtgggatataaagtgaaaatatagtaaattctaacctagtgtggcttgaaaaagaagttgcaatttatagagaattgccaaatatactgtgatggatcactaattttcaacatataataatttattaaaacactaaggatgacgtctataattgtcgtattaatctctgaaggtatcaggactttacaaggttcctgtgccttggccatcattgtgatcatttatagtgactaatcaatttgacaactatgtggcatatgaatggtaagcattcttggcaagcaaagggaagaaatgtcttatctgcatttaccagatctcatgtcttggctgtttgcagttatttacccctttcttccattaatctaaacttccaagaccctaagctcacattgtatcctgtattaacttgctaactaacctcctgtttttgtggttttctttctctgatctaatcagtccaatcagaagaaagattacacttacagatgcacatgctgatgtcatgacatcatcctcttatttaaggatctccctttgcttccctatcaagtctcaacttctctggccatctagacctcaggtgaggtccttttatcttagcgaccttgtt

SEQ ID NO: 116067 - DNA, 1117 bp, Homo sapiens
gctttcctgaggattgggtgggtgggggggtagaaggtgatagaaaaccctttgcatatgatatggtggtaagacagcctcctatcctgtaggcgtggtcaaggtttaaagctgactatctcatggggtgctcatgagggttcttcaaagactctgtcatctgtgtcagtttctgggagtctaggggtccaccaccagtcctgccactgtgatcatgttgccctttcagacagccctagaggactggacctgaaacaagccctggactggctcgttcttgtcggaggaccactccgtgcccttggaaacatcaggcactctttgccccaacacccacagcctctgagaggatggcccagacccactgcagcagcaatttcccttcactcccatgccaccagggcagctagccacactgcctctcatgttccaggtccccagagaaggggtgccagcacctctctgtgtctctttaatggtggagcactcaaatcaagcccccaactggcctcactgaaatccggcttgtgaagtaagaagctgatattcctactctttccccaatgggaagagggtgctgaatggggatctcagtgcagctctttccaaagaaatcctccctcacatcttgctcttgaccctccctgtgggagaggagcttaagcctagttcttagttatctcctttttgaagggcagatgggtgttttttttttaactcactttggtatctgatattgctagcatcttgtgttagagccaaaacttgcagtgtagcatcctcatcatgtgtatactagaaacttacttgtggaattgttggatgatagagggatggtgcagtagaatgttaaattactcaccgacggggtctcaggtacatgccacacgcttgccaacactttacaaaattgatctttaaatgtttttaccaggcttttgaaggaaaaagacacatatatctcaccattttacttttctttactaggcagttctttatatatttattgagcattttaatttttctttccatgaatttcctgttaaagtcctttgccctattatttatatatatatatttttttatttttttcttgagatggagtctcgctctgtcg

SEQ ID NO: 116068 - DNA, 1049 bp, Homo sapiens
ctcctgccttggcctcccaaagtgttgggattacaggcatgggccactgtgcccggccactatttttcagttagttgtgagcatttaaaaaaacagaagaactcataaaaaatctgaatcttccacttttcaagaaatcccaaaggtcaggcccttgtggtccacatttccacaagtagctgtgagctagagccaagttgcttacagcccccacccagccagcttcgttccttaccggtaccggcctcacccctgcaggtatctgtttccaagcccgccctgttagagtggattttctgaggctaaagttagtttggatttattccaacttatataaataatcgaggtgattagatatgactaatacttctgttctacctagctacttaatacctccactgacactttctttcctgataaaatctgaaatctcttcatttatccttgcatcccttgagccccttgagggacaggtcttatcaacagattggtttctactggttaaaagttgcattaaatttgtctcctcatacctggaacaattggatatcatgttttgcatctgcccatcaggtagatacacccttttagctctgccacattctaacatagagtggctcttctgtcattgccacctaattgtaggcctctgcttgctagttgtatccactgtttacgttatagagaaatcttttcacatatgtaaggactttatatctgtgtgtgtgcccattcatttaatagtctttgtatatgctagaattaaggcacaagaaatacaaatgtttcatgtctgtggtcaggaaatacagttagcaatggctgtagctgtttagattgtgaagatgataattggccgcttcagatcctgtgtcttacagataatcagtactggaaggtgtagggtgaagctgcgtcacagccatgaaatggaggcattgtgaaacccaagccggcccagaacaccctcgcagcatgatttgttattgcacagagctggctgtactgctgctcaagccatatttcctgaaactcaagaacgccagagt

SEQ ID NO: 116069 - DNA, 1040 bp, Homo sapiens
attattgagccagagaaaaattctcctatagcatgtgatggaagtggccacattttacctcttgctttatttccagaaatgaacacaggtgtctatatccatttaatacacccctttttggccgggtgtgttggctcacacctgtaatcccagcactttgggaggccgaggtgggcagatcacttgaggtcgggagttcaaaaccagcctagccaacgtggtgaaaccccatctctactaaaaatacaaaaattggtcaggtgtggtggcgtgtgcctgtaatctcagctattccggaggctgaggcaggagaatcctcgaacctgggaggcagaggttgcagtgagctgagatcatgccacagcactccagcctgagggacagagtgggactccatttcaaaaaaacaaaacaatacaccactttttatttgtagtgcactatacttagagctgttgccataggaattgatataccaggcgtcatggtggtcagcagacaaataggaaactcctgttatgtcgtcagaatgagttgcagagagtaccatctgctacctgtattgtacatctttctgttcctctgtcacgcctggcacaagagcagcattggtttaatcatcagcagcccttctgctctctgtagtcaggattggcagtaactcattggtgggcaacactgccttggtcttgccgcttgcactgtgaactgtaactacggacacacatgtcaggaaagaatggtgcttgggatgctcctcctatctgtgcctcaaacgttttcactcgagggatattaaaaagtggcctactgcttataaagactgtgtgtcagtgaagaggaagaggtgggagtggagagtgggaggcatttgcaagaacatatgttggattctttttttctcttcttggtgacaatgattgacggcatctagtgagtccctgtttgtcacttccttggtacagctggtagtggaggtgggggaaatcaataagggctggacaaaggacatagctagaggaagaaagcactgcaaatat

SEQ ID NO: 116070 - DNA, 1031 bp, Homo sapiens
ttatcccctttccaaaactaacatgaaattaactacagtaataacttttaaaaaatacatttgcgataaaaatgccatctactaaccagaaatttgaacaacccctaacatgaagtaaacagacagaattcgattgactgagaaacaaactgggagaagatcacagcccacaaaacgctgggggttgcagcagaggtaggagctgtcgtgaggtttgctccaagcaaaggggacagcaaggaaaagaagagcctcaaagtgagcaatcgtcagcctaggaccagcagaactatatggcccttccctaaagcagcaagtgtagatgctgatagcgggatagcatgccggtacccaagacagctaatgacctcaagaaggaacagagagtccccagtctgagaaggaaagacactggttcccttctggcgtccgttccattgctctctacagcttcttaatgctggctcctgacatgcggatctgcagtgaatgaccaacaaacagcaagtctcaaacactaagatgagtcccagatcagaagatgtcagacatttgaaggaaactgccactgaaggaagcattagattcaccaaacagaaccaagacccaaggaacaaatgaaaatattaaaatatgtgcaattgatgattcattcaatttatgttcaacaaatatttattgagcacttacatttatacacagaagaaccaaagataaaactctaagaaggaaaatttggtatagataaaatcagaaaaacagttaataaaatttgtagatatctaaattattggtggatataattaaaaaagcatgaatctaaaattctaaattatctcaatattccacaggtgggaaagttagaggtggaagcatctaaggataatagataccaattagtttaggctttgatagaaaaatgtaaaagtatattaaaacttcagcaggatattagtataggtaatatatattaaagatgcagcacattaagtacttgaaataagtataaaatttgttgcttgaagacattt

SEQ ID NO: 116071 - DNA, 1035 bp, Homo sapiens
ctctttttatgccccctgtgtcccatgcattgctagattctgctgcctactcttgttggagttgaatctgtcgccaaccttctagtctcaccagtcttgcctcagtcctgccccttctgacctcattgcatgactcttctatcaagcaccttccttgtgggtctctctgcctcctgttactctctaagccaatccctcttaaagctagaggttacaaaactgatctttaactacaaatcttgtgttaacccaccagagacatgccccgattctctattacctactgaattaaataccaaatcttagcttagccttcagctgaccccctcatctttttggctcaccatggacacactccaagctgtagcctaatgtgctaagctttccatctgtgtaaccaaatcctgctgtctgtttcctattcttgacattattctgttgctcgaagccctcattgattatgatctctttgcaaaattttcttcccaactaagtatgaatactttcttaaaaaatgcttatagtacttctcttatagaacctattctgttcttctaggtatatttattacttgtgttcttgattttattagatcaaatcaaatgaaattggcactattcaactgtttttgatctaaaaaaagggcaataccaagtggtccaaactaatgttttccacatttgaaaattagcccttttcaaagagtcaccgggtctgtcattcatctttgtagtctttgccagcattctcccctagtcccctgcacagagcaggcactccacaaatgcttgcaatgaatttaaataattagggaatggtttttgtcactcttcacatttttccatttgaatttcgagttttggaaatattttatttaacctcagaaatcagtgaagactttgttttgcagaatagctgtatttcagaagaagaaagagatgcttatgaagaactgctgacacaagcagaaatccaaggcaatattaataaagtcaacagtaagtaatggatcgtatgaaggaaattgatatttcc

SEQ ID NO: 116072 - DNA, 1051 bp, Homo sapiens
agtttgctgagaatgatggtttccagcttcatccatgtccctgcaaaggacatgaactcatcctttttttttatggctgcatagtattccatggtgtatatgtgccacattttctttatccagtctatcattgatggacatttgggttggttccaagtctttgctattgtgaacagtgccgcataaacatacaggtacatgtgcctttatagtagaatgatttataatcatataatgggattactgggtcaaatggtgttacttttaaaatcttttcctttatagcttgtttttgttcatttctaaagaaatgatgggtagttgtatttctttctgtgtttattttttactttctcatttcactcctgttgggtcagcatttagacgttaagtgtatgggatgcccataaggactttgcgcttttggaatggtctccatctgtgagggacactaaccagtgcaagttaccgataatccaaatcgttattgtggtcagtattatttattatacattactagtgtatttcacatctgcacttggcgaggcctcattcagctacagaaaataaattgttaccaccatttcctatttttgaatgtttttctctcaagctactctctatggaagacaccgcatgtcaccttgaagcatgcagaattttgaaaaagtttgtcacaaccaagaaaacagttttagacttcatataatgtttcttcttttaacctctgccattactagatccctagagactattcagaattcaaactgcagagtgactcattatgtacacagaagattgttcttcattgccctggtgcaaagacataaaagcacactaaactatctagttttattaattttcgctggaatagttcatgttagcctatggttgtaacattggttctgtgaaaattggaaagtgggaaaattgataattgagaagtaaaagtttcttaatatatcagtatgagtaagtttttccctgaaatttccccaggcagaaaaaaagtaattggagtggttgactaaactgtatcttccagagggct

SEQ ID NO: 116073 - DNA, 1039 bp, Homo sapiens
aattaacatcaagattattttctcttccacagttatgcaaacacactactctctgttaaactagaagttttatcccaagggcaagataacttaagctggaatgaaattcagaattgtattgatatggttaatgctcaaattcaagaagaaaatgaccgtaagtataagacactttccttctctagcatagtgggagaagaaggtatctggacaacttagttttctagattagggctttaagtttttgctcaaggaactttgtgagagcaaactccgctaatatgcatacctttatttataggtagattttatgcctataccactgtaccaatatgttataaacgttacaaagcctacacaagaattcataatataataaaatacacaagtaaaaggcctgatttttctggttatttgtacttcagagacagctaaatacagagacagctaaataactcatatttttaagcacccaattttattttgaccttttatttgggcatctttttttctgaaatatgacacgatttttctgccccacaaatggaggaattggaacacgatctaactgttgcttaatgatcacaaatcatggtgatttgctgtgtttctagaaattatgagctgccagcatgaaagcataccaacctcaggaagatatgccctgaaacatgctttcttgaatgtcagcttgctgctttatcatttgcatcttgcttatgaaaatagagtgaagaatgaggagctatgtagcttctgcagtccatacattcactgcttttctgtagtatgcattaccaaattcaagcttcgagctgtgttttccaccatgaaaacaaagcaacaccatcttctgtggcttatgagcttttgacttgtcagcaacagtgggtgagtgttgctaaaatcattgatctctcctccaccttccagctttgacttttctaactcatttgctccaagctcgcggatagagtgggcagatacttctctcacagtttattatgttttattttagtgtgtttgggtaaggtcttag

SEQ ID NO: 116074 - DNA, 1149 bp, Homo sapiens
gaatgccaggctaaagatttatgatttattatagaaacagtggagttagtggaaatgttttagtgatgtatcctaactgatatctaaggaagattaatctggcaggacttgtgaagtggtggagggtaggctggcagtggagagaatggttagaaggtagaggtggcctggacgtagtggctcatgcctgtagtcccagcactttgggaggctgagataggaagatcactcgagaccaggagttcaagaccagcctgggcaacagtgagactccatctctgcaaaaaataaaaaataaaattagttgggtatggtggtgcatgcctgtagtcttagttacttgggaggctgagacagcaggattgcttgagcccaggagttggaggctgaagtgagctatgatcaggctactgcacttcagccaggtgacgaagcgagacactgtctctattaaaaaaaggaaaaaagaaggcaaaggtgaaactagataaaagaccctggtgagggaccctacaaagatagaatcagttgatgaggcagccaccagcatgagagtcaaaagagaccaaagaataaaaaatgatgtcaaatgtcaaggatggcaataccactcacagaaatagggaagatggtgatttaaagagcttgaagtagcaataaggcaaatggaaatgtcattttccatagagttgtgatatcttttctcctgcattaacatttttaaaatactgataaagtgtttttaaaaattactaatgctggctggctcagtggctcacgcctgtaatccagcactttgggaggctgaggccggaagatcacttgaggtcaggagttcaagaccagcctggtcaacatggtgaaaccccgtctctactaaaaatacaagtatttttagtagctgggcatggtggtgtaatcccagctacttgggaggctgacctgggaggcagaggttgcaatgagccaagatagtgccactgcacgccagtctgggtgataaagtgagactcagtctcaaaaacaaacaaacaaactactaatgcttttgtaatgtttgacctttgaagcatatttcttaggagctcggaaatggagctccttgcactatgcttatgttgttcttgaaaacagacgttctctgtgatg

SEQ ID NO: 116075 - DNA, 1084 bp, Homo sapiens
agtggttgagatggcctagggggagttatgagaagaaagaatccaaaggtggactttaggggtaatgacagattttaagggaagaggaaacaaaggaggaaaaatcggaagatgaaatcggtatgaggacctaagaagttggaaatgaattctttaaaagatagaaacacatcaactatatgctatcaatatttggtgttacttggcatgttgatgttaataatcctaattcctgcaatttcaaaaacaaaatcttaaagctcaaacctgaacatttattattatataactttttgtaaccctttcacatgtatagaaaatagattctcccagatttctaatgttacctttaagatagacttctatgccaaatataaacctcattcttatcgatttaaaatgccagtactgcgccattatgtcttgtcccatggcctcaaaattcctccatattgaatacttgaagttagtgtttagtaacctatgtttcattcagagccagtttctcttcctgctttaatctctagcagttagctcccgggtgaaatggaaaccctccacgtaaacctgagattgcacaagctgaattcacggtgtaaaatagaggaggtgtgtcctagtaactgaggggtatggaggtgatcaggtatcatttaagaaaaggtagattaaagaaaaggaaagaaaaatttgggaggcagcattcttctatgcctgtatttagaggtgatcttagaagctgtgttgtgtgacacacaaacccttctgctcacttttgcattttggaaaagttcttgcatctgacatcacccaaagagaagtgcctttaaagataggcacaaagttagagaatggtgcctgaagagcatgccgtacaagttattagcctgattttaaaaagctgttaaaaccaagtgtttgtccgttttcagaaagtttctgggatttagcaagacatcatgcctccagacatgccaaacagtgcctgtgttttgtggaaaagttgatttgattccattttccgtgagaatgccagatctgggtccacttaaataaggcttttattcctcagagcctggttttc

SEQ ID NO: 116076 - DNA, 1047 bp, Homo sapiens
agaaagtagattgtaatttagacattcaaatagcctaagatggttatgatttgtctcttagaaatcaaaccaatttagaaggtttttaaaatgttcttatattcattgttcttacattcggcctgcaaatgtcaagttgattctgtttttcacattgagactcatggttctattgactataaaagtaagaggatttctcaaatgtataattttgtactctgtattgcacatctaaaatcctatcttttcactctgtcctgtcccttaaagagccgatatactttcttttactatatcttaaacagcaaaaaagattttccaaagttaatgctacctatgagaattttctgactttcaacaagaatttgattaaaaacattcttcattatttgcatgaagacttgaaatagattctggtcacacactataagcatcacacacactctcagataatatgataaaagaaaatgtgttggcccaaatatgttaccaccagcaaaatttaaaagggcagagtaactcaagtccctttcattttggcctagtgttcacattcactggagtatcttgcttgcttaaagtagatttgcctctacttttgattccttagagcagtctttctctacctttttctcattatggcaccctaaggaatctttttagacagttttttctctaatcactccttaccatgaaattttaatgccacagatattttgtatacctgtttatgtgccatatgtagacctgtactttatacataaagagatttttttcactccctccctgcaggaactaatttttgccccgttaggggttctatcacctccactgtgaatgtgtgccttaagagagcctgctggtatatggcttaagatgtaaagcaaacattttttggatctcttaggagatttatggaggtttcttaatttgttccttggcagaaacatacctgactttctggagtgaaagtcatctatctgatatcttcaactatctggaacttagctacaactcacagattaagaaaaaaagcaatcaaaatag

SEQ ID NO: 116077 - DNA, 1008 bp, Homo sapiens
ccaagagtttaatgtgttttgttaatgaggaggggtagaaatttgcaatgggataaaatgcttgttaggtctaaaatggttccagaattaagttttaggactccgttgcacatatccaccagctctgcctttctagaacacttgtttaggttgtttttgacaatcttgctaaatatattagcactatacaagagaataccaggatttctgtaacttaaaaaggattttgcttatcctaaagtaaacaaatgtctttgtaaaactagttctcaaatacatgctaatgccctaggttacagctacatatctatgttcgtgtgtattcaccccatttcatagattactacagcaagcaaaacctagtgccttcataccacatatgagtaaccaggaaagactattgtttttaataaaccatactcccatggtatctaattcttcttatggactaaactggtctgtgaatttgtgattgtcttgggcatatgtggtaaatattctcaaagggtaaaaatgtttgatactaatgcattcctaaaacgttgaattatatatttgcatgccttgaagtaagtggaagataaccattaacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagaggtaagttggtttgttactttagcacaaactaagtattttaaatatcatttctgtggtattatattttcttaattttaagacaagtaatgctttcaaattaacatttctgtaattttttgtcatctatggctaaggaaattaggaaaagttttagatgtttctttttagttttagaaagctatgatgagctcagtggcaatatatggatggcattaagaaaat

SEQ ID NO: 116078 - DNA, 1073 bp, Homo sapiens
tatacattaataaaactccttctcccaaacaacaaaattctatttttacataattattccctgactcctagacattaataaaacttctccccaaaaaagaaagtgtacttttggcataatccatttacaaagccagattgtgactggaatggtggcatatgcctgtaatcccaacactttgggagactgaggcaggaggatcactcaagcccacaagtttgagactagcccgggcaacatagtgagacccctatctctactaaaaattttttaaaaactagccgggtttggtggtacatgcctgtagtcacagctacttaagaggctgaggtgggagatcacttgagctcaggagtctgaggctgcagtgatctatgatcgtgccactgcactccagccggggcaacagagcgagaccctacctcaaaaaataaataaataaataataaaaataaagccagattgtaaatatgcagtttaagccctgagccaggacaggctatggtgttctcatccgccaaagctatgctatgtagacctacaccctgtctctcccctcttccaggaaccctctcagcttttccagtaattttctgggggaaatgagaatattctttttattctaatgttttaacataaagtggtaataaacaggctacgcaacgaaaacaagaaactaccacccaatagtagccttctgcaaagaatcacttccattgttctggaaacccccatttctcggaagcaggcagtttttcacatcatgtgctgtgttatgacatctacatctggtttgcatgcagacatcactgccgtcagccattagcatgtattaagtatctgttgggtgcagggcactgtgctcagtggcatggggaaggaattgggaggctttagatgacttttcaaacattaaaattaaaaaaaaaaaagctaagcattgaggggtttgcattgttttctttttaagatcaattggaacttatttcatgaaaaaatcttggtttttaaaaggtaaccatttcaagaatagtttcagaccttgtgagttgaagcaaggtcctggggatatg

SEQ ID NO: 116079 - DNA, 1047 bp, Homo sapiens
ttataatagtttacaacaccttccttggtttttagttttccatgtagtaatttgatttttttcctttgagaaatgattaactcagcttatgcaagtccttaggtaactgaagagaaatatctattacagagtggccagaagattagtgaggaaattcagttaaccaacgtttatttccggtataaaatcataatataaaaacacgtacctacaataagacattatgatagcatctgatttattggccttccttcctgttaaactgatcctggatatatttaccagctttgacttttatttgtaccctgcttcctgccgctaaagatttcaagtgaagcattcacactttaaataatactatcttttctccatcaaagaatcaaggatattccacatccatcctttacacacagagtaagaaagagaatgagattcatgatacaacaccataaatcaaaagcacccgctgaccaagcagtgcagttttcaagaacttatacaaacccaagaatgcatatcagtacattagaacagttatgtattggggtgagatggagactggaagtggaaaaatgaggacaaagggaacaagtatgtgttgaaacaatacgaaacatattacttccaagctacctgtcctgagttctgaggttttaatttgtggcaagagctttctctcctgccactgatgtgctgaagtgtgcttgaagtgtgaatgaagacagcattcatctccacttgatttttttttttaaacattcaatcatctgtgaaaacaacaggaagagcttcttcactgtgctgtgttgatatgttcctctcttaggcttgttgattttgtcctcagatcatctgaggctccattcggtcatgcagcaaatgcttgactacctactctgtgttcatgcgctgggcttgaggctgggatacaacagtgggtaagctggaaacagcccctgtcttacaggggtggagagcacagttcgacagtaggaccgcaaccaagttgcaggactaggactcacccttggcctcacaagagttgag

SEQ ID NO: 116080 - DNA, 1005 bp, Homo sapiens
ggaatgtgccaatattgtactctccaaaagaaatttaatatgagccacatgtaattttaacttttctagaagccttattttaaaaagaaatagatgaaattaattctaataatatattttatttaacccaatatatccaaaaatatttaaatatgtaataaatgtaaaaaattgatgaaatattttacattctttgtttcatacaacatcttcaaaatccagtgtgtgtttcacacagcacatctcagtttgtactagccatgtctcaagtgctcaagtgccacctgtggccagtggcggccatcatgggcagcacagctttaacgaccatgtgagtgcttaccatgtgccagacctcacagaaggctttagatcttttcatccaatccttgcatcagtcctgagagattcctgttttataaacgaaaaaacaaaacctacaaggattatataacttgcacaaatccacatggctaatatgcaacaagagtccaagccaagacagatttggctttaaatctgtccgtccccgtcgtccttaagcactagacacactgtagtgggagggaggtgggttccctgtcatgggactggatggttacttatgtctgaggtagaactttggcaatgaattccacaggcctggtgtacagtagaagtccaagggaaacaggctgtgtgagcagtttgtcctccagcaactcttgagcaaataaacattctttgtctttggtggggcacgttttattgactccagtcatttggtcattgcacagcttctctaaagaactagaagttccctagaaactgtatatcacaattagttctgagaatactatttcaaacaagaaagttactatattgacattttttaaatcatccaaagcttttatttttaactcagtgttcctgtttaatacattgatgatgatggctggaggaaggtggtgtgtaggaaggaaaggatacattgctttctcagccacagccgctttaggaaacatg

SEQ ID NO: 116081 - DNA, 1049 bp, Homo sapiens
gttctcatagccacatttcaataggtaatctagttttagtttcctcagctagcctatccaggaattgaaatccttccatgtggggaacaaagtagcagttatccattaaaatatgtccattactatagtgatttgtcaccttggcaataaagtagctattgagaatttttcccaaataaggcttgctatcgaaaagatgaagtaattcctttcaaagacctacttcaaaactcaggaagaacatgttctggttctagtctctgaactttggctggaggactactttcattttgacattaacttgcattgtgtagcttatgaactgtgaaattaggggatcagagaaaactcagcatcttgatattctcttttcaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggtttttggaaacagtattctttcttccttcacttagcagacatttgctaatcaccagtcaagtgctgggcactctgtgaggtggcattagggattcatggttgcatatgctgtggttactgccctcttcaatgctacagatttttcaaggtttcaaagcagttgatgactttttttttttttttttttttttgagttggagcctcgctctgttgcccaggctggagtgcagtggcacaatctcgactctctgcaacttccgcctcccaggttcaagcgattctcctgcctcagcctcctgagtagctgggactacaggcacgcaccaccacgcccagctaatttttgtatttttagtagagacggggtttcaccatgctggccaggctggtctcgaaatcctgacccggtgatccaccggggcctcccaagcagttgatgacttttaagagaaaacaatca

SEQ ID NO: 116082 - DNA, 1009 bp, Homo sapiens
atggcctggtgccatggcatgcgcctgtagtcctggctactcgggaggctgaggtgggaagatagcttaagccaggagtttgagaccaacctgggcaacatagttagaccccacccaggtgattaggtcaattgaatctgacttttgtcaacaaattcttctaatatgttttttaaatgcacaaaatgtcaaagttgagatttaatgatgctttttacaatttcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgatttttttaaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcata

SEQ ID NO: 116083 - DNA, 1078 bp, Homo sapiens
gattgatccctttatgtcaagtactcagcctttcctaatgtcttcagggtagatctctgaaaacctatcattcacctttgtccctttgaggggcagagtttaggaagtattgcttatatcaagacaaatgtttcacagtattttgagttggcttattctctaataaagtctatttgtgcattatctgctctttaccacccactctcctagtaagaaaacataaacaaaagtaaaatatgctctctgcttgtcgcttttgccttgttgatgcgttcactttttacatttaaaatttttttaattttatttttcagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatc

SEQ ID NO: 116084 - DNA, 1789 bp, Homo sapiens
ctcagtggctcacacttgtatctcaccactttgggaggctgaggcaggagaatcttaaggccaggagtttgagaacagcctgggcaacatagtgagatcctatctctacaaaaagtaaaaaattagctgggtgtgatggtgtgtgcctgtggcctggctgtttaggaggattgcttgagcccaaaagtttgaggctgcggtgcattatgatcgctccactacgctccagcctgggtgacagcgagaccctgtctcataaattaaaaaatgaataaatgaatgtactttcatttgaacaaaccagtgttactgctgaaacatttatttctgtaatgacccttgtcttcctttcttgtacaggaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattgagttttccaggtcctcagatgggaattgcacagtaggatgtggaacctgtttaatgttatgaggacgtgtctgttatttcctaatcaaaaaggtctcaccacataccatgtggatgcagcacctctcaggattgctaggagctcccctgtttgcatgagaaaagtagtcccccaaattaacatcagtgtctgtttcagaatctctctactcagatgaccccagaaactgaaccaacagaagcagacttttcagaagatggtgaagacagaaacccagtaacttgcaaaaagtagacttggtgtgaagactcacttctc

SEQ ID NO: 116085 - DNA, 1239 bp, Homo sapiens
ccaagataaatgagctgccagaatcaggtttccaatcaacagcagtgagttgggattggacagtagaatttcaatgtccagtgagtgaggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagtttttgtatgtattattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaacttatttctgagttgtgcgtttgttttgagggaaggagtgagagaaggcaggcaacagcttcacccctctaaaagtggacactcacaccaaactctgtgacaacggtttttcatttaaaaatgtttcagaggccgggcacagtggcacacgtgtgtaatcccagca

SEQ ID NO: 116086 - DNA, 1637 bp, Homo sapiens
ttatctgcatgatacgttttaaaaagtctgcatggggagagaaatttgccaaaaaataaatcaatccctaattccttgcctttatttcattatcagttgataagcaacagtattaaggtatccagttagaagttaagagttaagttttttaaatagaacacaacctatctacagatttttattttactcttgctgtagaaaatgtaaccaacttaccttttttttttctttttaactgacagctagggtcttgaaggagacattagaatcaaagatacacacttctgcagatttatctgtgccatctgttttaatcttttaaaatttgtacagttgtaaaaatcatgatttatttgaagtatgtgctttttgtgtttaaatgccagtgttttgtagttaagtcctttttatatacattattctaatatgatacgatttcacttcatttttttgctacagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggtaataaaatgctaaacatgaaactgttgatgcccaagaacctgtccttctttgttgttattatgtggaaagatagacttctttggtccgtcacagcatatataagggttataaacattcttatgtgtaattatgcaaagaatgttgtagtttttccaaaaccagaattagaacttcttcatatatgtagtggttttcctactacattgtgttccaaaattttgtgatctacataaactaaaacaaaatttgtccagatattttgactgaacaaaagaactgtggacaacaataccacatttacacctaaaaaaattttaatgttcctttatgtcagataccctgccactattcaaatttccctgaatctataaatttgtttttatagtttgtttgaattaggatccctattgtgtttgatatatctcatttaatctacagttttctccttcatttgtctttttgaaattttttttccaattgaacatataatcattgaagaacctagatctttgtcttagccaatatttcagggtctgtattttgtggatggcttccctgtggcatcatacatttattctcgaataattgtcactcatttttagtgccttcaaaactgggtcaaagttgaagttactgacacactagtaaatgttgtaataagtggttcaagtcataattgatagtcatgcttttcctttgtagaaattgaagtcgttacttaaacatagtctcaggtcttgagttcagccaactttttaattgatatacagaagcttttgtcttatttggcatgactatatcttttataggagccagcatctgcattagcaacagaagatacctccttagaaggctcatcattagctgaaagtttgagagctgcagcagaagcggctgtatcacagactggatttagttatgatgaaaatactggactgtattttgaccacagcactggtttctattatgatt

SEQ ID NO: 116087 - DNA, 1050 bp, Homo sapiens
ttatgcttgctttagttttcatgcctttaaaagtattatcaatttttttaatgtattaagtggaaccatatgaaattgctgtttcttataagttaaaagtggtcaagtattgacaattttatatgattaaatttaatatttagatttacttgtttctcacactaggaaaattagatcagttattgaatggtaaagtattttggaagattaaagcattttttattgttatctttaattcattgtcttctgaaaatactatagttgttcaaagaaatatttaccacatttgaatgtatttggcattttcgttaagtttattttatcttacatgaatagaatttatttttttcttgactttcaaaggaaaatcaactctattatgatccttccactggaatttattactattgtgatgtggaaagtggtcgttatcagtttcattctcgagtagatttgcaaccttatccgacttctagcacaaaacaaagtaaagataaaaaattgaagaagaaaagaaaagatccagattcttctgcaacaaatgaggaaaaggtaatgtctttacaattttaaaaattgacataatggtgataacatgataattaagacaaaattttttatgaaactgacaatcattcaataactctgcatttcaaacatacccattaagataacctaggaaagtttagatggagcaaacatggactttttcataaactctgtcactagaaatagaaagcatttcttaaaatttgaaggagatagattaaggtcagataaaatatctcgtatatagtttggaagaagaattcagatcctcagttgataagttgatgtcaatgcacagttcataataaaagataaacacagtttataggtagacatagatacaggttcaactttcttagttatgtggagcaattttttacttactaggacaatttttttttttttttttgagacagagtttcactcttgttgcccgggctggaatgcaatggcgtgatctcagctcaccgcaacctccgcctcccaggttcaagtgattct

SEQ ID NO: 116088 - DNA, 1015 bp, Homo sapiens
atgcaccaacacgtctggctaatttttttgtaatcttagtagagacggggcttctccatgtggtcaggctcgtctcgaactcctgacctcagctgatcctcctgcctctgcctcccaaagtgctgagattacaggcatgagccaccgcacccggccaggaaaatattaaaaaaaaaaaaaaaatccattgctgacaactgtggagtgagataacatatttattaggattaatagtttaaatggcctgcaagacaatggttaagaaagcgatagttacatttaatttaaaaaagtattatgtaggctttcagatggtacttgtaaagactaaggggaaccccaaaaatgcttatgatgatgcaatgttaaattgaaagaaggaaaatataaaaagttaacagtgttctttatttctactctctaaacaggtaagtttggtggtttataggttataaaggaggcttgtttgttttattgatattttatgaactgtggcaactatttgatatcttactcttgaaattttatctcatggtttcctgtcctgtcctttcctgtcctatctctgtcctgtcttgtccttctgtcctgtcctgttctgtccttctgtcctgtcctgttcttttttgagacagggtcttgctctgtcacccaggttgagtgcagtggtgccatcatggctcactgcatcctcgacctcctgagctcaagtgatctgcctacctcagcctcccaaagtgctgggattataggcgtgagccactgtgccagccagtttttcttttcttaaccaaagaaaaattacttgatactaaattgtaaagttcacataaggaattaggattctgttagattttttctgttctcctatttgatttgcttctgttctatttttttgtgaacaatacttaggaatagaagagtatgtgactaaaatactaaaaatcagttttctgtttgctttcaagatctctgttttaatggcttgtgcttgttactagtggtttgattgttt

SEQ ID NO: 116089 - DNA, 1266 bp, Homo sapiens
ctcattaataattttactttttaaatgtggctactagaaaatgtaaaagtacaaatatggtttgtgttacatttttattggacaccattggtctaggctatcccatagtccaggcagtatgtgatgagggcctgaactaggaatgttaagacattgagaatagagagacagatttggatatattttgagaaaagtctgtagcacttcgtaattttatatatggttaaggggatctcagagataactataggatttttaatttggataataagaagatggtaatatcattaaccaagaaaggaaatgtgagaaggagagggggaacagattgtaaccattgttattttactgacacatatcttcacgaattcgttgaaacttgatgtaatgttataagatagtgatgtttaagagtattctcccctgttccctcgtatctacccacccttctccaggatttgaactcagaggatcaaaaagccttcagtgttgaacatacaagctgcaatgaggaagaaaatttcgcaaatatgaaaaagaaggccaaaataggcattcatcacaaaaatagtccccccaaagtcactgttccaactagtggaaatactatagagtctcctcttcatgaaaacatctctaattcaacatcatttaaagatgagaaaatcatggagactgatagtgaaccagaggaaggtgaaattacagactctcagactgaggatagttatgacgaagccattaccagtgaaggcaatgtaactgcagaagatagtgaggatgaaggtgagtaaataatcattatttaagtaaatagcccagtctggtaactataaaagagcaaaaccattaaaaatgttagtgagttgtagtatatctgccagaaagtaaacattattttaatgatgttattgaaaatgttgtgggttgccacttggttattcttagagagtaggatgtgaataaatgactaatacttagaccttcagaaggtttcattgtattgaatggcatagtcagtagaatacaaagccaggttacctggattctaatcttaaaatatagattaaggctgttttagtgggttagatatttgtagtctacttttgtaactgagagagaaaaacaagttgtctttaaaaagtatacattatgaattcagctacatggatattatggtaaatctaatttttttttacttgaatatataaagacatacttttaaaacacaggatttcatattacagttggccttctgtatccatg

SEQ ID NO: 116090 - DNA, 1072 bp, Homo sapiens
gataggatttcactctgttacccaggctggagtacagtgatgtgatcacgactcactgcagcctcatcttcccgggttcaagcaatcctcccgcctcagccccgaaggtagctgggactacaggcatactctaccatgcccagctaatctttatgtatttcatagagatgcagtttcacctgggtgttcgctaggctggtctcaaactcctgggctcaagtgatcttgcctctgcctcccaaagtgttgggattacaggcgtgagccaccgcgtctggctgaggctctttatatttctctttcctgtactatgttttctgtgttttctctctcctctcttatggttgttatcttttttcctgttttgcttttctctttttttgaccttccattgttcccattttgcttttatttaacggactgtaatgtggacctaaagtagattttatgtgatgtttgtctttttggaatataatttctcatttttaatttgaaagtccatttactttcactttctggggactcattcagaaagaggaaaaagtcctcttaattttaattctaagcagattatgttgcttttttacttttttactatgaccttgagtctcctgcctccaaaaaaataaaacaacacctaatctgtaacttaaatagcaaagcgatctgagatccttccccacctccagtctaaaccatagatagttctatggtggctttttctttttctttgtttctttttttttttttttttttttttttttttatagagacagggtcttaactgtgttgcccaggctggaatgcagtggcacgcaccacagcctctgacacctcctgggcttaagtgatcctcctgcctcagtttcctgagtagctagcactataggcacacaccaccacaccaggcttctggtggcatttctgttttttctttcatttaaactaacatccgctagtggggtggataatttgttggtgaagtcagtttgatagcacatataacatgtatccaaatagatgaaaaacttttaaaaaagaagcttaatgttaggggaaaaaacaagtattt

SEQ ID NO: 116091 - DNA, 1894 bp, Homo sapiens
gatcaagaccatcctggctaacacggtgaaaccccatctctactaaaaatacaaaaaattagccaggtgtggtggcgggtgcctgtagtcccagctactcgggaggctgaggcaggagaatggcatgaacctgggaggtggagcttgcagtgagccgagatcatgccactgcactccggcctgggcaacagagcgagattccatctcaaaaaaaaaaaaaaagagttttggtagtaatccaggaaatgcaagttaaaatcacaatgataaggcaatttcacacctcttaggctagcaaaaattaaaaattttggcaacatcaagttttggtttagtatacatagagcagcaagaattctcacagactgctggtgggaatatgaattgatacaaccactttggaaaacagttatgtagtaaagttgaagatttgcttatgttatgatttagcaattccattcctaagtgtgtattccagagaaacatttgcattttgtacacaaatagattgcaggtacaagaaggtttatagtaatatttttaaaaatagtaaaaccttggaaaaaaaccctgaatgtctgttttcagaaggatgggtggatagattgtggtatatccacacaatggattaccattcagcaaaatgaatgaacgacaactctataactgtgtataacaactggatgaacctcatgacttaatgttaaagaagcaaaataagaggaatagatagagtgttatggaacaaggagggaaagattagtcctaactattgaacatcttggaaacttctctgagaagttggccttgagtgtttcaaatcacattttgtattaagaatttttggccaggtgtggtggctcatgcttgtaatcccagcactttgggaggctgaggcgggaggatcacttgagctcaggagtttgagaccagcctgggcaacatggtgaaaccctgtctctacaaaaattacaaaaattaaccaggtatggtggcacatgcctgtggtcccagctactcaggaagctgaggtgggaggatcgcttgagcccaggaggtcaaggctgcaggaagcggtgatcacaccactgcactgtagcctgggtgacagagcgagaccctgtctcaaaaaaaaaagtttttgatgatatggaccaaaaaaaaaaagtttttaatgatatgtacaaatacttacattaggtcaaaatttttcaaattataatctctagtaccaaaggagaagaggtaggacatattctaaatttttcatggtaattaaaggtagatttatagatgacattttcttctatagcctctgtttctaccagaagcatataatagtttgtgtttctaaaaaagtattaagtataataaaatttaaattatcaaaggctcaagttaacatcatcatatcatacagaaattgtccatagttttgaaaagtataataattaataattgcttgatttcactttctaagtttcatgcagaaatttattttgaccatgacttacaaagttatgtccttgtggatcaaggcagtcaaaatggcacaattgttaatggaaaacagattcttcaggtgagtgtatatgtgttaatttgttacctgcacattatttttaaactgatttttttttatttctgaagggcataatctttatcatttggttcagagtagagttaagcccaaatgtgttacttcggaaggaatttccagaaaggctgaaaaaagtgtataatcagtgggtacttacttggctgttgagttttgacttctaattatgtatctatgccttattttcagttatgactccattgtaaagctattcagagtaagtgtgtaaatgtctcaatagcaactttgaaggtcgtccctttttttattgtctta

SEQ ID NO: 116092 - DNA, 1073 bp, Homo sapiens
tcagttaacacttaacatcctcagcatgtagcaaagtatttggcataaataagaaaatataggggctgggcgtgttggttctgacgcctgtaatcccagcactttgggagcccgaggccagtggatcatctgaggttaggagttcaagaccagcctggccaccatggtgaaacctcatctctactaaaaatacaaaaattagctgggcgtggtggtgtgtgcctgttatcccagctacttgggatgctgaggcaggagaatcgtttgcaccggggaggtggaggttgcagtgagccgagatcacgccattgcactccagcttgggctacagagtgagactgtctcaaaaaaagaaaaaatataggaaggcgggaggccttattcttagtctgtaagagtaaaaatggaaataaaactgagttatcaagagagaagaaaagggagatgtgatgcatttatcccattctcttaacatttcatctttttttattgtgatgattatatgttttggtaatagattgaagtctagaattggatatttctgattggatagggagactggtgggtttgacaagttgctcagttcagctatcttcatctccaatagtagtactttttttatgggtcattaagttggggaagtgtgtgcatgtgtgtatgtgtatgtgtctatttcatttatagctattttaaatatattttaaaaattataatcagacattacttacagtagatgtaaggtaaccataagtgattgttttgatttctgttttgtaaaatgtttcccctctagccgaaaactaaatgtgacccttacgtacttgagcatggagatgaagtcaaaattggagaaactgtcttatcctttcacattcatcctggcagtgatacctgtgatggctgtgaaccagggcaggttagagcccaccttcgccttgataagaaagatgaatcttttggtatgtgaaacagattaaatgtggctgtgataacatttctctttcattacctaaatgttctaaaaaacatcagtcagctactggctacatgtctaattgatacgatactgcatt

SEQ ID NO: 116093 - DNA, 1275 bp, Homo sapiens
aggctaatcatagaaaaaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttgtcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatatgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatgaaaaagagtgattttttgaaccggtgatttaaatgtattgatctgctttgaattttcaagcagccagaattttctagtttaaattggcagagttataacaaaggagagcctcaaatattagacaattgcagtgcggctttctgggcacaggtgtcactgctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaa

SEQ ID NO: 116094 - DNA, 1026 bp, Homo sapiens
ttctgtcggtctttttgtctttttattgtgtttgaagagctctttgtgtgttacggttgtggctgaagtgtctgaagaggtttctccccctccacattgcaggggcagctgaaatgcactcgagttttttgttttttgtttatactttaagttctagggtacatgtgcacaacgtgcaggtttgttacatatgtatacatgtgccatgttggtgtgctgcacccgttaactcgtcatttacattaggtatatctcctaatgctatccctcccacgccaccccacgacaggcccctgtgtgtgatgttccccaccctgtgtccacgtgttctcattgctcaattcccacctatgaatgagaacatgcggtgtttggttttctgtccttgtgatagtttgctcagctaaccaggctgttacggcctgtggccatagactgctggtcactcagcagatactgagactgaggattgtattgagctagaatatagccgcatgatgtggaggactgagaaggtgaggcagttttgccccgtgctgccttccaccggttaagacctccaaaatcgaagggctgcccaggcagaggatgtccccttgccacccttggaggggcagcgctgtgctggccgacatttgtgatgcagcctgtccctggctcaggtgaggcttccactaggtcaaaaggattaagacatcgaagtcagtgcttctcatccttgtgcccactttaactcctaacagatggcattcacctgtgcgacactccctctgggcattccagtttttaaggaaacccagagaggtaaaaagcatgacagtaatcagtcacctctggcactatcaggggcacatcagtaaggatgactctcagactttggcacaagtaagagaatctgcgggtttatgtgcagtttccaagctttggctcaagaaagcatatcagaatgcaaagcaatactcttgatgttataggaaacgtttacatcccttttaatttataaagtaaattagtcgtaaagattca

SEQ ID NO: 116095 - DNA, 2066 bp, Homo sapiens
cgtgggaattatgggagtaggattcaggatgagatttgggtggggacacagccaaaccatatcacacaggtatcagaattattgttggaagcatctctttcccaaccagaccgtacgcttcctgagggcaaagactatgtgacgttcctcttggaatgcttggcagaaagcacgcacctgaccttagcaggtgcacaatgagcatttgaatgagagttggatggagtgaatggatgtaagcaaaatactcattcattggcatctttgtgttagtttaaaaattttttcaaggaaaaattaagggagcttttttcattttcttattagctaaccacagaattaatgatatgcattctcattgggtatttggtaaggaagaaacgcgttatcacagggctttggctaattaaacctccccattatcttattttaccctagtgataaataacctattttgcatgaagttcaatttaggaagtgaaaataaatttaaggggtaagggtcttggatctgttactcttttttatttgctctttgtagtcaattcccaaggggattcctccaacttagactacttactctgttgaataacataatgtcagatggaaaaacaactgccttttagccattaaaatcttaacgtgggcatgtctgagcagtaaatatcggtagtttctttattgttcatgtcttaaatttatataacaccggagagtccaacagtgacatcatttgcactatctatgatctcagccacctgtttagaggcaaataatcttattatttctcttgacagatgggaagattgagactcgggtgggctggggctaaagaaacagagtcaggttcacttcacttaatgcagcatcccccaagtgtctaccctgtgccagggagatgaatgggatgagctcctcttccatgacatcctgggtgtgaacacagaatctccttctgcagagcacagcaaaccacgtgacaatgagcagcctcacatgctgggtttcctcctccaagcggcgcagcagtgggcttccccatgggactgtcccaccagcctccacagttaaggctgggctggccctgcctgagctcacatgcttgaggagccaagggttgttttgcttttttgtttttgttttttgtttttctgagatggagtttcgctcttactacccaggctggagtacaatcgtgcaatctcggctcactgcaacctccgcctcccaggttcaagcgattctcctgcctcagcctcccgagtagctgggactacaggcacccaccaccacgcctagctaattttttgtatttttagtagagacggggtttcaccatgttggccaggctggtcttgaactcctgacctcaggtgatctacctgccttggcctcccaaagggctgggattacaggtgtgagccaccacacccaggcccaagggttgttttataaaattattttttatttatgtagagatcctgtgatatacacactttccctaaatgtatacacgtgatcacatgcatgctttcttagtacctcattgcttttacttttgtgtttacctcttccccttctccctcctttcacatcagttaccattgcctcaaccatagtatctccttatttttcttcatctatagctatatattgcctctacagatatgtatattacttaataatagtgggatcatattatacactcttctgcatctctcttttctccctgaacagttcctccagatatccttgtaagacattgaacagaacttcatccttttcctctttaatggctgtataatattccctggtatgaacatatgttatatactcagccattttcctggtggtaggcattcccttgcttccagtttcttgtcattctacatgattctgatgtagattctgatgtcattctacgtgaacatcctgatacaagactgtgtttattggtgctgatagttctatagaagagatccccaggagtagaatctcaggttatcttttttttttttttttcaatacagcatttcgctgttgtcacccaggctggaatgcaatgg

SEQ ID NO: 116096 - DNA, 1078 bp, Homo sapiens
tgaagactagagtctaggatttatgacagtacaaacctaccagttgcccattcgttacagaggcatgtgctgaacgctatactttgcttttgtcaagctctctctctctccccctccctgttcacacaaagttagctttaggagcaattttcagggatgaaaatgttaaatttggtgaaaatattaagttgggatattatcagtaaagaccatccttttgcctgacggttgaagacctgaagcagtagttcaaaattgtgacagctcatgaactttgtgatactttttttggttgctccagagaaattgtgaatttttgttttctagaatatctataatctcagtttagtacttggcaactctagctactccatgtttgttcagtagaagaaagaatactgaatgaacccattctgtacatttttaatacttccctcaagaggctgcttagagaccaaatgaagtaaaaactgaagggacaatgagccccaattattagcagcttgtataaacttgtattaatctcattgctacttggcttaagtattaaaaggcttgacctgggtaggagtttaactcattttgctttatcaagaagattcccaaataagagcttaattcactctaacccattactgggaatgttggaaatgaaacccctggttcattgacttaacactactttgcattgtgtggatctcagaaagtatatatttgaagtgaaatttgagaccagagttatttatgcaaatcttacagaattattatcacagaactgccctaatatatttaatagtatccttttaggcctgtgactcggtgttgtattgtcttttctcaatcgtaaagttcacatgttctgtgcccttttgttgctgagataattttataaaaactttacattcatttttttgtagactaagcattctttttttgccgtaagagtttgagatagttgctaggcacgtggtggtgccccacccctttccaaagcacacaggtggaaaaataaaatctttaccatttggtcctgtttacagtggtggaaggttgtaatagtttccaccccctccccctg

SEQ ID NO: 116097 - DNA, 1065 bp, Homo sapiens
gttctgcttacagaggtgtgagcatagataaggaaagacaagggacaatgagatgcctagactagcaactgtatttagcccttaccggccctaggactgtagactgaggggcccctggcataagcggtactcatgaaggcacatgctattgccaggacagggcactgaagcagcgaaggagtgggaaagaagtgacttgacctctctcagctctcatcctgcagtgccctgccagtgcctcccactggtcacatccaacatgaagccagccacaagggaggcttgtgcaggctgcacagatcagcctttcaagacacagagcagggcagacagtggatgtggatgggcatagtggtttttacaattggagactaacttgcacagtaatcaactgttttacagtgatcacattgtatattttgttaattttagaatgtattattttggagaactttgagaaattttgcaagcatagaaaaacatccatttttcatatttaaaaaacgttcctcagtatttcacatttacttatgcaaaagcttcttgtcttttaggttgtaaactttgttatgaagtctcttaaactttgtacattctccttattttcccaatatattagtgcatatcattgtattgcgataagcctgaaacagagagggccacactgtctttcagattggcagagggtgctttaaaaattcctcttttctagataggggcatagatatttgtgaattattcaaaggtgatcacttgcctttaaatcaagttaatcaaagtggaatttagtttaatgtctttcgtagctcatagcttagggggaagatgctgtgtgtttgagacattcacatagctgcatatatcatctccttgcagacatagctgggaattattttgctgcacacattagtgaaatataccaacttgaaatgtttgtgctaaccgagtgacctgttttctgtgtcatcatgtgtgtaattctcttatgtctgagtaaaaggctgagatgaaggtctgtgtctctggatacccgtggggttgctaggaaatgattttcgaagtgct

SEQ ID NO: 116098 - DNA, 1014 bp, Homo sapiens
aacacatgtagatacctgttgttatgtttaagatcacagagtaatacttctttgttctctaaggctttcaaaaggctttggtgaaaaaaatgaatcgtaacctatcttttctcataagtatacctgaaatgtcaaaccaagaactgtattcaataatagtgaggtatgcgtgcggagtgcaatattttagccaactgcaagacgccattcctatagttgcagaaatgaagatatcagtgtgagaaggtaagtgtaacaagtaatcatgatacgggttagaagagcagaggagaatattaacctaactcaactgaaatggcttacaggcgcagtagtatattttcttatttaaattgctccagtctacctaatttgaactgtatactgtcttagtaccaccacttgtaaacacaatttaaaataagaaacaagaataaaagggggctttaaaactgctaccaaatttgtcactgcactgcctcataagagacagcaagagctagtcttatcaacagtgttttccaggcacctggtccaaaactggacgaagcactgtagggaaggatttcctgggcagcagctgtctttcagaagtcactcttggagaaacacactctatgtggactaatttgttaattttgagagctggataattaagctttaattaacacattttatcaaatgacaaattcctctcttgcctaagtattttctctaactatgtaaacaggtttcaactaagtatataaacaggtacttcagactattatcattttcatcaattcaagaggttgcctttatacatgatcttagatccaatctccaaaatttattaaacattcattttatgattatccacaaagcatgaaattttcaataagtataaagccccataagacaaagtaaatgcttatcaacagttgaaatgaaaggatattggtagaaagaacacactatttcccacccctgccccccacaacaaacactaccagaccacaacgtttattcaggctc

SEQ ID NO: 116099 - DNA, 1133 bp, Homo sapiens
acaatattaacaaaattctgattaaaatattagatattatttgtatgtgacttaccaatactgaaaaatgaaatgaagttctacacccagatccaaaggagtctttaaggcacatatctcacacgcacatgtgttaatgtggtattagacacttctctgcttttcggggtccctataatcagttttaattttctttacagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttga

SEQ ID NO: 116100 - DNA, 1001 bp, Homo sapiens
ggtcttaatcaccattatttaggagctggagatagctgacagtaagggcagtgtgaataatgttgactatatgacaacagtaaacagaggatgcatgaagggttgtggttatatgtgtatacagttaaagccttaacagaatcgaattccaggggcctttatcaaattcatgaacagagtcctgtttctcctgcctttgaaggataatagtttgttagctttaatgaaacctatgccttgattttcattgtgcaaatatgaaagttttagttgaaaattatgaaatgcgtaagcttttaacatgtagaaatccagatacattaatatttgctgcaggcatcattgcctgtagtgaaggaataagatcagttgaggtaacagattagctgtgagaactaataacagtgtaatcagggccctaaggaatttcttaaattgttcttccctgtttcatagccaaagaacaaaaaatttcttttcatttgaaagggcattcatgcttaggaggagcagcggcagcatccttgttagtgagcatttcctgtatttcaggcactgtgctaaacactggctgctggagtttacagagagagatgaaaacagtccttgccctcatggatcttacccttgagtggagagaaggggtatagacctaataggctgttaccctaggctgcatttgatggacccaagtaagcagcagtgactcagaagaaacatttcttgctgaatcttgtaaatggttagaggatataggacttgacacttgagctgaaccttgaagtttagtaggatgagtatatagccttgtcatcataagctccttgatgttggggtacagtgtcatagttatctttgctttcctctaacaagtagctcagtttttaactttgtgtttatggttgggaggtgagcatggactgtggtaggcagaagggcaaagatagcatttacgtggtggcaaggagcaccttggctaggccggagcgctgggttcctgt

SEQ ID NO: 116101 - DNA, 1005 bp, Homo sapiens
ttcaaaaaaccagcttctggattcattgatttttttggagagtttttcttgtctctgtctccttcaattcttctctgatcttagttatttcttgtcttcttctagcttttggattagtactttttactttataaactctatgactataaaattatactacagataataaataagccaaaggcgtatttaggaatcaaacatgaccaagtagtctgttaaaatttgaaaatgatctgctgacagtctcatcttgcagtacataggcacgttagccatgatgtggatgtcagtgatcctgaaatgtttatgttgtacagttccctgcttcacttgcaggagctctgctcctttctcctcacccattaccaatgaaagatatggccagttgcttgggattgtacatcacagggcaaatctgttttcagaggggtggccccagggcaaccttagaattgtatgagagaataccaacaagtgtggataatgaataccagatttgctaaaaagattggaatgcccaggcagaaggttttctaagacagacaaaaaataactgataatctctccaggcagaaggctctgggtgctcctttattttattccttttcttgtattatgttgccagcatcttttggtaatcatgaagtactagtacttgtgagggatggatagacagataccaggtgagattttcatactaagtggcttttgacacaggatgaaaatccatccactaataatatataattgaggttgtttgtcatgaaacattttgaatgacctgtttgggaattagtttgccatgtgtaaactgcttaaaaatatgtgctgattggccaggtgcagtgactcacgcctgtaatcccagcactttgggagcttgaggtgggtggatcacctgaggtcaggagtttgagaccagcctggccaacatggcgaaacccgtcactactaaaaatacaaaaattagccaggtgtggtgtcacatgcctgtagtcccagcta

SEQ ID NO: 116102 - DNA, 1070 bp, Homo sapiens
tatttggcagtctctcttacccaaatgaattctaaatttactctgcttgggtttttactacaggttgagcatccctaatctgaaaatccaaaatctgaaatgctccaaaatccaagaccttttaagcactgacgtgatgccacaagtggaaaatcttatacctgacatcatgtgacaggttgcagtcaaaattttgtttaacgcacaaaattaccaaaaatattgtataaaactaccttcaggctatatgtataaggtgtatatgaaaaataaatgaattttgtgtttagacttgggttcagtccccaagatagctcattaggtatatgcacatattccaaaatccaaaaaaaatcagaaacacttctggtcttaagcattttggataagggatacccaacctgtaaaaactaacttccttaattaaatactgaaggtagataattttttaaagcgatagccttaggagctcaggttactgaatattaaatgttctgcttgtgaatagtgaaataagtgaaaaggctgtgagatactactagaattctggtaaatataaggccagaaaacatttcctaattactgggagcattttttgtatgctagcagttttagtgtgttatatacataaaatgtaattctcatgataatctagctccatctaaagcatgacatagaatatagatggtccccaacctagggtggtttgacttacagtttttcaactttatgatggtgtgaaagggaggtgcattaagtagaaactgtactttgaattttgaagtctgatattttctcacactagtgatgcatgggatgatagtctttcccagtgctgggcagcagcagcctggagctgcagctccttcctagtcagctataagatcacaagggtaaacagccttactctacagtgtactgtgttgccagatgacttttttttttgcccaactataggcttatgtaagtgttctgagcacatataagttaggccaggctaagctatgatgtttgatagatgtgttaaatgcattttgacttaggatattttccacttagaatgggtttat

SEQ ID NO: 116103 - DNA, 2004 bp, Homo sapiens
atgccaaagtatgaaaattcaaaaaatacaaaattttaatcttatttaacaaaatttaggttatcactagctatgccctgacttccaaaatgaataaatgaattgtgttgatttttgtgagacacacaagttttctttcaacattgcgtaatagcataatgtaacatttttctcatgtttgacttaatattacaaaagccttttttttttaaataaatacttaaggcttcaccagtttcttcagagcctcccttcctgatcatttgttactcaaattattcttttttgaagtatcttcctctcaccttaattttggattgttatctagtctgactgtgtcagatctttatttttcaatggctttgcctgtgataaaatcagttctttaacattattttcaccacattcacgaagtcctgcaatcttggaaagatttgccatttacattgtatttttgcatgtttactacttggtaaattagtcagagactgatggatgaagacactggatgggtaggaatagatgttggtgttaaataacgatggagtggagactgactttctaagtggttaataaatgagtggatatatatacttatttgtgtgtaggtacatatacagttgttatggtgacttttattttcttctatgaccttataactgtggagacttaaataacaaatacttggacaatgaggactccatatttttttcctgcaaactaagttactgatgtttttatgcttaatttacacaattatatttttaaatttatagaaaaaaatactcaaaattttctataaaaatatactaaaaattagcattttgttttagaaaataaaactatagttatggctgtactttcagtgcttgtttagattctgtgtgattgcttaagttaaattctgaataagtaattttaaatggaatgtatatgtatcttctatatggtagttgtacttaatgtagtcatttatgattatctaaattgtgaaagctaagcctattaacatttttattggtatttcagacaggggaaaaacttttagaactgaatggacacactcaaaagataacagctattattacatttccttccttggaatcttgtgaagagaaaaatcaactcatcttgacagcctctgctgatagaacagttattgtatcctttaatctggaagaaatgaacaagctgtagtggcctaaggagccactacatacactattagtctttagctgatagggtcttgtctgtatattcttgttatagcaaaaatgatttttgttctgttacttataagataccatttattaggtatctgaaaagtattagactggaaataggaggttaaggcttgttattgatggaaactccgtgactattgctgttctttccagagttactctatcaggttgtataaaattgatgaaatgggaaaatgtggacttaaaaataatttattttactatctcagtttgcttttcaatttagggaaacaacgatgagttggactggagaataatttacattttttttccccactatacagcagaagaaaccaaatggtcccaacccataaaaatctttggagcatctgagtctgatagaaaagtgaattactgtttgttcagtgtgtaatatttaataattaaaaacaattttataaaagtaaaattactttttctttacccatacttttaggtaaaaagttaagatgggatagcagtagtaaagtgcttatgtgtaacaggcattgttctaattgttttacatatattaactcatttaatctttaaaattagccctttgacataggtatttttaattcttttttttttttttttttgagacggagtttcactcttattgcccaggctggagtgcaatggcgtgatctttactcactgcaacctctgcctcctgggttcaagcgattctcctgcttcagactcccgagtagctgggattacaggcctgtgccaccacgcccagctaattttgtat

SEQ ID NO: 116104 - DNA, 1075 bp, Homo sapiens
gaaacttctggaacaggtggaagtcctcccgggtagatgtgagctccatcgggaaaagggtgtcacaaaaacaggtgctcagaggcaggggtgccaccgcggcaccccagaaccccgggtcagctcgcgcggacaccgcgtctgggagtcctggcgtggaagggcctcgggggttctcattctctccaagtctctttccacattttattaaagtactgaaaaggcaacaactctgtttttaccatgtcttttttttaagtctaaaataaattattccaaagggtcttaaacgggtacctctgatctttctggtttattaggccaaggacgacctatgaatttcttctctgcatcacagtgtatacatgtgcatgctcccaatgtccagaggtggtgatgcctcagtatttatttctaattaggttgttagccctctccttggctcagtttcatcatttagacccattcttaatgggacaaggaaatttacgttatttacacaaggtgaccaatgaggcagctgacacactttcctttattcatccaaccaacatttgctgagcatctactatatgttgggcactgagggggtgagagatgaacagagagacagatgcttggcttagtagagctcacaatggcctgcattgaatttttccactacagtagactgtggccatcaggatttgtacctgtaggaggcaaagataacccaggaagaagctcagtttgttttggtgggctctcaccctctcttaccttctcagtctgtattttcttctcacccagaaacctgagatctcaaggaagaaagtaatttgaattaactttcttaggtgttaagagttaatgtaatatccttcacggaatgttcccatttttgtaaaaggactgcaaggagaggcacattgcctagataagtgacttttccatatctgcctagtggtggtgggagacttgagacagaaggatttgggggttactgtgatccaaatactggttccctaatcagcctcaccagtgctgatggaaactcttgcatatttttaagaaatgtttttggggggtgtgaaag

SEQ ID NO: 116105 - DNA, 1037 bp, Homo sapiens
ctgatgccaatggtcctacaagcagctcccacaagtctgtaagtggccaagcagcatgagcaccctactatcctgggcaggtgcccggaaacctcggaggtgctacttggcatgaagcaactgctccttgcagggcagggatgtgccacagctgcagccctttgagattctcacagtcccgttttcaatttggagcctagagctgaagagataaattgagaatattgatcagctcatcagctcacaattaagatgttctttttcccccttccgaaacttggtgtatggctgtggtaaagggaggaatggctgtccctcatagcgactgcacacaggctctcaagccacttccaggttaccacaccataatatttttgttgtcattcattcttatctatccacagccatcaaatatcacctcctttcatgaggggatggtgcaaagtgggcagaccttcaagtgagaaagaaacagggataagcggctaggaaagggcgtcccaccaacacttgtagatcggaactgtcaaagaagtccaagtcctctgtctttctgtggagccacaagatctggagaaagggaagtgtgttcatctcaggaaaagattgaggactcaacttgagaaaaagaaaaagggggtagtggtggaataaagaagtaggcagcatcaaatctgttcaggccacatcttggcagaatactatgcctgccctctttgcttccagaatttcaaggccaggtgacatagcatcataaaactttaaaccttattgctgttagaaaataaacatgtgtgtgcacatgcacacacacatacacacacacagacacacaaatactactgtctaagctcacaagcactggcattacctgacccctgtttatctctctacctccacttctgattggtaggacacacaccagccaccttagcctcctgaaaattcataaaataatttttcctatgattcaaggcccttacacatgattttccctttccactcagtgctcttcccctattcttcacatagcaggc

SEQ ID NO: 116106 - DNA, 1017 bp, Homo sapiens
tccagcttcttccccccagcatggggagatgtttaaatgaataacaaacatcgatccacagatgtctacaaaattgggaaggatggtgaaaatactacatcctttgtggttatgtttcctttttgactgctcagtttgctgtaactggtgagcttgcttttagaagttggagctagaagcatcttaaagatgatctaattttgtaacccccagacttggtaaatcatgatactcacccggggggtatttaatacaagtcctattcctgggcccaggcccagatccactgtatcagaatctccagggatgcagccccacaatctgcatttttacaaacctcatggaaggattttggcaattagccaggagtgataagctctctcctgaatagctacatcttcattttacagtttggggaaactaacacattagaggtgacaccagtgcttctcaaagtgtgacccttgcactggcatctttagcaacatctgggaacttgttagaagttagaatttgttagagcttgtgaattctcaggccccactccagacttactgaatcagaaattctgtgttttaattaaacctccaggtgagtatgatgaacactcaagcgtgaggactgttgtgttaaattatcaccccagggtagcagttggtataatagacagctaggtccaaaaggggtcttactcacgatttctttttttgaaaagaacgcagtggcatggtctcggctcactgcaacctctgcctcccaggttcaagtgattctcctgcctcggcctcggcctcggcctcctgagtagatgggattacaggtgcacgccaccacgccctgctaatttttgtatttttagcagagatggggtttcaccatgttggccaggctgatctcaaacccctggccttggcctcccaaaatgctgggattacaggcatgagccaccgcacccagcccttcctcatgatttaatcacatccctcattttatggaagagagatggagatccaaaaa

SEQ ID NO: 116107 - DNA, 1018 bp, Homo sapiens
gtatcctcagtacctggcatcctgaagacgtatagtaaacttattgaatgaattggggtagtgtatgggagagcctgagctttggccctgtgtaagttggagtcctgttttgatagactgaggattcttgatctgtaataatagatagaattttaatgaatagaagttatttttggatggcattgtctaaagttttttttggtggctaaaacttagaaaatatttctttttacaaacacatattgtgacttgtcatggatttgacctagtcatttcatcttgtttaattcctgtaacgattctgaagggaattccataggaaaggaaataggaaaaagccactaagaaatattcctgtcactgatttttcacatatattcagattaaccagatacacaaaaataatttaatggcagtggttaaatgtgtaggtatagtatgattagctctgaagtaaaataatgatgttatgtttgaaattttcaacctgtgccttattagtaaaagaggtttaagttcaacaatagatttccacctgagaaaatagatgtgaataaagaacttctttgtatgttataattgagatttttgttttcaatatgagctctgacaaagctatttgggaaaggaagaaggtactgggacttaaagtttctattaaaatatagtattattaccgttaatctccttagtaaaaagctcagattgtctacctatttctttaaaggtatttgaccaaacattgtttttttggaaataaatgtttagatgagctctatgtttctttctgagaatagtttaaggaaataaagcttcctgctactctaagaaaaagccctatttgaagtccaatatgtggcattaacttatttactcttatcaattgggtttccctgtcattgatttgattttttttctttcatgatttgatgtgttatagtccagttttgaatgatggactttacgtccagaaatatcctctagaatacatatttctgtgtttaattctgtagtgtct

SEQ ID NO: 116108 - DNA, 1099 bp, Homo sapiens
ttcatacagttttgtctattgcttttctgtttttaattttgttgatttctgctcttatatattatttccttctgcttgttttaggtttattttgctcttctttttctaggttctcgaaacaagaacttatttaaattaaattaaaacaagattattaatttcagacctttccttttgattaatgtaagcatttagtgctgtaaatttcccaacagacactgctttagctgcatcccacaaaatttgacatgttatattttcatttccatttatctgtgtctttatttgagacttttttttggcccatgggctacttaaagtatgttgtttaatttctaagtagggattttccttctttctgttatgatttctaattttacttcattatagtcagataatgtattatgtaggatttcagttcttttaaatttgttggggtttttgttattgttggggttttttgatccagaatgtggcttacttcagtaaatatttcatgggcacttgaaaagtatttgtattctccttacttattagaacattgtattctcatttctgaggtagagtgttctacaaaagtcagttacaccttgtgcgttggtgttgttcagttcttttatacctttactgattttcatctaatatttctatcagttgctgagagtggggtattgaaatccccagcttatgtatatggatttgtctgtttttcctttcagtgctatcagtttttgttttacatatttttaaactctgttgtttaatgcatgcacatctaagatcactgtattttcttggtagattgataattttatgataatgtaacatccctctttgtctgtaataattattttgctttgaagtttactttatctggtattagtttagccactcctgatttattggctttttagaggcaaggtctcactcttttgcctaggctggagtacattgtcacgatcatagctcattgtaacctcccagctcctgggctcaagtaatcctcctgcctcagcctcttgagtagctagaactagaggcatgtgccaccacactcacctaatttttattttttgtaaacagagtttcactgtgttgc

SEQ ID NO: 116109 - DNA, 1056 bp, Homo sapiens
acaaggtcgggagattgagaccatcctggctaacatggtgaaaccccatctctactaaaaatacaaaatattagccgggcgtggtgacgggtgcctgtagtctcagctactcgggaggctgaggcaggagaatggcatgaacccgggaggcagagcttgcagtgagccaagatctcgccactgcactccagcctgggagacagagcgagactgtctcaaagaaaaaaaagaatttcatgctttgatagattgcacttacgttaggcaggtataggacttaagagcatgaggatcatgcttatatttatgactaaactatttttcttctgttccttcctccccccatctagtatatctactttggtattttaaatataatatgttttatatttacacagtttctttcttatggtctggagagaaagctaattttctaaaacatttttggcttttttataggttggtcaaagaaaaagtgatgtatgaaaaagaggcaaaacaacaagaagaaaagattgaaaaaatgagagctgaagacggtgaaaattatgacattaaaaagcaggtaaaattatatcataaataacaatagctaacatttacagaatgccatattaactaatgtagtttttacagtagtcctctgactgagattatattattatttacttctttactattaaaacttccatttaaagataaggaaactcaaacacaggttaaataactgcgcaaatcacatagttgttaagtgacacagctgaggttttgttttgttttgttttgtttgaaacagggcctcactctgtcatccaggctggagtgcagtggtgtgatcatggctcattgcagccttgacctcttggctcaagcaattctcccacctcaactctctaaagtgctgggattacaggcatgagccaccacacctggcatagctaagatttgaacacaggcattctggctctagtatctgtactcttaaccgctaaattctactgtcttttccaattttaagtatcagatataaaaatggactaatcttatattaattat

SEQ ID NO: 116110 - DNA, 1053 bp, Homo sapiens
cttggttcatagtaagtggtcagtttgttgttagctgcttttatcatcatatttaatttttatttatgtcaagtgattcaagcttttgcctaaattcattacatatgatatttcatgatataccaatatcataactgtctgtcgaacttcaccaaatggcaaaaaagttttaggagagcagatttgttgatgcccattggaaatgctaaaacctcagatgtcattcatccaacctaacttctttcatcagtgttatcaatctttagcttaatttcattagtagtatcattttttgatcagcttcctgaaatacactaacttagattttattcatttctgaaatattgatgtcttcattaacttctattttcattgactcttttaaaaacattgtggagaggcataattaaaaagagattgtaaaatagagataatactacttaaataggatcaaaagtattaaatgcaatacagtacctaaaggtctgttcatataaggccctcaatttaagtttgttcttttccataatccctcacacaacacaaatcttaaatatactgttcgtttattcagagacaggagagtttgttatcagctatatcagtagaggagaactgtatataacagggaaaaggaaattatactagaggctccaaacagggggatttaatacctgtttgaaggaattaatgacacaggtgttggtataatttttataaaatgccaaactttcattagttgatcaggagtcatcttacccactttttacagcatgttttttcttaaactaaatgttattaactgcttattgtgttctaggcactgtgggaactagcctgcccaaagaagactttttataaatccaggttaaatggattctctttttcaccaattgcttcatattacaaccataaccatttgttgcatgtgtgcttttgtgggtgtgcatgtgtgtgtgtcagggggatgaggttcctggagtttctaattattttcatttttataattgagagaaaaaacatgacttctttattatatcattaatatcttct

SEQ ID NO: 116111 - DNA, 1025 bp, Homo sapiens
cattcctttttcctctataaaagaaagcagttgttaccacatttgaatggcagtttggttatatttacatgatcaattaaaggacagattttcccctcatacataatacaagttagagtcagctggctgtaattacagctcctgtgtctttgtttaatcccaaatgttacagttattacttggggtttttaggttgaccagaaaaaggaatgtttgtcacagatgtatgtttatgtataatcatgatagtctatccacagtcagggtcctgaaagattctaccaagtaattcatcagaaatagttcaggaagactgcagaacaacagcttgcaaaaagttgtgatgctcttcaaatgccataaaagacataatttatatatttttttctgtttttgtgagataaagttagagatttttcgtgtttttacatgctaaaacaatactattctcctgtttaagcctccagttgtgaaaatgcaacattttaaaataatgtttactggcaaattcaggaagtcaggctgtaaaatgaccattttactttgagtaaacaggtgaagaatgaaagggtaaaatatttgatacagaatagactttttttaaactacaggctataaataaggtgacttagacaagaaagatttggagggcttcagagtctttcctagctgttaaaattgtgtcaagtacagctctatgccaagtactattaccaaattttatttaaaagtaattaagcagttaaggacttataacgtagttttttaaactccaaattttgatgtggtaaagtacaaattaaatatacattgaaaatggaccctttaacatataccaaatcagtgtatacgtataccatcagataggattattgtgtgaaaattatttgtaactcttaagtttttctgaatgaaaattattaataatgattattttgtcattcttttgtacaaaaggacttaagacatcaatatcagtaatatgaaaataggaatcttcatacatgcttcttggaccattttga

SEQ ID NO: 116112 - DNA, 1315 bp, Homo sapiens
atacagtattagagtagttgaatgtgtgtcgagtctaattcttttttccattttccagagagctgcttttccattaactttgggaaaacacagtggcagattcatttaaaataatctcagctccacccttcatataagtgacttagcctgtgcaataagaaattaagatcaagggacattttttcattagcctgtcgttttgttatttgcattccaaagacggcattacgaaacacaactgtatctgcaatataactcatctcaaggagccttaagacacttatggtagcatatgctaactattacaagatgcctgatggaaggatattaaaattactggtaattgacataaaatatgacaaagtgttttaggctttctgagcaaagcaacacacattacggaggaacggccccataatgtaactgattaatgaaggattgctgaggcatacgcggctgatgttatgaaaaatgaattctttgttgtcgtgccgacaacccagcaactgcagtcggaaaagactattagcgagaatcattatcaatagcgatattttcaaactctattatagcaatcaggctagaatttattcaatagatttacttcatttggtggtaattgataaataatcaaaatttatcaatgtgcttgcacacatttcactaacaatcaagcaaaagtggtccatttaccacctgacttggtccaaattaggattaaattgatgatcaattaatcttagaaggggcagtgttgtattttgtggaggagcagcagcaaaagtggcaaataaatggagtaaagacaggagattagtagaatgagcagaaatgagctgaaccgctacggttcgcagctaatgagcatgcagctggattgcaaatggctggatttatagtgttggtataaaaataaaactggctgtagtttagagctgtcacatgcatagacagaaattggagtatattctacatcatccgtctacaaataaaaaagccgtctcaggtaatacctctcattgggctaactgtataatattggcaggtagcttatggaagaaagaaaaggttgtgagctgagaggtatttttgaaagagcaggacagtcttttaatagttgatttattactgtgatgatgttacgaatttatataaacatttcttagagtaaatcagaatagtgtatttcctaattcatggtataattaggacttaaatcttaacacaaaaatcctagaaatgtacactctagtgtacacgtttcctgaagtgtatcagggcaaaaggcaaacagtaatgttgttacaggaagtgc

SEQ ID NO: 116113 - DNA, 1063 bp, Homo sapiens
aagaactctgtcttgtaaattaggcaatctggatttcagttgtagctctgatactaaatctctaaaacttaaagtggctcctccagcactattcttttttttttttttttttttttcctgagacagagtctcactgtgtctcccaggttggagtgctgtggcgtgatcttggctgactgcaacctccgcctcctgggttcaagcgattcttgtgcctcagcctcccaagtatctgggactcagcactatccattttgatacaaagtttgctttaatttttaaaaaatcatgagacttaataacttcaagagggatacattgttagaaattagtaactcaaagttcaaatgacagcagatcatttgaatttaaaaccttaaaaatattcaacatctgggctaacaattcttgaaataccataacctgggcatataagatggtccaacaagaatctcttcttacatcttgaatctttagaacttagttatagaaatattgcttggtatttaactattaaataacactatatagactatattttgcttatgaaacactgagtttgcagcccaggatgaaatactaatgaacataattttaatccttgcacttaaactgaaaaatgttatcattcagcttctcctttagtgaatgagtgaatattttactctcttcaaactggaagctggggaagtgaagaagaattctttccctacagatgaaaatgaattcagagaatattaaatgagttttcattttatttgacactggaatggatactacaaataataacctcataaatacatccaatagtatttttttaatagaggttttcagtttggggtgtttaaggttttcattactctctgaagcatgtgttaagtaattgttttattgttcaactatttttctccttaaagctcaaaagaatatgattttcctgcatgtaatgaagaaatctgttttacacagtgatggcatgttctgatactgaaatagaattcaacgaacagtggcctccattccagaccatttataattctgcaacagtgctgggtgcacattt

SEQ ID NO: 116114 - DNA, 1793 bp, Homo sapiens
ttaggaatatattaaagtatcatccaagcaactgaaaataatatttaatctcaggataaagtaaactcaacacttgataactcataataaacacaaaatatcttaaagagagaatgggtcctagtcttatattactacactattaactgatatgttgtattaccattttcacaaagagaatgtattaactaacatgaaggaagattggtcaatagtggaatgacagaataaggaaaatcacagcgtaaatgtttgctttgcccatctaagtgctgtccaggggacaggaattctgagtgtactttttgttatttgtgagatcatcctgtctccttcatgtaaatttgtagttactgaatgttactttttagcaaaggaactttttttcttccaaaagcaatcttacgcagattgcaagcttataaaacagttaacaaaaacaaagtgcctctgagacaccttcttgaaatgcttatgctctaggaaagaccaaaatctactttagttatgaagcattccatttatctaattctctttttttctggttccatgctcacaagtcaactttctagtgaggctgtggtattttatataggtctgcctatcacaggagaatgggctagcctaatggagaacacttttccagtgatggtattatgcttctctctctcctttttttttagatggaatctcactctgccacctaggctagagtgcagtggcatgatcttggctcactgcaacctcttcctcccaggttcaagcgattctcctgccttagcctcccgaatagctaggcttacaggcgtgcaccaccatgcccagctaatttttatgtttttagtagagatgaggtttcaccatgttgaccaggctggtcttgaactccggacctcaggtgatccactcgcctcggcctcccaaagtgctgggattacagtcatgagccataatttttaaattgtatttaaaaatacaattctcattgcatttttaaaaattggcattcgactataatatatcagcctcattaatcaatgttattctgcccttaagtcatgagtccacttatggcgggcccacagattgtgagcctgagaactagaaacttggctacaattaactgaccaaggaagggaaggcttttcaatgaggcccttcagtagactacctcctcatctctcttttatgagacatagagacctactatgtcaggttatgttccaacctgacgtagtctttagttccatgagtgttaattttttcttatttgaatccctattaaaatttgctttgtaaaaataaataaataaaaaataaaatttgctttgtttttaagcagagaatttgaacatcatttgacttttttttaacacacaagtttattgctgtcctatattaaccctctccccacctcctgcttagggattatcaagttgttgaggtttatgtactctacatgaaatgatccttgactgccatggtttacatggttctttcctttccctagtcagattttttatgattgttccttttatcagcttgctgtttataatactggtttctcctttcctcagctactggcttaaaatacaagaaaccaaatttatagaatcatacctaaagaaagaataactgttctgaataaggacatgaagatctctcctgtaaatcatatgtataagctttagtgtaaattttgacctctattttagctcttctgaggccctttctgggggcctctttttcttaagaattctgtttcatttaggtagaggtgcctgctaccttta

SEQ ID NO: 116115 - DNA, 1053 bp, Homo sapiens
aggttttttaatgtccttattagaagtttggaattccataagcattgtttctgtttgattatttttggaaagcaagggaattccagggacaatttgaaggttgcattgtagaagaaaagagagcagttgtttcctagtcgtttcatgatttttttccagctagattttttttttttttttttttgagacggagtctcgctctgtcactcaggctggagtgcaatggtgcgatctcggctcactgcaacctctgcctcctgggttcacgccattcttctgcctcagcctcctgagtagctgggactgcaggcaaccaccaccacgcccagctaatgttttttatatttttattagagacggggtttcactgtgttagccaggatggtctcgatctcctaacctcgtgatctgcccacctcagcctcccaaagtgctgggattacaggcgtgagccaccgcacccggcctccagctagattttttaacttagaaccaacttgatctctgatagactatgtctagttaagtgctacatagtaaggggttacccagtcattgtttacttaaggtgaatgaatttctgcataggggatttcttttaaatagaggcagttttgttttattgcaaaatttgttttattttgttttgtttttaatgcaaatttatgaatagagcacataaagctggccttgtcatatttgccaacaccatttcgcatgtaggtaaagcatgtatgaaagaataaacagtaagcatatgagtgaatgaaggacaaattaagccaaataaacttgaatgctcttagttgtattgaatttttaatagagtagaattataaaattaatatttgatagaaacgaatatctaattttcactaaaatgattaatcctattttaggaaaattaaagtcaagttaattataaatatggactaaaattagcagttgaatcacagcaaagataatgacaggattatattgaattgggggtcatgtttgacatggtgccataggtgttatgttaaatacagttttatttaaatcatattaatt

SEQ ID NO: 116116 - DNA, 1035 bp, Homo sapiens
gttgagacaggcataaacattgacaaacagttaaatagtgatagattatattggctttccagagagcttaagccttcatgcctctgctcatccaagaggtagaggtaatatccttaaggctgagatatatggggttttcttgttggtaaggtaaatgaaatgttcaaaggctttactactgcaccagagcagataataaggcaattagaactgttaaattgatgaaacaccagagtgggatgaattatattatgaattacaaagaaataagagattttacagcaacttttgagaccaaagaggaaagatgtatcagtaaagtgaagagaaattgatagttaaagtgctggatttattgacctgaaaaagccaacttttaaacattttagggacagtttcagaatatatcagctttgtaaataagtggaaaaaattatcagtttctgctgatagtttaatttcctctattaataagatgaatttaaaatgtatttcttcctttccattttttgagctgcagcatacccgagggatcatctagtcaaacctcctcattttataaaacgatgaacctgagacagggaaattaagcagcttattcagtattacattacaaagtagttgagttggaactagaacccagattacgtgacatgtcattggcttaactttatttgaccttagagtgtcgataagtaacttcttatataagttaatttatggaatactgtactttctttagaattcccaccacataaaataatcacactgctaacacttaaataatgcactgtttgccaaagttagctggaaaacaatcactagagagaggcaagcctttcgtttcagtaaggagtgcgctgcctgtttttttgttttgtttttttaaacaaaagctttggttcataatttcagtctaagatccacaaacattatcacattatcatccacacttagaaaacagacttctggaatactcttgagtaccatgagacttaatatttattatgtcctaaacttttcaggtgtcactgt

SEQ ID NO: 116117 - DNA, 1011 bp, Homo sapiens
tttttaatcttgtgtttattattaccttttaaaatataattttatttgtgtattgctaaaacgtgtcatttacttttggttattttttactttataagaagggcattttctgggacttaccatttttcacctatgttgataggattcagccctaaatttttactcttaggtgcagtacatttttttgatggttgtgtaatactccattgtttgataataccgcaatttatccattcctcttattgatgagcatttggattgtttcacttattaactgtgtttctatgtacattcttgttcatgtctctgttaattatgtctgagggtttttcttgggtatatacccaggaatgaaatcgtttggtcataagtatgtgagtattcatcttgtaagatgcgtatcttagttcaagctgccctaacaacataccatagactgggtggcttataaatgatagaatttatttctcaaagttctggaggctggaagtctgagatttagggtgctagcatggtcacattctggtgagggctctctttgggttgaggactgctgtcttctcattgtatcctcgagtggtgggaagagatctggagagctctctgaggtctcttttacaagggcactaatctcattcatgagggctccaccctcttgatttcattaccttccaaagaccccatctcctaatagcgttacattgaacgttaagatatatgaattggggcattggggttgggaggaagggatgggcacacaaacatttagtcgcttgcaatgccagacttccaaagggattgtacccttttatgttcccagctgcattatgtgggaattcctttcattgacccacatcctctccaatacttgatagacttcttaattttactccattatactgtctttgtttagttttcattttggaaaaaaattgttttgcttgtctttttatttatttatttattttatttatttattttttttgagacggagtcttgctctgtcgccca

SEQ ID NO: 116118 - DNA, 1035 bp, Homo sapiens
gagcagccatgagatacatgggggaagagtcattcagacagaagaaacagcaaattcaaagacttgaaaaagggagtaagattggcgtgtttgaggagcagcaaccaagtgaaagagaggaaaagggggtaggagattcagaaaagtaggagggagagggtacagatcttagaaggacttcatgtaaggacttgggcttcaggtgtcaccatctctatgagagtttcctggctatgtccaatgttagtgcccccttttctgtgttcccagagaactttgtagttttcactatgatagtactaaaaatgcattaagctatttgttctgtttactaggctgatagcttccaaagtatggtctaggaaccccttggggtccctaacacccattcaggggttctgcaaagtagaaattagttttatagtaactaagacatttgcctttttcactttcacttgctcacaattgtacagtggagtttttcaggggctatgtgatgtttgatactgcaacagattgaatgtagaagcagatacgagaatccagctgcttctcttccagacataaagatttgcaaaaatgtaaaatagtgccgtttttctattttttgttttgttttggaaagtaagattatttttcgcaaaataggttatttttgctaacattgtacattgattttgttatttttaagtaaattaacaaatatatttaaaatttttctaactaaatatttaaaaaatttattttaatttctaatacagtaaatattaatagagataattcacataaacaaagctccttgggtagagtccagattcagatcacatcaagcaagatgttttcttgtttgggatggagaatttatattgggatggctagcaatgacttttgggttgtgtggaaaaaggagacagttttgagttgtttttggttaattctaacagaagataagaaagcactgtaatactctatattattggtgaataaagtgtttcacatacatattttaccattggttgagatttaatccttcaa

SEQ ID NO: 116119 - DNA, 1054 bp, Homo sapiens
caggaccaaagggatggtgtctgatatatcattgcttttcacagaattgtttttcaacaaatagacacttaatagatatttgtcaattgagctaaggactggaggaaaccagaaaagggtttatgagggggaacacatcaagagactggaaataaaagtttgctttataaataaaagtgagagccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtggtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaataaataaataaataaataaaagtgagagacttagaaatggagaaaaaagagaaacaaccgctgttaagtaataaccaccctcaaatagacatttttcaggatagtatttttattttattagagatataaaagatatgaaaatatatcaaggatttgtttaaaagcaacaattttacattttttaaactaggaagagactagtctattgtggaaaatttaaaaattattacagttctgtcaaaaagtttttgtagtttacctagaattaactagaatagattcttaaattctagtttaatagaggggtctgtgtttgtgtgtttaactgcctgctaagttacatagactaatccactccaggttattattattattattattttgcaacttaagaaaaatagtagggacataggtatgtcgaaatctcatggggagtaggtggtatttcagggaaacaaaagagcaaaggtttggtcccagtgcttaaggaatttgtacattgttaagttatgcagtatacatgtatatgaggatttattcctagaacttcaagtatgaatgtacgaatgtatgtttttattctcatttt

SEQ ID NO: 116120 - DNA, 1993 bp, Homo sapiens
agttcctttaggaatttgtgtaatgtattcagttctccaaagtggtggtcagaggccatgtcaaaatggattgcaggtggtcagctcttcaccacattctgttaactacttggcaagtagttactcttaggagcaatatagcaggcaaccagatgtctcttcaagctggagagggagaaggctaaggccactcatcatcacagttttcccaacacaaggtattttattctccaggttgaatgtggagatgaaagatctttggccctgtatgtgtatgggtgttttgttttttcattgcatttttttgtttggttggaaattttgaaaatctgtagtaagcaaggttggaaaattttattaataatggcagtctaaaactcttaagacagtaaatgcttagatgtgtgatgtctattccagtattctacttccagtaatacctttataaaagaatataataatgttctattgtgatgctgttgtgtccaaatagaactgatttttttcttaataacttgtcataggtctaactaaagatcactcatttagcagcctcactcagaacctacatcttactgtctttgaatcatctggtatggtgttggcacattatactcagtaaaagtctttgcaatacacagatgaaggaatgaaatcttcctttataaggattttgaacctgatcggataagcagtagagagccactgaatcaattactatattacagcataatagttactatattcttgcaatatagtaattgcagaatagttatttattcttgcagtgagagttaaatagatgggctcccaggctccacttactacacgttattacatatgtgaccctgggaaagttacttagcctttaaaagccccagttttcttagccggaacatggggttaatgaaagtacctgttttttttgtattgttaggataattaaataaggtaatcatgtaaagcacttagcccaaatgcctgatatgtagtaaatgttcaataaatgctaactgctctcattattatcattaacacctatcttcgttcatttgtgctgctataaaaaaatacctgagactgggcaatttataaataagagaaatttatttcttatagttccagaggctgggaagtccaagatgaagaggccagcaagtatctggtgagggcctggtctcttgcttccaggatggtgcgctgaacactgtgtcttcacatggcagaagagcattaaagggcccaaggctgtgtgaagcctcttttataagggccttaatcccattcacaagggaggagacctcattacctaatcacctaaaggccccatctcttaatactgtagcattggaaataaagtttcagtgtgaattttggagggatacgaacattcaaaccatagcagcagcatctttattacttttctgtagattatcaacagtgtggatgaggacttaaggatgaatggttactgatccccaggagagaccctggaacttggctttgatttaaattgtgataaaagcttgtgttttagttgcttgttctgttcactgattgtctgtggagggagaaaggaagagtatgaaccttgtgttcttgagtaatttctaagactttgtaatgatcatctttttgtgaccattgctgaagcagtgattccctacccccaagccccagcaaaaaatgtggcaaggccagttttgcttttttattggactatcattaagtttattgtggggaagagtagacaagtgagttttggagaaccctaatttcaaaatctataaatgattcacacaatgattacaagacattcttacaattctagtgctagattatagttatatccaaatccttcttactgttttttaactgagttctctgttgttgttgagatcctttcacttccacaagtaagttacggagttctgtgtgtgtgtgtgcttgtgtgtattctaactcggtttgtttgtctatatagtatgttgga

SEQ ID NO: 116121 - DNA, 1049 bp, Homo sapiens
actgaggggtttcccaggatgtggaacacttcactgctaaaactgggaaagtcccaggcaaactggaatgattggtcacctcttctgtaactagctaacatagctctgttttatgtgttctgtgatttatttggaggctatttacagatagtacaactgtgagttgtatgttgtaccttaatttaaaacttaagtgcatggtgtaaatatgaatccttgacagagtagcttttgttctgtatttaaattattaatgatttagaaaataattttcactaaagtaggagaaaatgcagaattgatattttctaaatgtggtatttcagctaagtgacttatctgcaccaaaaaagtttccaagtgggatttgtgttcataaaaaagtttgttttttattagacttgtgataaattcaagaaattcttctgcaagtaaaaaacactcacaatcatttaacataaaaggttatttaactttaaagccagctttcaataaagcctgttaaactagttcactggtgagtgaatgaattgattaaaaatactttcttaaatatatctttttataaccattttggattggtaatggcttaaaatccaatgtgaacaaagaatgttagggcattggaaatagcactgacattggcccatagttttcctctgattaaatgaaagtgacaccagtagattagaatgagactaggacaattcacactgcaattttgttagtttaactttaacagtcttttaacactcttgtttaaatgtagctgacataccataattacaaatctacaagccttgattatagaattttacatcatgagcctgtggggaaattgtattgatttttttttttttaataaagcaagcattgttcccaaactgtggcatcttccgaagtttgtttatatctacatcctatatacaactgtgtatggtgtatatgctatgtatagcaggcatgaagacaacataaaaggtatgtaaaatctccactattagttcaatatatattatactgatataaaaagtgaagaatgcaaatga

SEQ ID NO: 116122 - DNA, 1443 bp, Homo sapiens
ctcaaattgcttataaattaatggaagtgtctcccatacattttaaaatgacttttctgttgacattttggggtatagcttcccacttatgtattaaaatgcaattaaagaaaaacccctaaactttctgttttagctgcttgttactcacattttgccttggtatatcaccatctaactccataaatattgtcccctattgtctcttgttatttttcacctgaaaattattttgctatgactctttccatcttctaccttagtatcctatttttattttattattatttatttttattttactttaagttctgggatacatgtgctgaacgtgcagttttgttatataggtacacatgtgccatggtgatatgctgcacctgtcgacccgtcatctaggttttaaaccctgcaacctatttttaaaaatctatattttacctcagcaaagtaaaaaatagatgaggcagcaatggtaacatattactaattgttggggctgaatgatcatggggcttcattatatttttctgtacataagttgaacatttttcatgataaaaagggtctaaaagatatgcttttttcctcctctctccaaatttagtttcaaagataccttaattcatgattcagacatgttcttgcttttgtgaaagggattctattcttttctttttttttttttaatcaatggtttaaaaacctatcctcgacactattttaaatctgttcttgacactctttttctggttagacgttcattttccatagcctcatttatcttcggaagtcacaacctttatttggaagaagaggtttaaagtcattattcatgccccaaatccttcaattttctctctagaaattgagagcaactagaaattatattctaggtatttgtcctagagttcagtttgggtaggctatactagaaagggtggattaatttagtttctgattagacctggtggaacacttcaggtgactcagaagttcctgatagtgggtctgaggaagaaatgtggacaggcaggttgaatgttaggggaatatggaaacaggcaataagtagatgatggtatttggcgtgtaggagatccagccatgcgtgcaagacggccatttcagcatgttggcaaaatggcagagttgacctaatggatagcagcccacattataaagtagaaacaagtttcagggccagtatttttaggccctgggaaaataggccggaggtttacggtgagtgtcttgttcctagagaaactttgttaccttgtacagtaaatggcaaagcatctgatttctgggaagtgagtttcaagagagagaggttagattactaggaataaagaaagagtctagatactaggaatggcttagaaggtgagagttggacagaatgaggctgaattggtgctaagcctctgactctgaggg

SEQ ID NO: 116123 - DNA, 1009 bp, Homo sapiens
gttcctgagttccaaagggaggaatgtgtaatgagacatgtctgaccccctcttcccatcatggcctgaattactttagaatgcccttagttgagaggaggggtccattcagacggttttggagcttagaattttgtttttagtttgcattcctgagtgctggtagacccttcagtgttcattagaactttattgttcagacccaagaagagcaaactttttgatgaagtattacaagagaaaagataaacagccttctgaagaagcaagttattttgttgtagcaatgtctactaaagaaaccaactggcttcttcctgttcgcccacctttcctttgtttattgatatttccaccagaggaaggaccaggcaaaagggagaataaattcactttttaagataatgcttctgagttttagcacagcatcccacttcccgggaagctttattgccaaggcaataaggagaccatgtgagtaggagttaaatgcacagccatttgtgaagtgagactgcttgggttcagatcttgattctgccctttattctatgttgtggaatatattacattgtgctgtgcctcttttaccttatttgtaaaatagagcaagcacccaactcaagcagttgttgcaagaactgcctgctatgctgtttaatacagtatgtggcaaatagcaagtgggtagtaaatgttaataatactgtttggattctcattttacatatgagaaactgaggtttaatgaagttaaaaaaagaaaaaaaaaacttgtctaaagtcacactactagttagtggcaatgcaaggaaaaggaccaaggtttcaaatctacaactttctcctttaagctacagtgctcccgtaaagagtatttttaaaattggtaataggaagggaattgagatgtatatttgaaaatataaataatccatcctgtccctcagctcagagttctttttaccagacttttaccagactggttcacttttaccagacttgcttg

SEQ ID NO: 116124 - DNA, 2109 bp, Homo sapiens
aatattatttattttttgagacagggtctcactctgttgcccaagctacagtgcagtggggtaatctcagctcactgcggcctccacctcctgggctcaagtgatcctcccacctcagcctcctgagtagctgtgactatacgcgtgtaccaccatgcccagctaatttttgtacttttttatagagaaggggttttgccatgttgcccaggctggtctcaaactcctggactcaagccatctgactgctgagattacaggcatgagccactgcactgggccagaaaaatatttaatattaacttctaccccataccatacacaaacatgaattctggatggaatgtagatctttttatgtgtgtgtgtgtgcacttttattcaactggtctcaagtcagtgcacaggtaagccctggctgccttcacccactcccagggacaccaaaagccttcatacatctcaagctgggggacaaaaaagggggggggggcacgaaggctcatcattcaaaataaaaaaaataagaaagtattaaggcgaagattaaaaaaattttgcattccataatttacacgaaagcaatgctatcacctcccctgtgtggactcggtagacgactgggccattctccttagacagaagtggggtggcttttaggatggcaagggacttcctgtaacaatgcatcccatgatatttggaatgactattaaaaaaaagaacaatgtacaatcaaagtcctcggccacactgtagaactttgggggatgctcgctccaaccgactgctgtcaccttcactgttccagtttttaaatcctgagtcaagccaaaaaaaaccaaaaaaacaaaacaaaacaaaaaaacaaataaagccatgccaatcttatcttgtttcctgcacaagttaggttttgtcaagaaaaggtgtaacacaactaagtcacagtccgcctagaagcatttgcggtgaacgatggagggccagactcctcatactcctgcttgctgatccacatctgctggaaggtggacagcgaggccaggatggagcctccaatccacacagagtacttgcgctcaggaggagcaatgatcttgatcttcgtcctgctgggcgccagggcggtaatctccttctgcatcctgtcagcaatgccagggtacatagtggtgccaccagacagcactgtgctggtgtacaggtctttgcggatgtccaagtcacacttcatgatggagttgaaggtagtttcgtggatgccacaggactccatgcccaggaaggaaggctggaagagcgcctcggggcagcagaaccactcgttgccaatggtgatgacctggctgttgggcagctggtagctcttctccagggaggagctggaagccgcggtagccatctcctgctcgaagtccaggacgaggtagcacagcttctccttgatgttacgcatgatttcccgctccgcgtggtgatgaagctgtagcggcgctcggtgaggatcttcatgaggtagtcaggtcccggccagccaggtccagaagcaggatggcgttggggagggcatacccctcgtagatgggcacagtgtgggtgaccccatcactggagtccaacacgatgccagtggtacggccagaggcgtacagggacagcatagtctggatggccaagtacatggctggggtgttgaaggtctcaaatatgatctgggtcatcttcttgcagttggccctggggttcaggggggcctcaaacagcagcatgggttgctcctcgggagccacgcgcagctcattgtagaaggtgtggtgccagatcttctccatgtcgtcccagttggtgacaatgccgtgctcaatggggtacttcagggtgaggatgcctctcttgctctgggcctcgtcgcccacataggaatccttctgacccatgcccaccatcacgccctggtgcctggggtgcccaacgatggaggggaagactgcccgggcggcattgtcgcccgtgaagctggccttgcacatgccggagccgttgtcaatgacgagcgcggtgatatcatcatccatggtgagctggtggcaggtgtggactggcagt

SEQ ID NO: 116125 - DNA, 1039 bp, Homo sapiens
aagtttagtatgtaaatatctgacccacgctgactttataatcaatgtttctgacatcccaaagctagctatttattacttatgaattagtactctttccataactattttttgcatgtatgttgaagcatagcctgtgcaggagttaaatgatgaataaatctggggtagtggtttttgccttccgagggccaaaacaaaccaattttgatcatgctgtgttccaattaaatatatcctttctgaactgtgaaatgagaatgtcagaacatctgatcttctagtcttccgctttaaaacattgcttccaccatttgtgtccactagaacatagagacctagttaataaaggcagtagcttttacaccagctagcagattatgttgctaggatgatttgcttagtgtgtttccattgcagcgtaagcagatgcctcttttctttcatacccctattctttatagtactgagacttttgtggcaataggatttcaaaaatatgtccaagatactaattctaatttctgtcaacatactgacaccaaaattgacatttgtctctgccaactttatattaattgtaacattaactctaagttttttaatagaaaagagacaaaatgtgccttggggctgtgccaccctgaaattcaaacaacagtgcttttgtgttcctattcaggcataatctccttctctatggtcccaaggcacaagtgttaagtaaataaagggactaataagactattgtttacataattataaccctgtcagaaatagggacctctgttgaaatatttgttgagtgaattacacacgtgatgaccgaatctgtgggaaaagttgcataaatgaatgggaaaatagagccacctcatatcctttggtgacgtggttttacaggaatatagaaacagcattctcctatgaagcagaagagcctgaaaaatttagacaaaagaaatgcataaacctgtgaggagccttagaaaagagagatcattttagggctggtgatctttatgtttctcaaagatg

SEQ ID NO: 116126 - DNA, 1506 bp, Homo sapiens
attttttagctttcctatataaagaaagagaatgcatcattggcctgatagtgtggggaataatttttttataccatctctgaagattagagtaggaactagagagtcctaaattatggtggttgtttattttttattttaacttttctcatttgaacgttagaggaaaatactacaatattgttaggtgattttttaaataactgggaaaaatacattgctttgtgtaaattctctaaaactaaatcacgtgtaaatgctttttttgtccttcactattaattcaatagtgtaatggtttaactttaaaatgcaattttatagtcaacaaaatagaattttttacaacttacaaattctctgcctgtttaaaatgttctactataataactcaaggtaataaagatttataattttaaatcctttggcagatagcgctccaaatcactatactttggtattgatgtttaggaggcttattccaaccagtatttcttacatataatgatcgtgcgacttcattacacatttgtcaactttggactaattatttttatacagctagggcagggcactgcatcttgtgatcgtctttcttactaataggattctgtctgcttcagcaggcagtaattgaaggcttcatgtacagagtacaaaaaaaaaaaagttttagcctgagtgggtcattgtcacagcttctggtaaccagtagaacagaaagcacaagaaaattgaactcagaatagaaaaatcagaaaccaggaagactatccaagagaagaaaaagcatgtcttagagctgttgcattaagtatagcaaatctgattctgtgtaaaaaatgttatgtttgtgactaccctggagactgacgcagcctctcagataaatacttttaaattcatgctgtaccgttaatgttaattgttagaacaattgaattataggatttcttttccttctaacaaagaacatgtatgatttatagccagtttgttacaaatcttaaaaagtatagtttaagtgcatggagaataaatctgtgtattatagatattagatttttttcaaatttgttgttgctatttggtctgtttttataattatgactatagttaagacaaaataactttttaagaagaatgaaacttttttttatttagctttgacaaccagcttattctgtctttttcgtaaatcttaagaattcctataggcttcaaagattaaatgtcaattgctggagataatagacaaagacatttaataagatgaaatacagatatagccaaacagttttaccttctcagttggtgattacaaacagcaagtggttggtgatagaatgaaatgaaaaatatctagatggtgtccttttaataacatggagcccgtcatacacaggcaatacatctttaactgtcatcgcacttatttgttctcatttgtggtgttactgcttttcgaggttgattggtctccccgtagtccctccctgtgttaca

SEQ ID NO: 116127 - DNA, 1050 bp, Homo sapiens
aggccatttaccaggtattgctgctagttatcctggaattactttgatgtgttctcaagcagcatttggcaatgagagatctttgaatgaatagaaaaaaatagcaatagtaacaaatacatttatatattattaagaagtaaaagcttactagtttacataaaccccagattgagtatactttaaagagactgaaattgatatttcatatgtgtgattctaagtttttatcctatcatacttaaaattagatttaagtgattttttactgaatttttacacattttcctatacaatgaggattttaaaaaacttcgaaacaattgcattttgttttagttttataattatcttgtaaattacatcctaaagtagtgtttcttttgttgaaaaaaagttaaaattttggccatgagcttaaaattctgtaaatgtaattttcaaaaagaaattaataaaagggagccttcttttgcttttacaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtaggttcactaacacacgatgtggaggtgaagatgacttgaatatgtataaatatataattttaaattcattgttttctttggaaataataacccctaaacatatatatatatacacacactcccttttttttctgatggtatagttgttgattgctttgcattaaggctgtctttcccatctcagagcatccttatcatactggcatggtctttcctgaaagatatacagagcatattcacattttataatagcttggtaatttataaagttaccctttttgaggtggttgagagtttatcttatttcaccagattcagtagatgtccaggaagaactattctataaagcagtatagttggacttttttaattgaaagggaggacgtttgggtactacatacagatttccttttgatagccatcc

SEQ ID NO: 116128 - DNA, 1042 bp, Homo sapiens
caagtccataaattaatagtaatatttttgctgggcattatttaagcaataaaaaagaacgatgaaatctttctttggatttgcatttcttggaaagttgattattgctatagaggaaaattatctttgtgattttatttttctattgacaaattgaattgattcttatatttgctattcttaccctttgctggctaaagcctgcctctctgctttacatctgctcagcaaaccaaggtgagtggcacacggtgactgaataaggctttggcacatttattgttaaggggatattctttttttgaaaagtgcagctaaagtatatctgaagcagcagattattatataccctttcactccctcagcttttggttagaatacttaatatttcgatcaaattttttgtgctctgctgtgactgagggatttttcgctgactagccatacagaaccttaagtgcatgagagaggtgcacttggagaatagctgtggtcctctgtggagttgttgccaaaattcctttttcttctgccattttacttctatggttgttgattatttgtctgaataaatctggcagctgtttgctatgtttaatagagcagaaaggctactctgaataaagctatttgaaaatttgtttatatgaagtatttgtaaatccttgcaagtctcttggcatttctgtatcattctttctgtcttcctgaattcattctttgatgtggaacttgatgctggcaaatttagcacaggtttaaagagtcttttcaatagcatctttttagttatagatttcagcaggtttggtaatagaggtctcaatcctcaactttacacatgtatttgttatactactctagtaagagcttagcttatttccacaaaagatacctagaaatctctcactaacggaaaagcctaaatcagaataaaaatccgtttcctcagattttatcaatgcaaaattctggaaggtaaaatgcaagtaaatttaaggggtgtgtgtgtgtgtgtgtgtgtgtgtgtgttacaccagct

SEQ ID NO: 116129 - DNA, 1019 bp, Homo sapiens
agaaacactgaaacacctttgtcttagttatataagtaaagtaaccatatgctttatcacacatatcaggacactttagagagtgaaaggaggcaccagctggacaggattccacaacaacagccataaactgggactattcctgggaggactgggatgaatggtcatactatatatgatactctgcaatgttcccccaacctcttctgttgacatattaggctgctcatcattcccaaagtacaggcctagaatgccctctttctcctcttggaagtaaacttagccttcattcctgcagaatgctttccacatacctaaggtagtgcctgccattccattataagtgtaatttctttccctcccgctagacttgtgagcttcaagggccaatctcacttggctttaaatccccagatattcacacactacataggatcaaggttgtattcagtgtttattgaattgataaataaattggatttattggtttgccttcaacaatccacatatggaaaaaatataaggccacttacaagaatacaatacataatagcataaaataaaagtcgattttatgttctttttttatattatgtcatttgtctgtacccacacatgaataaattcaagtgtttcttaacctaatgtttagtatttcttatccacaatccctgtttctctagctaccatctcacaggctgtgggatccagttctaacatgaaggtagaagtccctctatgggacttcctgaaagcttttgcttttgtaataaaaaggaacagatttggttgacatagttactcaacactctctcatcaccacccttccttcaatggaatgtaaactaggtacctggagatacagcagccatgtggcaaccatgaggatgaaagccaacatagtaaggatggcagagggaaagctagaggaatctgggcctctaaagggttttttaagccactgaatgagcctgtgactggtaactctaagacttcttgtattataaacgatcaat

SEQ ID NO: 116130 - DNA, 1216 bp, Homo sapiens
gtgaataatattttttctaaatttctttcaaactaacattaggaaaataattcatgtatttcacatagaaaatgttcttgactattaaaagcatttacattagtatgttttgttattataaagatacaaattatttattttagattttgttaagcacaacagcatgctagatcaaaaattttgtgtgtgtgttccaaaaagagcactttgtcttgcatcaaatgtaattgatcctgaagcagtgtaatcacaattactcactttcttgattggcctgcccaaaatcagaaaatggaaaccgatcgacagtgtttaaatcaatagcttcatagtaatgcttgtgggggtagggagatagtggtaatgggtagatcaattggtcttagatgccaatcactgactgtgccttttgcatagtaaatagcactttttgcttagtgatgtgctgtattagtcttggtagttcaataaaaagaaaaaaagaaacaagaatggctgatattgaattttttccttgaaatacattatacaaatcgatacataaaattatgggtaataacagcatatttgataagaagccttcagaaatgctgggaacatggaccaaaagcctgtcagatactcttttattagttagaataaaaagaatagagtaaaatgatcctactttagcttctggattaattctatatcattataattgtatctatggataaatagatatagacagaactgttaaattaagccatgtagttatatgtatatctgataagcatttttgcctcttttttgcttggattttaaatggtcatcaaattaagttcttgattaaatttattgagatcaaatatgtgcgcaatatacataaatatatctgtctaaaagttagtgcagtacataaacagatcctcatcccccacaggcatgcatgcattaaccagtgtgggaagtcacacagcttagtgctagttagagaactgagcacatgtttttgtccaaagatccattaaaaagaaaatacattctttaatagtgaatgaacactgaaaatataagaacagatgccattagctgaccagaaattatgaggcattattgacagaaaacaaataggagcagataaacaataacagagaaaataaaaatcacagggtaaaacactcgtgggggaaaactaccataatggtaagaaccaatctggcagaacatcaagcac

SEQ ID NO: 116131 - DNA, 1051 bp, Homo sapiens
tttaccaagaaaatattcggagggggaaataaggaaatatttgttttaccaaataattgaattatattgtaggtctacaaaaaataaaacaatatgggactggtttaacaggacaatcaaggcccagaaatatctcctagtacataaataattagaatttttgcatttaaaatcattgagaaaagactattcattagctcatgtagggacaattagttcagtatctggagaaaattaaatatggagtcaatatatcaaaatcaattccatatgaattaaaatttgaaaccatcaaaggtctggaagaaaatataagtgaatagttaacttgatctcaaagtagagatcattaaggcaaaggaagaagccaccttatcctgggggccatggtcttcagtttacagtaaaagaaaataaaaacaaaaaaacagttcaaagagtcaggattggaaatgaaggtccagacgttcattttggtagttggctaaaacacccaagaaaatcaattgacaaactgttaaaaccaataagaaagttagcaagatggccaaatatagaggatctagggaaaaaaactaacaaaaaagtttataaatccctgccccccagcaaaaaaaaaaaaaatgagtatgtttgtaatattaatatatgcttggaggttacagaaaaatttcttttttttttcttttcttttctttttttttttttttgagacggagtctcgctctgtcgcccaggctggagtgcagtggcgcgatctcggctcactgcaagctccgcctcctgggttcacgccattctcctgcctcagcctcccaagtagctgggactacaggcgcccgccaccatgcctggctaattttttctattttgtttagtagagacggagtttcaccgtgttagcgaggatggtctggatctcctgacctcgtgatctccccgtctcggcctcccaaagtgctgggattacaggcgtgagccaccgcgcccagccgcttacagaaaaattttcatacagttttgagggcatttacttctttgtatcatttct

SEQ ID NO: 116132 - DNA, 1489 bp, Homo sapiens
aaatcatagaataaacaagtgagttctgtgtgcaagattggcaaaaagtaaggggagcactaaaatttaggattaaaatacagtgtgtttagagggctgtacatttagatgttttaaaggcttattttttcatcaaagtgttatggatctatgaaatcctgttcttaaaatgaagggacacttttctgaaaatacccagctcaagaagagacgggaaattgtttcatatcatatgattatctccctggctagttctttttttcaaagattactgtctatcagactttgtgtcttaaaccaaacgggcgacttcatttttcccctccctgggaactaagtgtggaaaggaaccctaagggtccactgctgtctcctagtggactaaactaaaatgagaggaacagtgggaagaaatagattaataaagactacagaagaggagctaaaagttagaatttgccataaattggatggagagttcactgaagcaaacctcagtcgattgtggaactagattcatgccgtgggaaatctcggaatgacttagccgtgacttctttcctgttggcatggtgtctttttcagtaaactcctaaggaaaacaaacaaaaagtactacaagttgatgataaggtgggtgggcaatatcctgtataaaaatgaaactatgttctagaagagttggatttatttctggacaccgacctttttaaaagcaatgcatcattctccatccaacaaatgctgccatagccaataatatgttggcttgtccattttcggcttgtagtacaaaataaatgaaagccaaggacattacaattgggagggaaagaggactattatttaaaaggcttttaaatgatgtcactatatattcttttaacaacatcctctaaaagcctttgaaaaaatagtcccttcctccctcagttgttaacaaagaccatactggggactgctctttaaaaggctgttaaatggtgatactatattttttaacatcaacatcatttagaaaccttttagagaacagttctcttcacccacaactaacagaggagggaaaaacagatgcgggggaagggattacttttgtaaaggcctttggatggtactatcaataaatacagcaatgttgttataaaagcatttttccaatggtgattcagctttttgacatgtacttttaatctcaggaccctgcgttatctgacagattggtgttttaacgtgggctgaaaactcaatttactaataatccaaataatgccttttattgaactttctgcagtttaaaaatcagtttcacatatatggtctcatttgatcctcaagacaactcagtgaaacagacaggatatgtatgattagccccattttacagaagaggaaaacagaagctctgaggttgtggtttagctaaggtctcaccatttaatatgtggctgagttcaaactataacccagatcatttgacatctggtct

SEQ ID NO: 116133 - DNA, 1023 bp, Homo sapiens
tctagtcagtcatcttggcccctccccactggttaatatgttagtttattacattactgagagaattattcccatcaagcccatatctagaaagtggttgtgctacttacacattccttttattacttagcatgtaatatttaagacagtaaaatggggattaagttattgctttaaattatttgactaaacgtagcttaatattccattctttatatttcttaaatgctctctctaaaaatacagcatggtaagctgaaaaatgaaaaataacattttgattttatttttctgtcaatagagcagatctaaaaatttaaagcacatctttctaaggtaacatttacctcctcacatctttagcagctatcagacatgacatgggacatattcattgaccctaaaaattttcatcagaatcatgcactgaaagggggcagccccagccagacaagaggctcatttcaattttaacggctgtaattaaaggttaattcactgagtcaggattaacaaggaaagtacaaatgataggcaagcagctgcctttataatacaagattagaacaatgcaattacaataagaattagaaaaaatcaacttccagaaagggtcttttaatgaatgaattaaattgtgatctctaaacatgcgtatataaggtaatgcttcttaaggaatcatataaattgatactgtatatctaagcatattatgttaaatgtggaaacaacagttaacactaaaaactttcattattagtaagttgcccaaaaatgtacttgtatatatctgtacatgatctttttaaatggcaaaattttttccctacttcatgctccttttttttttaatgtccactgtgtttacctgaattgtaattgatctttccctcttcctgcccgaccccccctgcaagtacttcttatgtttataccttaaatccatttttcttatagaacgtattcctaaaactccttttccacctagtgttaattagaaagttgacaagtgtcattttc

SEQ ID NO: 116134 - DNA, 1699 bp, Homo sapiens
ataacagaccattttcatctctccttttcctagattactaaaaggagctactttttaaaaagagattgttattaatttttagttggaatttttttattgcaaaatatttttaattggcttaagcaaatatgtgccagtttgtcctaactggcggatagtactcataatgttagttgttagtattttagtaaaattccccacagtgacaaatccgctgaatcagatgctaattatagttattaatgaactagcaattatttgtggcaaaaaacccaggtcacccaaaaaaacaaaggaaacatgcacacagatctgcaagaaattgaaggattaaagaggttgtgataaagaaagccttaggcctttcgacttcccttcctcctcctttgtggtaagtagttctgctggctgtgagttcacttgtttcagagctgagagttcactgaacatctatccacttttccctaagattatgatttttagcttttaattattattattaaatataccacagtaggaaataagatgatttttaaaatataatttatttaaaaatgtaatatgtttttaaaagattcatcttttatggcagttttgtcatcttcggtgaaaatatgtaaataaatgagtttctgaaattctatcttttaaaaaacagttcatagtctgaaattatgcatttaaaaaaggcagttcatagtcacacaaatttgatggaattttgtgtgactatgaattgctatatttcaaattttgttgctactgttgaattgtggtattgaaatgaaaaatatagtttttaagcattatggtatcttagattatgcattggtcaatcatatagcaaatattatttaattacatgtcagccaagttaacttctgttaccactgttccccttaaaaacagtgccaaatttttttctgaacacagggcagggcatggtatggaaattaataattcttattctaatagtattaaatctcttaacatgagaaacctgacctaaacatggaagatgttatgatatttacaaaacctttatttctcttcgaaggaagagaaacgaatttagctgtagaatacatgtccaatgaacactaagaattgattaccactgacaagagagtatggagtaaaaacaagtacagtatataaccctaatatcaaagaaaagtaaaaaccacttaacttagaatatatcagacgtgggctgggcgtggtggctcacgcctgtaatcccagcactttgggaggccgaggcaggcagatcacgaggtcaggagttcaagaccagcctgaacaacatggtgaaaccctgtctctactaaaaatacaaaaatttgccgggcatggtggcttgtgcctttaatcccagctactcaggaggctgaggcaggagaattgcctgaacctgggaggtggaggttgcaatgagcggagattgcaccattgcactccagcctgggtgacacagtgggactccatctcaaaaaaaaaaaaaaaaaaaaaaaaaaagaatatatcagacacattgttactcaaatcattcagggaatataattatatacagcttttataagcctatcagtaagtgtttttccttaaatttgcagctgtttttcattactgaatttatgacttttcccctccaaatgttaatatggaaaatctgctttacacctctgtacaaataata

SEQ ID NO: 116135 - DNA, 1104 bp, Homo sapiens
taaacacattattcatagaggaggaaatatagatgataatatgcgaaaaaggttcagtggtagtaatgaaaaaatgtagaattaaagaaccatcttgcctgtaacattagcaaaaattacaaaaaccaacatctgttgttgctgaggtatgcaatgaagcaggcattatacactgctccactggtaaaagtataaattatgacatcattctggatggcagttgggccatctgtataaaaagccatcaaaatatgtataccttttgaccaggtaatctcatgtctagattcttcttctaaggaaataattagaattacacagatttatgtgcatggttgttcaaacctaaatgtctagtgatagtagtgatggttacaaaaagtatgcaaaaacaatttaaggaattttgtacaattattaagatgtttttattacatattttaataagataaaatatggtataatgtcagatggaaaaaaggatacaaaatgttatatatataatctaaattttgtaaaattgtacaattgtactgttttcaaatacaaggaaattgaaagagtagaagaaactgcatcataattttaacagcttttctgaatgatgagattatggatgttttatatttaattttcttctgcatatttttaaatattttccagattttctctaatcaagatgtaatacatctattacccaaaaagcaatacttgtaaaatagaaatggaaagcacatatatgaatgacgaggattcctttttatttgtttgggtctttttcctttccttttccttttcctcttccttttctcttcttttctttttttttttttttttttttttttgacagggtctggctctgtcgcccaggttggagtacattggtgtgatcttggctcactgcaacctctgcttcctgggttcaagccatccttctacctcagcctcctgagtagctgggactacagccacctgccaccacaccctaatttttatatttttgttggtagatatggctaatttattggctaattttttaatttttgttggtagagctagggtttcaccatgttgcccaggctggtctcaaactcctgggctcaa

SEQ ID NO: 116136 - DNA, 1025 bp, Homo sapiens
ttttttagggagattactgggtgataaatgttagtgataatgttatgtgataaaaattttcacaaactattactcaagatatttatatccttattttgttataggatttgccattatgttttgaaagctaagactaataactgccatgacttgataataagttgactaaatcaagatgttaaatagaattgtcatacatttattaatcaaagtaatttaattagatttactaacaaaataaaaatgttgcttttaataatttgaattaaacgttcatgcacatttactaatttgggccttttcttacagttaacccagtatccactccagttgcacttcccacaccagctctttctccaagtttgatggctgatcttgaaggtttacacttgtcaacttcctcttcagtcatcagtgtaagttatttttaaaatccaccagctcggttttcttatgttgccattgtatcttttttattaaaatgtaaatacttgaagtggattcttagttttgaacagattcttctctaagaacaagcccaatttagctaagaccttttaattttttaaataatttactcaaaccattatcttctcaatttttttcccttgttgtccacacttaattatcatctgtatgtttttctctggtattgttatatatctgtaacatacaaaggttcttcaccacattgacgcagtacatatacctgaactgtgccacaaaaagttgtctacattaacagactttcatttccgtaatcgttttattcctaccacactattttttcatagactattaaaaattcatgactgtttttatttaaaagttcaagatttttttttctgtcttatttttgtacatttatttacatgtgttggtgtctttaaaattattctttaatgttatttatagaatgtgatgtgaagtgaggctagaacctacctgtcacaaaataatgcaaaaaccgtcaacatatcatggtatttgaagctgcaacaactgtttattgtgttagcatatta

SEQ ID NO: 116137 - DNA, 1056 bp, Homo sapiens
tatagaaacataaaatatctagtacaatgcctgtcacaaactatatcagaaaaggctgacctatcacaagcccatcaaaaatatctgagctatgcatatgttatttctttttcttaagtaaacctgtttaaaagttattttcaagaatatttgtggactttctaccaaagagccactttacgtttttatgttagcaagaagttgtccgattgtagaataattacatacctttaaattttgttctgacatttataatttttaaacacaaaatagtttaagagtttgcatagtgggtaagaaatactatatgctaattgagacaaatgttgattcaggaaaacattttatataaccatacagaagtttaatttgttggtaccactaagcagaggaaaaaaaagtttgttttggaatattaaggactactccacagatttttaaaacagaacgtgtgataaatgaaatatttgttattttataggagaaagaaaagaaaacaaagcaagatagaactcctcttaccaaagatgtttcacttctagatctggatgattgtaagtattgtaatttaaaatatttcttctgtgtttagtaagagtattttttatttttatagtacctttcatttacatgtcccaaaatatatcaatatttattgtgaaagacttatagatgaataaggcaagaaagttttggaaatcagtggtatttgtttctttcatctattcagcatatcacttcattatcacatgaacaaatatagatggccaaatacaagtacacaaaattcattttaaaatcttttgctttagtaatttatacttgtttgctaaatagtcatccataccttataacttctacattgtgaaatgtggattatggggattgacacatgtaacttaaggaggtagaggattaaggaatgtaaataaaaatggaaaggacatcaccatcttccacttggcacaatttcagtaggaatggaaatgggttacaaagcctttggaggccagtttggctatacctctcagtcttttaactgcaaaaaatctttgt

SEQ ID NO: 116138 - DNA, 1036 bp, Homo sapiens
attttagcttcaaaactaatgtttcttctatttttttcaccatcttagacattgtttactcatttgagaaatggagagagggacaaatactgtttcgttcatttttaaataaggaatgaaaattaaaacaactagatgatgtggagtgttcagtgataaaaataattactttgaagaataaaattagtgcctttttaagtgtattaataatgtatattattatgtggtccttgaagtttctgagtatcaggacaagggaaaaaacaagtgaaatttaaattattttaaaatgttacctatgtataattttacgtaatgcttttgttcatgtatgtgcactgttgtaggagctctaacactgtgtaaactttaaatagtgataaaatatattttgctttagtggtaccgtctcgtggctagaggaatacttcaaaaatatttattagcacattagcaataagctatagacttttggtaaattataagttatttgaaggcaggactatatctatcttggctgttatttccattgcttggcacagaatctaatatatatttaaaattctatacatacctattgaatgaatgaatgattaaataaacaaaaacattttagtagaaactttagttttggtctgtgattgagaaaatttaatgtaaaaaatagtatagattagaaagataaactttgactcaattatatttaacgccctactctttgttggcctttagttgtttgtaatgcacttaatactgttttctttttaaaagatttacaaattttttctgaatatctaaccaaactgtgaacagttcaggcttaggggcactgtattctagttcatggatatatacattttgtaagtacagtagaccgaataagcaaatctctgctgggggaagccctagttatatgcagatatgtttttgaaatatttattttctcaacaaaacagtagatcaagtgagtgagtcctttcaactctaaaaagaaagagcctgggaatgtcatttatagattttaatgaatatcttt

SEQ ID NO: 116139 - DNA, 1029 bp, Homo sapiens
accaactgtatatacgtagcagtgtttgagttgctcttgtcagttgtttttatctcaggttatatttgtgtctcaaaactttgctaattccttttgggaggtgcaaagaaactgagtgaatctcttaggtgctctaacgatcagtcactaggatttgactggtgtctgaatgtcagtaaatgttaagatttgccttaataaaagattttggcaataaagatcttttatttgaaagattcttggggataaagtaaatttggcatgtggtgtgaaataaatcatggataagagtgaaaggaacaattttttgattggttttatgttctatttgaaaagtaagcaagttttagttatgtttttacaactatttttgtatgttgcaattatataacttttataaatattgaagaatattgggttttactgttataatgcaaagccttgcctctcagtttatgtctttcctgatttcatttatattttaagttctctaaaataaaaatattattcaattgcagttgagacctttgaaaggaagtgaatgccattaagcaggctttcttattgaagtaggcgtactctaataggaaaagatctgttttagtgggttagacttctttttaacttataaagaagtctcaatttactagcagtgtacttttgttttaaagcacaagtttaagtgttagcctcagatttttaaaatcatatttgtcagttaacttgaaggaaaaaagtcattaaattatctttggttgataattctaattgaaaatatttcatgcaaatatcttgtcctgtgaggctagaaattagctttgacttcttgttgatttcaaagcacagtatggctttgacagactttacatactgcttatcctattttatagtttcaaatttcaaacctctttacaatggtttcctcttagaatgcatatttgatgcttgtcatgtcagatcttttttgctatttgccttttttttaatcagcatgaaaatgaacatgcataatacattaacaaatctttt

SEQ ID NO: 116140 - DNA, 1039 bp, Homo sapiens
tttttttatgactattcccctactacttaaaagtctctgcatcccttttgttcttacttttttgacctttcattcttttggttgcttcactttttacacgcctctgacacccaagtgtgaatgttgaccccaaattagtacttagtacacattagtcttttgagatattaattgatgtgaatgaatttttctttaatcttcttttttccctctaaatttttcctgttgtgagacctcattcactcctatagcttcagctaaaacatttatattaattacttccatggtaacatctttcagtctttacattaagtttcagcttttcttcccaaattcataccaaatttttagacctctctgaggctactggttttccaaacctaatacaatcaaaagacatgctctaccatttgtcaccagcattcttttcattctcccagatctgaagccccagaattatctctgactactctgtcattctgtatgtttagatagttaccaactcctatatgttctgtgcgttatttctcatgtctgtttcttctttccctactgccactattctagattagctcttcattacctgcatagaccattgccattggtcatcctctgaccaatgctttcccaaccccaagtccttctatacaactgccagatggatattaaattcacctgtcctgatggcccactgccatttgagttcagtaaactcaggctagcttgcccaaacctaccttgtcttaaccctacccaccttgtgttctttctttctttctttctttcttttttttgagacagagtcttgctctgtcacccaagctggaatgcagtggcatgatcccagctctctgcagcttcgacctccaagtctcaggtgatcctcccacctcagcctcctgggtagctgggactataggcatgcactaccatgcttggctaattttttgtatttttaatagagaggggtttctccatgttgcccaggctggtctcgacctcctgggctcaagcgatccacccacctcagcctcccaaa

SEQ ID NO: 116141 - DNA, 1068 bp, Homo sapiens
atcctcatctactcctgtgattttattttttctagataagcctttcccttataacccaactctgcagaaatgctagaaactttaaaaaatctcatcccttgccactgaaatcaaggaactcttacgcatatgaccttttttgttcttggctaggttgtgacaaggggggggttttgctgaaggggaagtgaaaggaagtcacaaaaatagtattgagcaaagaattataagtgtacatacatcataagaaattgagactattcactttttaaaaatattgggcattttgcataatagagtgtgttttaaggcttcaattaaagagtatacattctttagttagtaagaatttgcgtagccatttatttaaaaacaaatggaaccacttatataataaaataataatgctttttggtaataacatttttaacactgaattttgcctgcttagcaggaaaaaaataaagtataaattgcaaaaatatagttattaatataaaatgtattctatctgatttcaagtctagttaaaagaataaaaatatagaattcagacctaacgataattatctttttggtctttaataatcacccccttcctataactggaccatgttcatgctagacttcaagtatagtatttttatatacaactgtgttattctgtttgttgaaaatatggccaaactctgcctttgattcagttcaatttcttcttaatccaatattgttttcgtttatttgttctgttaactggaatctcttcaatatgttatctgagtaggcaaggatgaaaattaatttattgaagtagacaattgccctcccccatccagagatttattgttaaagaatgttttaaaaattggctagtatttgtcttgccttatttcacattttcttgcatatattaaaacctatcttaaacttgaatttatatttaaaacttgtgtctgtatataaaataacctgagatttttatttttaaaaaattcacataaaatcttaagagattttatggtttattaatctggcctcatataaaaacttatcacttagtgagtctga

SEQ ID NO: 116142 - DNA, 1008 bp, Homo sapiens
tttttctgtctcagaattttttttaactttgccagtatgataattttttaaagctcctaataagctttaaacatcttcaaaaaccaccctttagtaatcataaatatttatgaccaaatttaaattttacactccaaggtattttcatttgaagggagatagtatgacatagtggaaaaaatacggactttggaatgagacaggcttgagttcagattctagttctgcccctcttgttatgtgcccttgagcaggttatttaacctttctaaatattaatttcattattgtaaatgggataataatgtacccaggaagagtgcatttaaattagataattagtatgattggtatgaagtgcctagccctttctggcccacagtagattcttaaaaaaatacacacacatgtggtagagagaactagacctttagtttccaggaaaatataaagcaccacaaggcatttgtcatcccctgagagaagggtgtttggtcatctcacatgttattccttctccttggagaactgtttccctgcccatctgccagccttactcctatatcttggcttatatgtctctttctccaggaagcattcctaattggatcaagtttttttaggtgtctctccacatgttctcctgacacgctataatttattacttattacttattatactgtattatcactgcaaccttatctgtatcctccagtggaccgtagaccctgtagggtagacacacagagatcctctgtgtcttactaaccatcgttatccttagcacctagcataatgccaacatgtagtcaataattaataaatatttgttgagcaggtgaacaaatgaatggtgttaagcacttaggtatgatcatttgatattttaaaagtttatatttgattagcttaaatttttagcaagatagtactttagaagaatttcctttgaactggttaacattttctcatagaatgtgtttaaggtcacatttgggaacttgtgt

SEQ ID NO: 116143 - DNA, 1892 bp, Homo sapiens
taaatattctgtgtacactaatatcagtttttctaggaggaattattttataaaaagtatccctctatatttaaactggtttttcaaagagggaagttgacttacgtgtcccagctttttaaaaggagtaattaagtattttaccaccttacaagtagccattccagttggaatcaaatagttacataccttggttttcatattgtttcttatttaatgttcttattttaaagcgataaaaagcaattcagttttgtagaaaaactattaaaattctggatgtgtttgtgccaagacatgtatatggattgtttaactgtgctgtcattcttaatattcacagtaaagtaatttttagagaagctacatttcagagcaacacctctaaacacactgactgattagcttttttattgaccattatgggggagattattgtaatctatggactgaaatcagttttttgacctatgaagagcttcctagtctatatttattccttgacatttgaggtaatatgccaattaccttgagctctgattatgattgttctctgttatatacagctcatattgtttattttatatttttccctatttttaatagatagagatcatttccagcttggcaccttatctcatactctcaacattaaagctactgggtacctggaattatctaattggccagaggtggcgcccgacccatcagttcgaaatgtagaagtaatagagttggtaagttgacctttctgaaattaattttgccaaagcagtggaagactctaggatagctattgttttatataaaagcttttttggagagttgaaaattgaaaattgttctagtatttctaaatgtaatgtgttagatataccttgcctttatagcaactaaatattatagtattcctatgccattgtacatgtactgttccttttcttcaaggaaatagagaactgaattctctgcatcagtgccacccacatttgtgctattgcatttgtagccgcgtagattcaatttctaaggtatttagtttcattggatgaagttttttctactttgtttagagatttgtaagcttcctgacaatatccttctgaataatttctgctgttctctttcagaaaaaccacacaaagtgttctagattttttgatgaaccatttttaagtgaagcctgaacataaatagggagcattgtgtaccaaaaatgtcctttgacaaggtcacaaagtgaataatatggtgctttctcatcaaaaacaaatttgctatataaatactctttttctcaatctttaaaaaaaatgctggccattgagataaaagaattaacattcttttctaatattatctgtttctttctcatatatacaagaaaaagtgagagaggccttctaattgtatttagcaattatgcaaaatatatttaatactttaaaatgtggagttaacaaaaaaagcagttaagaattgtattctggatacttttctggtggaaaagatacattgaattaggattcagataactggggttctttactaattcctgtgggaaagtgagttaacctccttgctctcaatttttctgtatacagtggaagaaaacctttattactttaataaatagaatttctataatgatcatggccatgtaatttgattcctctgagaaattattaaatgtttctcttaaccactccaacttatcctggctttgaagcatggccggaattaataatagcactatttaggaacccctgacagtgtacgatgataatgttttataaaaactatcttgtttaaacctaataatgattgtaagggatggttattgttattcccacattgcagatgaggaagccaagtcttagataacttaaagt

SEQ ID NO: 116144 - DNA, 1385 bp, Homo sapiens
aagcaatgtatggttgtttttgtgagttttcaaattttacataagtagatattctactttatgtatatgtttgcaactttttttgcttaatatcatgtttttgaaatatggatatgtgtagatataatttaattactatctctgtcagacatttaagtttctacttttctgctattaaaaaagaaagtgcttccttgagttcttttttactcttagtgagagattttgtaaatcacactgatgttttagggattcctcctaaagttaaaagcagattctctcttgcccgtgattcaggtctttggagaaatctccttcccccaaagcctctttaatgtgatttaacaaaaggagacttggacactctgaagtgacatctctatcctttctttgatatgttttcctggcattgaaaaactcaagtaaatataatacagaaaggaagaccttacagaaaacttttcaagttgacaaaaaggtagatactattaaattcagaaattacatctaagtcacataaagaatcctgtttagtcatgaaattaagaaactaattagggctgggcacagtggctcacgcctgtaatcccagcactttgggaggccgagacgggcagatcacctgaggtcaggagtttgagaccagcctgaccaacgtggttaaaccccgtctctactaaaaatacaaaaaaattagccgggtgtggtggcacatgcctgtaatcctagctacttgggaggctgaggcaggagaatcacttgaacctggttggcagaggttgcagtgagctgagatcgcgccattgcactccagcctgggcaaccagagcgaaactccatctcaaaagaaagaaagaaagaaagaaactaattagatggaacaacggtactgcttaggtttgcctctggtgtaagttaagaattctatgtagagtttacttcatttaccaaacatatttgtttgtatcatcctgttaaaaaataacagcaatgtagaaccaatataaatctttactatgccgaatgcagacttctgtgtcctttttatgtaatagtaaagatattattagaactatagtattaatagtaaaatatatattaggactatattttaagagacctttttagttatttgtactgacttataatctattagaagaaagctattgtttgaataaatatttcccagtttattgtcagagtattttgagaagtcttttaaataatgtatttctttttttttttttttttgaggcgagtcttgctgtgtcgcccgggctgcagtgcagtggcgcgatctcggctcactgcaagctccgcctcccaggttcacgccattctcctgcctgagcctcctgagtagctgggactacgggtgcccgcca

SEQ ID NO: 116145 - DNA, 1081 bp, Homo sapiens
catgtatgcttctaaaatcattgtgctatacaaaatcacacaataaaaaccatagggattattagaaaaatgcagttagagtggcaacactcaaaaactatattggtgacatattttttaaaaaggaacctaaaaaaaaaaaccagaagtacaattttacacgtgttaaatggttaacaaataaatactacaatgatactgctctttatattgaaaaagacttgaggtttgcttatggaagaaaggctatacttgttcagcggtagaaagagggttaatctgaaattggatggaaagttgtgcctcctaatgagcatgaatatggcgcataacacatgtagatgttaacctctgaagtacatgtttgaggtatgtatgttttgtgtattcctacacatctctgtttagctgggtgcatttttatgccttcacctagtatttcttgcagaagaaatcaccacaaaattcatgttatgcccaaattgttccctaatatgccaactgagttggaacaaatgcacattttcaaaacaagcattagagcagaactgactgtacctacctcacaaagttattatgaggataacatgaaacagttcatgtaaaatgcttagatttccttgcacataatagtgcctagttcattttagttatccttcttttgtaaccctagcgagcaactgctgtattcttcttagggaatatgatgatttacagtaaagaaactagtctagttactgacaaaaagtgtattcttattaggaaaaaaaactactgatttgggtttatcctactgagattttctaagtaggatgctgaaatctccccgcccctcttttttttcagtctgtgaagaaaaaaatggttagaaataagtatcaagagtagaaaacactcttagaatactctcacacaggagtaatttcacttttatgtggggaaaaagttgaaagactgaaaccagttgaagttgctgaaatctagaactgttaaggcagtataaagatttagcatgagttcgttgaaatagtctactgaagtttgaggaagaaaggatttaattaaacaaattaataacaat

SEQ ID NO: 116146 - DNA, 1035 bp, Homo sapiens
gatgatttttgtgggcattgaggtttgggaactgctgttctagagcaggggtcagcaaaccatttctataaattgctagacagtcaatatttttggctttgaggaccatatggtcttcactgtaactatttctgccattatagcacaaaagcagcaacagataatggagaaacaaataggtatgggcagctagactggcttctagaatttgttcgtctctgatagaatctagattctagaccatcggtttttgctgtatgaatattttctaagatattctcttcgaaatcaattttaatgagatttcctatgtgtttattttttgataactgacgaaaattcataaatacaggattaattcctagatatacattaaattaattaatagctgtaaaacttttgtaatagttaaaaccttttctatgttaatattagagtatgattaacttacttctaactatgtaatctgcttctcatattaggttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacaggtgagaggcaaatgttagtcaacctatctaatacgtactttcctcttcactctgatcaaacagcgggggtctgtgccttcattagtctgaccattcaacaatttctaggtgcctgtttgtttcaggttctatgttagatgatactagtgcaaacagatgacattctagtctagtaagagagaaaacagattaaaaaatgaaatagtgtgtgttaatgctgtagcagaagtattgacatacagtggaattctagacgaattataaagtctgaagtcgatgtgaggtcagagaaaattttataaaggatgaaactcttgactaagggcttgtaagagtggtttactgtacagaaagaggaaagcacagggtcagagtc

SEQ ID NO: 116147 - DNA, 2539 bp, Homo sapiens
cacctggctgatgcatcaactttctcaacagttgctggactataagccaaataagtacagtcttacagctctatatagcaaagcttatttttttcagcttttgtttttctcagaagataaccattaatagatacaaaaatatggtgagaattcagtattcacaaaggaaaataaaggaacaaatagcagttttacaaagccagaaaaaaaataagaaagaaagaaaacaaatgtaaaataaataataagtatttaaaagtaataaagatggaagaaataaaatcaaatatttctcatcttgaatatgaatggactgaattttctcatcaaaagacagacttacaaattggaataaaaacaaaaactagctacaggccatttatagttaaagcaccttaatcaagtgataaaagttgaaaataagaaggtaaggaaagagatattaagcaaatatgaacaagaaagtgagatttacagttaattaaaagcatttaacaagataaaaaggaacattataaaatgaaaaaagggtaatttgtaaagaaagtaataagcacaaacctatttgcacaaaaaatatggcaaccaaataaatatgtaaaggaaaaatctattcaaaatgtgaggagaaattgataaaatagttacaatgtgtgactgtaatgtatttctctcatattagatatttctagtagacagatataagtaagaaaattaagtaatcaaaaacttatttagtaaatatagctaaaaccttatatctcttgaacagataatacccacttttaggagtatatccagtgaatattttcaaaaaatcaagaatgtatttaggcataaaggaagcttaaagattttgcattctttgaccttaagcaatgaaatgagacttaaataatttaaaagggtaccagaccagttgtaaagtaagaaatgtactttcagattaaagaatgcatttaaagaagaaatgcaaacttttttctaaaacccaggaaataaaatgctttatttcaaaacatgtaggacatggctaaagttataaagatcaccatttttaaagtatagggatataaaataaaagaaaaacgaatcaaaacagaagagggatcaatgctgattttgtaaaatagaatacaaaaaatatatatgagttgaaaagtacatgttaaatctggtcttttggaaagaaaataaaacaaaattcccttctaattattatgaagcagagagaggtaacaaaagtagacaaatctggaatatgataataaaagaaattaaaatacaagaaagctgtatggaattctacagcacacatttgaacttaaggagaatgaaaagctgataattagttgttactgctcatctaacgtatctgaggaaactgaagtgcttgaaggtgggacaagcaaggaagaatcaaaacaatttgttgtgcagaaccctcaaaatggtcaaccacaagttaccccaggagaaggtgatgagggatgtagcagacataacttcaaagtcaggaaagaagaatgattgaatccccagaatctctctgttccagtcaggagagctgtttatacaagaacaatggccatgtggaaataaaagcagtgttttattaatccgaccaagtacctgataactcctaaacgtaggcaagtgattttaaaatgtgagccttaaaataagagccttaaatgagacttctgtcctcctgaatctctacctatttcaccatcaaacccaggagtgtcattctaaaacactgcaattttaggaaaagccagtctgtccaatatctaaggacaatgggtcaatattgagcatgttttccttcagtgcctgagccactttattagggcagaatcctgggtccatctttcttctggaaggagagagaacagaagtgatagcaagacctcttcccacctggccaccttacctatccttaaaagaagaggtgaaagaagtgggaaaatgtcccactatacacgggtgtgggaacaggcaagaggatggcctgggtctgccctgaaaatctggctcttggggaaatggcaggaggcactaagggagccattgcacaatgtggcagacaaacagaggatgaaggaataatccttcatctgattaataagtaaatatgaccccagtgaggtgaagttaattgcctccttgatgtaacaccatcagtgtgggatcagaaccggtctcaacagcttgctgaccagtattcttcctagtttaccacactcattttgtcgctacccagtgatccagtatgaattttggattcagatttggagttctgatcctagttccaccactaaccagctgtgagatgtgggcaagtttcttaactcatttgttacctagtttcctcatatgtctagtgcagatcatagtagagcatacttcatagggctttggcgatgaatgactgagaaaatacgtaaagctctcaaaaacagtgcatggcacatggtaagagctcaatagatattagctatgtaatttgttttaaaaagagaacatagatttt

SEQ ID NO: 116148 - DNA, 1035 bp, Homo sapiens
cgtgtctctagtcattgtaacactgctcatatttagttacttcctacgaagtgatacagcccccaggaagaaccacttgtctaaccaatagctaatgaactagcacagagaactctagatggaagaagacaaagaagagagatatataggtgactgtatatttacacatgattatgaggttggtgcaaaaataattgtggtttttaccacaatggcaaaaacctcaattcctttgcaccaacctaataaatgtatagcaatagactaggaatgtctaaccaaagtgctaaatttgaactcttgataaagaagggggcataatataaggaaaattctattaacctagaactaaaaacattgaatattcaggaaaactgaggaatgagattaaatggaggtcagaataaaagaatgttaaaggttttgtgggaggaagagagtggagagaagtgaaattattatggtagtctcatctggtgttcaaaaagtagtaaggtaaaaataattatcttgaggtgaaaaccatgggttttagtgagggaaatagttaataccttgtttacaggtaatggtagagaagtatgtatctgattatgagaaggaactaggagttctgtatctccccagacttcttgtgcaaaatttagttaaaacttgtgctagtaaactcgttctggtcctgtttagaaaggaagaggcaattataagtactagggcttcaggagagtgcagctgctatacataaaacctgtaacagtgtatgaggcctgtatctggcaaaccctaggctttcttggaagaaaactttcttctatttgagtatattcatgtccagggatacagaagatacttttgatgtgtaaactttctttttctcgctcattctctctctttccctttttttttttaatggagtcttgctctgtcaccctggctggagtgcagtggcgcaatctcatctcactgcaacctccacctcccaggttcaagtgattctcctgcctcagcctctgagtagttgggattacaggcatg

SEQ ID NO: 116149 - DNA, 1059 bp, Homo sapiens
tggtgaaattattaaacatatggccaaactcctggacagtatcactgtgagtatcaattaagagatgtttgctgaattttattcagtaagttgtaattttgttaaaataaatggtcagcctaaagggtaatggttaggagagctgaagtgtctggattccaattctgagattctaagatttcttgctgttataggagggaattacaaatctgaataggggaaaggatagaatgagcctcgtggtattagattggaattggagatagcagtgtgagttttatatatcaacagctagatgttgggtgagtatatatgcatgttcatgtgtcatacatgaaatgaatatacaaacatctgtttcccagagctgtcctttgagaggagttagaaacaataccattgagcacactttgtgcacagattttgtttttttaattgagatattattttatactataaaatttactcttttgaagtgtatcattggtttttgatcacttataagttgtgcaatcaccagtatgtaattgcaggacattttcatcaccccttaaaaaaaaatccataactgagactgcccagtctcccttcactctataccctggccactactaatctacttttttttatctttatggatttgccttttctggacaatatgtagccttttgtttctggcatctttcacttagcatgttttcaaggtttgtgtatgttttcgaatatagtacttcattcctttatatggtagatcttagtttttaaacacaaatcttgaagagtggagcaagatggccaaatagagggctgcaatgattgtcacccctgcaagaacacgaaattttagcaactaattacacacaaaaaagcaccatcataaccaaaaatcaggtgggcactcacagtatctggttttaacttcatattgctgaaagaggcactgaagagggtaggaaagacagtcttgaattgccggtgtcaccgctttctcatcccctggcagcagcagtgtggcatggagaatctctgcactagggggagggagagcacagggattgg

SEQ ID NO: 116150 - DNA, 1428 bp, Homo sapiens
cccaaaatattattcaaaaattacttcatggacatgataccctttatgatggaaaggtcatctctgaagccttagttgtagagcacagcaatagaaaactttacatcagtattatgacttttatattccactatctgttttcttaacaaaaatataccacatactatgcactaatcacagagtttttcttttatcagcttccaacttttagagatgtattttttgccatagttctcctatatgccaatattaaatttcttcttggttataagacactgtatacacgatttctttttagctatgtgatttttaaactttttacaggaatagtagaataatatggcatgtccataatttatattttcatacctggattactccacttttatgttgtgtatctttctagacaaatttcttaaaaaattaagatgttctagaaaatatactattttatgttattattcagtaatcttatagctgcagatcattgcttgaatctgattttcacttcattcctataattttatttatttaaagtattggtctttgtgttttttcttgttcctttcctgttgtcctatctagtctctttgggtgtcctctcactgtccagtttttgcttatatcaagtctcctgggattgtaggaaaggagacttaggtaatgttatggaatgggttgtatagagggcacatactagacctgtttcaaaatattggtcatctagtcttttcatttaatatcaggatgtttaataaggtccatttttcagtcaaacttttaagtatttttttcatgtattcatttttatcactgtctaaatttgtaccttctgtctatgtttgtgttatgctcatagttacgcttttagtaactttttgggtaaaatagggaatgtttctaaagactcataagttcatatttttctttaaggaaattaaataatttatttgggaacacttttaaatataattggtcttgccttcatggaactaggagagtttaattaatttaatttatttgttcaatgtttaatcacctggttggtaccatttttagcaaatttgtatttttttagacatctttaggttttctcctccatttgtcatttagacaccacttaaatgtattgcatttttcatagtgttaagtctacattgtatacttcttatttgaggttgggaatctttcttaaaaatttcgattgtaaatgacctttcaaatttcatgtatatgatacaaagtgtgtatatttctgtaaacaatagaagctttcctcatttaaaaattaggaaggttctaagcaaagtgaaattctctagggccattataaaatttataaagatattttaacttcctgttgttaaatcagtgatttatttctttatttttaaatttgtgtgtgtgtatatatatatgtgtgtgtgt

SEQ ID NO: 116151 - DNA, 1030 bp, Homo sapiens
agtgttcatagttctgttatttttatgctttatcttgtaggtggttatggcagttgctcagctgtattggcacatatcaccaaaatctgaagctggcataatttctaaatcactagtgcgtttacttcgtagcaataggtaggtcatgattttatatatattttttcttttgtattccttcaaaagtaatgtttgaacaaatgtaatctttcaggcatttaatatataactctgactatattttaatcaatcgatcagtaagatttcatacttaaggggattattataaaagtctttatgcatttatctcaaacttaatgataaatactgaaactttttaacctcaagcccaaagatattgaaaatattttgtggcataacactagagtgtcactagtagcctagtattagtgtttgaaatttttaggtatggcaataatgatgtttgggagttttggtaaatctggaatcactgaaaaactatactgaagtactatcagattgacttactcaatgtattaatacatggttttatatagagcaatgtgtatgctaagtaatgtagtttatgccagaattgtgcttcctataaagctggaatatttaattactatgctttgctccactctaaaaagagagctgtgtttttaatagctactcattttaaagattgcatactcttagtttcagatagacagacagaaagagcatgccaccttctttgattttacctctttataatttagtggtttaggttaacgattcaaaacaatttattgagtttccatgacatataacatgagaatcatgatttcaggtttaattcagacatttgtttctgtgtttaagaataccttcatttcagctatttgacataccttagctatttttcagtaattagttgttttaatttgaaacaatgtttttcattgagtgcttgtttccactaattgcgttggaaggaaaaaactatgtatttatttttgcccttaactggaacttagtccacaattgtagctcttgactggct

SEQ ID NO: 116152 - DNA, 1522 bp, Homo sapiens
attatctaatgcattgcatcttttaaagcctgtcaagtcttgcagaatgtccttctgggtttgtctgattgctgctgcttctttttattttgttattttgtttgctatacctactggaatgggatggttgcatcttttatagtgtcatttaattcttttatattctgtgtttcctgttaactggcagttatatccaaaggcttgacggatttaggttaaacatgttcttaaagattttaattgagaaagtattcttaatgaattgttctgttcagaacaattcttaatgaattgattcttgagaatttagagcttacagctttgtatatccaagttatcaacaacaatttttgtctaatacctaatggtttagtttccaaatcattattcagtaatcatgcctagtcataatgaaaatattatttcatggctgttgtaaaatatgcttatattttaatgtactcagcttagccagatgctagttaggtagctgtaatttgccatcttaagctgtactttatgagtgactcactgttcatttaactaggtcttagaaattgattttatagttcaaatacttatggatcaaaaacgttttcaaatagtgaaacaaatagtggcagtttgtacttctggtcccattttgtttgggttccctgcttacttgatgctgtaatagaggtggtttactttttgtgtcagtgtattttggtaccttgttttgggatgctgctaaatatgagtaaaggctaacttttgaagaattgtggatagatttttttttaacctcgtacttaagtttatggagagactttgagaatttctttcaggaaacataatacatcattgctatgtagtttgtactggagatagatactgaaagcggaatgttaggaggctattctaacagtctaaataaggtgacagcggcatgaatggttaagagtagaaaagtgtttataggatgcgctttattatgaacaggcatgatgtaactgtagaaggtctataaggttgtatatttttagtctttttggattttgaagttttgggaacttttttcatggcgtttacaaattagcctatacatttcaaatctgggtatcaaagcgactttcaactgttggatttctaaataccgaggaaaaagaggctcatttagtccttttggattttggagtaccctaatatattagaacagatggcatgccaaatggcagctagaattttaaagacattgacatgtataggaagtacagtttgctttcttgccagtaggattggacttttatttgtaagggaaaaggatttactatctgtaagatagattaaaattaagattcagctttcttttctatcatttactaatacttattagccaggtatatgcgttaatatttttttaaatgactgatcttggattaggtcaatcattaattgagattcttttattttataagatttaaaattcaggagagtttattttgtaaccaacttatatttgcagttcacaagtgaagaa

SEQ ID NO: 116153 - DNA, 1864 bp, Homo sapiens
aaacttctgctcagattttttttctattgtataaagttataggcaattttgccttagctaatcactgtcaccatttaaatttttaaattttactttcctatcattttcagtaactatatgcaaatgatcctttgcttgtaattatatagaaactggagttaaaatatatagtgtacttaccatacctgctaaaaatatgtaacccgtagtaaaatctctgcttttgtatatttgtctgtttatttgtttttctgttccttgaattttatcttattttagataaaatttatttttaaagccattgcaaaggaaagttaagttttacaccatcatatacatttgttttttgacagataatttgaaaaattgggactgtattcattcttggtgttttcacatgttaactccatgaacatgaattaggacaaacatgaggtgaagtctggtcattgtccctggcatactggaatgggctaagtcatttcttttctttgccacttacttgcaatccaaccttggaattattcgaaatgctgtgctcattagactaatttagtggttttccagtgtgcacatcagccctcaggatgtgctagcactgccacaggaacgagccaagcagggcaggggtgctctagactgtgcagctttttgggcttttgccactgtttcaaacacagaagccttttttgccttcctttcttatgcagcgttgaatttgatttcctttgagaaagatccattggcttaaaagacagatagaaagaaaaccactttaaatagaagatttataagtttagctaatttgattcctattattgttgttgttgttttttaattatagaagcaattcaagtacatgttcccttctcgtaacctcttggttgacgccttagaggcaattattggtaactgtttaatttcagttactctggtggttataaattttactttggataaaacattttgctttatttattaatttaagttgatatcagttgacctcaattcaaggaaaaattattcatcgattgtgtaagtgctatttgagggtctcgtttagcccagaataatcagtataacaggcttttgtctacatacgtacatatgttcagttcagaagcagtgtgaaagatttgaaaggctcagcccttattgcagtattagaatcaaggattgtacaatatgttagactcttgttataaatatattttataaaattaagattcaaatgagtggtcaacactaggaccatgtctgtgctctcactcttccagttaacccatctcaggcttcctctgtgctaattatgattttgttttactgagaaactttggagtgagcagtgtagccatttatagtcttcagtgctttctgatctaggcttgatgttgcttccaactttttagcgactacacatggtagttttagctttagaagttggcagacgaggccgggcgcggtggctcacgcctgtaatcccagcactttgggaggctgaggcgggcttatcacgaggtcaggagatcaagaccatcctggctaacacggtgaaaccccatctctactaaaaatacaaaaaaaattagccgggcacggtggcgggcacctgtagtcccagctacttgggaggctgaggcaggagaatggcatgaacccaggaggcagagcttgcagtgagccgagatcgcaccactgcactccagcctgggtgtctcaaaaaaataaataaataaataaataaaaataaaagaagttggcagactaaatctcaaagcagagtttgaccatagctagaagaaactgagaagtatttggcatttatatttgcttgctctttcttatgtgatgttgtaaaaggaac

SEQ ID NO: 116154 - DNA, 1413 bp, Homo sapiens
gaaataaacacatcagaatttacttctcttcagaatagtattttctagacatattagaactattaaaattattctttgacgaatagtcaccataaagtttgttattcaaacatgaacattcattttaattgaatgactgaatactttaatactgattggcatgaaactgattactataatgcctgagtaagacctttgatgtaggggagaaacattttttaataagttactatttctttcttttctagttggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagaggtaagtgttgaacagtcttccactttcaagtatactaagagaatggatgagctttttaaaacttgggcaaaaaattaggagtagtaaactagagaaatctgcatatttaaggaagactcatttgtctcttgttcttttactaaagcaggcaaccaatataaatgcaagcataattatccattattttggcactgattgatacatatttattggtgtaagtatatacacttttagtttgatactggcaagaggcccttgttaggaggagcagcatgacacagtgtttacagtgacattgccaaaccatggatttttttggttactagttactttcacgtctttgagccccagctattccaggtactcatttgtaaaaaaagtaggtgatgtgctcctatagcatgtgaatttatacctaaagtaattaatttcttgcctctatagataaatattgttgaacttttaaactactttttcctagttttgtatttataaaatgtttgtgttcttctcttcactttagctggtagcatttagtaaaattaataatttaagtgaagctatttgttttctttgtgcagattaacattagaagtacgccttattcttttttttaagtatgccttattcttttcatcatattgacaatttagaaaattttatcatataacttgtaattaagatccttaggatgtatacatttaagatttaaggtaattttaaaccagtttaaataaatccttaaatgttgtaagaatagcacattcattctagtcttttgatgtcttatctttttaaaatacagtattatagattttaaaaaccaatttgtgtaaaaaaaaaaaagatttttaaaaagctcctgttatatcaaagtggtctgtatacatacttatgacaggccttgagtgctcagtacatcttgcttttgttaattagaaaaatgtaaataacatggaaaaatgtatgatacatgctttaa

SEQ ID NO: 116155 - DNA, 1030 bp, Homo sapiens
atttggaaattctccatatttgtttttgggaagtatgtatgcatagtaaaataatgactgctatctagttatttttttcctcccagttgaaaagagtttgtggtttatctacttacagtcgctttcttgaagttttccaactcttttagaagtgaacttgttctttcagtactatcttaactaaaccattgatatctggtttagttaatatgaacaatattagagggaaagatgaggacacattcatgagaaaaaccatcccattttatttgtttttctttatttctaacttataattcttgctctcctttccctctttaaaaatttctcaacatccttgaattggtgagcatcatgtaaagctagaattaaagggaaaaattaatatgttatttttgtattttttagccttgatccagagcagaaggaaatgttaattgaagtaattgaaaaacttctgaaagataaaagcacagtaagtaatgtctttttacgtctttgacataaaaatgtactttatttacatagtatcatttaccattatatattttatatagttgtatttattgatttcaaaatggtataaatattaatggcacacaggactatttttaaagaacaaaaattttcatgtaatgagaaagactgcatttggagttttagatcgttatgtgtttcttcatcagaatctgaaaaaaggcaagttgagaaaaaaatctttaacctgtggctaagtggttaacatggtaagatcaaggaatagaggtgacctatgggggatgtgagttactagtgtactagtatcttagatggggcttttgtacccactttatatttctcaaaactactgaggaaaaggattccagctcatcttaggatgctatcatcagggagtatgtactatctatgcatggcagctatctaatacagtaggcagtagccctgtgtagctgtaactattggtttatggcttagcatttgatctatcctggataatgttcaataaacatttgattagaatgtgtattct

SEQ ID NO: 116156 - DNA, 1079 bp, Homo sapiens
tctgaaggttgagaagcactaatttaaaccaagaaagtgtaaagagtctaatcgtgaatatagatggaaagtacattgataatagagatggggttctatggaatgaagtcattactaccttttactacagttgtaaatttcttgttggatttttaataataatactgcaatgatgtcattttcaaatgagaagatgtgcaattggggttaaaaaacagtgatttaaagcattcttcttttataaatgtatatattataaataaaatataatttttttcctaggttttcagatgctcttaggggaagagttgtctcctcttttgttaggggtaccttaatagaaatatctgcggactgccatcataggccacaacatgtagtagttaggaacatgcccctgtttgcatcctgattctgcacttgctagctctgtgactttgggcaagttatataaacctctgagccttactttccttatctttgagagggagataattgtacctaggatagatatgagaattaaacgagtaatataatgtagatgtagggccttacacatttaaattctagctggaaagttatagcagattgaggtgaagaacaaaagctgtcgcaggcagttttcctttcatattctgtatttcctaattaattttaatactagccagaatgacaagggtacttttagaaaagaaaggctgggctgggcgtggtggctcacgcctgtaatcccagcactttgggaggccggggtgggcggatcacctgaggtcaggagttcaagaccagcctgaacaatatgatgaaaccccgttctctactaaaaatagaaaaattagctgggcgtggtggcatgcgcctgtaatcccagctactctggaggttgagacaggacaatcgcttgaacccaggaggcggaggttgcggtgagctgagatcatgccattgcactccagcctgggcaacaagagcaaaacgccgtctcaaaaaaaaaaaaagaaaaaagaaaaacaaaggctgaggaacttctccagatgaaagaagaccaaggagacatgaaaacttaaatatgatgcatg

SEQ ID NO: 116157 - DNA, 1024 bp, Homo sapiens
ttattaaacactatgtgcttgttatatataattctgaattgataattttcaactactctccctttgacaccttatggccatgatatctgagcttctaatttgatatgtttattagttttatggcctgtggtataagaaagtccaaatatctggaaaaaataaacatttaacttagaaaaattatgaggcataggtgaagcttgtcttagtattatcaggaatagagtctcttagtagcaataggaataattgctaacattaaaaaaacctgtctgaccaaggttattagtgccttgcatagatctactccgttttatcctcacaaataaccctgtggggctgtttctgtcattacttgtattttatatatgaggacaagatggcagaaaggttaaattagctgatcaaggtcacacagccagtgtgtagcagtcagaatccaaagctaggttgcttgacttcagaacccatcttagcccattcagcgccatctttcctgtttgatgattcctccctctgttttgtctcttaatatttttgactccttatcaacatctggcattagccatcctttgggaggtacctagtattggcatattttttttcttttatgttttagttatgggtagaaatgacgaagtccttagaaattggtggtaaagtagctagttccctgaggacttctagttcttgttgtaaacagaaaattccataccaattattgttccttcagaactgttttactattcaaatagttatcagtaggagaacttttccatttgctcatattttccctttacaattagattctggtagctgcctaatgttctgttacaaaaatgtcaatataaacataattattggtctatttgttttggatttctttcgttctttaaataccttgtttattttatttttttgaaacatggttaagcctttaatgttttgggaaaactgacataagtttcttaaaacttatgttcagaaattgaatgtttcactcctctcaagtgcaaaatttcat

SEQ ID NO: 116158 - DNA, 1021 bp, Homo sapiens
aaaatatgagtcattgctaaatatttaatgatgtctttcctctgctcacaactctccattggtctcctgcttcactcatagtaaaagccaactcattttacagtggtttatacatttctgaccttatctctcaccattcttcccctcacttactccagtctggctctcctggcctcctattcctggcacatgccatgcctaaaccattgtttccctagctagtcacatgggtcccttcctctcttcctttgcatccctgccaaaaggaaggccttttctgaccaccttatctaaaagagcaactcccacctccacctcagcacttctcatcccccgatactactttatttttctccacagtagtctattgccacctcactattattgtttattgacccttgccccattagaaggtaagcagcacatgggcaaggactttgtattggttatggttggatccctaaggcctaggatggtccctgctagaaagtatcttctcagcaaatatttgttgagtgaatttgattgtggtgtttttttccttccccatatttgaataacgttctgcggaataaagttagatagtcatggagtaggataccataggacaggatgtctgactttaggtaatcattgaatgaatgaatgaatgaatgaatgaatgaatggcaggggtcctacagaacatttaatccctctcttttcttatttcaaagatgagaaaatggagagaggtgtacaaatcatagaaagatgtcttagcttcagtattttgtaaaccctccatagtgctcagcaggtttcacaaaatactcaaaagaatgtcacaggtaaggaaatagaatataaaaagactagcttgtattcaagaatattttaaggctatcatatagaaagttcttataagaaattggtaacggggattctaatgcttcaagtatcacatatttatataacatttgttgtaaattaataaagctaatatctttttaaaggcagtttattagatatggtatgtaat

SEQ ID NO: 116159 - DNA, 1702 bp, Homo sapiens
gtggtgatgcactcctgtaatcccagctactcaggaggctgaggcaggagaatcacttgaatccaggaggcggaggttgcgtgagcggagatcacactactgcattccagcctgggtgacagagtgagactctgtctcaaaagaaagaacaaacaaacaaaaacataataaaattaaagaaaaataaaatgaaaaaggcacacaaaataaaatacaagccccactttttaaattagactcaataaacataaaattacattgtcaaattgttccgtcacggttctcaatgtgcttattctgaattttggtacctatctcctcatgggttggtaacaaaaatttgtgaattagtcatgattcttggaccagactttctcagatcatactttaagtagcactgatatagtgtacagtactacatagtcttaattttccccttaatttatgttgtctttagaaggagtagaaggttttaatgagttatggattatagattgattaaaaagagaggtaatttacactacataatagccctaacacatccctagttcttatatataactggtaaactttatttttcagttatagttactagttcattctggggctaaaataagaatgactttcctggtaatagtaagatttgccttaaatgttcagttatatattcttctctgtcctttgaaacttaaaactggcctattttgaacatgaaaggaaaagttataccatttaacaccacaagatgtcacttatgtaaaaataaagttggtatcctaatactcaaagctagaaagctacaggtaactaggtaaatgaagacacaggtaaattaaaaatgaatatatttgaaacaactattgttttcagcaaagagttgaggaaaatattgctaattcagcattattttgactcaaatattgatatttaacaaaatagtatctaagatttatgcagtaatacatgttaactgatcatatttgaatctacgtaatgaagaaggtagacctaaaagaacttaataaaagttaatgtattttgagggtaaagtaggtgttatggtattaactttcctaaatctttactgttttggtgacaggcaaagaagaatttgggaagaaacatgtaatttatatcagaattttaaatagatccttatgacatacgtgagaagctgcatattacatcaggttgaaacagtgcctaggatttttcttgtctcttccctgaacctcagaattattagtttctcttcctatattaatgcagtatttgttgttgaagactagcttttctgttaaccatgaagagcaaaacctttatctttaatattgagattctgttttcttgtttttagtttcagagagcaggtgcttgttctgggcactctgggaatttgggctttagatgagcaaaccaagtttccattagtttacgagtaagactatgcctggaattagaggttgggctgttctaaaaattgacacttcattcctcttcattgctcacttctctctccagataaaactggtagaggagaataatgggacactttggggaacagaaaaggggaacaagcaggagaaaattgttttcttttttggcatgtgtgtatgtgtgaccacatttcctttctatttagttcctatcgaattctttttttttcttacctaacttcagtaagatttttttaaggtttctt

SEQ ID NO: 116160 - DNA, 1065 bp, Homo sapiens
tccatttggttgttttgtatggattctactaattgttgatttctgtgttgtttcatctgttttgtccatctcttctacattttcctgaccatgttaattgtaattattttaaaatccctgtgtgataactctggtatctgagtcactcatggatctgctcctggtttttttttttttttttttcctttttttcttttttgggcgggggtaatttcatcctgtttttagtatgtctcgtaagttttgatcagatgctaggtatttaggataaaaatgattgatgaagctttgggtgatagcttcttccatacagggctgggtttttgtttttgtttttttttccagccaagcaaatagaatgtaagcagatcattctgatcttgtcaaagctcagttttagactttttaaggtcttgtttatggaactttttcttatactcctcgggcatcttccttagcactctgtgtggctcttcagtaatcttaatggaaagtccagggcattcaccaaagcctctcttctgaggacagacttgacagctgctgttttttgttgtgtttcctggagtcttgccttaggaattgcagccaacattttgcacacagatttttgtgtaccttgtctctggttccctcctctgtaattttgtccttcaagtctcagtcactgtggcagccctggaattcaacatttgtctcctcaagttattaagactgtgacttctccttgggttctgttctcccacatggcaatttgggaaatgtactgagggaaaaagctggtgtgaatgaggagctctttttttcccttgagagagataggttcttactctgtcacccaggccacagtgcagtggcatcatcatggttcattgcagtcttaccctcttgtgctcaagattctcccaccgtgtctctgagcagctgggattacaggcgcatgtcaccacacctggctactttttgtatttttagtaaagatggagtctcaccatgttgcccaggctggtctcaaactcctgaggtcaagctatccactagcctcggcctcccaaactgctggga

SEQ ID NO: 116161 - DNA, 1029 bp, Homo sapiens
ctgttcttgaactcctgggctgaagcgatcttcctgcctccgcatcccaaagtcttgggattgcaggcatgagtcacagtgcccggccattgaaatatattcttaatatagtcagctttatagcagaaattgacagcgtagtatggtgaataggaagaatgttgaatttcaaaacaagattgaaatttaattccttgctttgccattccctggttttatgatgatatacataaaaggcatgtgattttagaatttctcacatgctatgtaatcttatgttacctttatatattctgagacttggtttactcatctattaaatgggaacaataatagctacacacgcttcatagagactttgtgatactaaaataagacagtgttataagcttcagaaaataaaaccactaccacgtggctaaataagttaataatatgttataaacacgacatgttagcggtgagttagtcaatgatgtggaaaggatataacttccaatcccatatctcataactcccattcatgtgtaactacaaagaacaagttcttatgtatcctttcagaaattttttaaaaaaattaaacgatcatatatatactattctctatgtatcttgctttccacctggtatattttaaaagatctttccatatgttgatatgtctttccatatcaacatatgataccattttaatcttttaaaccagcaatcgccaaaccagcagtacccagggacctgtttcatggaagacagtttttccatggaagggggtgggggttggcttggggatgagactattccacctcagatcaggcattagattctcataaggagcgtgcagcctagatccctcgcatgcacagtttacaagagggtttgcactcctctgataatctaatgccgctactgatctgacaggaggcggagctcaggcagtaatactcctcatctgccacttgcctgctgtgtggcatcctggtttctaacaagccacagatgggtaatgttctgtggcctgggggttga

SEQ ID NO: 116162 - DNA, 1077 bp, Homo sapiens
cagtttttctgaattatatttcacaagtgtttgaaacaactaaatatatttacttttaatggcaaaaactgcagttacttttgcaccagcttaatacaaagtacctttaatgtgcaccacataaaaataaatgaaattaataagccctgattcttctgtgtgattatcaaggatttgggaacaatgattatagtacaaaggagtaaaaagtgtatttgttttaaactttttttttttttcaattttcagtcttcttttgtatcctatggctttgaagctgttcttgaagaagcagcctatttctcatttttcctaaaagaaggcaggcttatgtatgttttgctttaacagaaataaaaagaggaggggctaaatggtcagcagtgccagctgctggtgtggaatcaagcaaaatggtaaggcagtttggtgataaggcagttgttggtgaccttggtggtggtgacagcagtgtcaagggatgttgagtgtggaaatcgatggcagtccattggtggatgggtgagaagtgagtaaaagaagatcacttctccgaagaactttggctttcaggtagaggacgaaggatggttattgcagggagacatggagtctaacgagcttttttttcttttagagtagtttctcttttatttttaattatggtaaaatacacctgaataactttatcatcctaaccattttttcccctatttgacaaggtatcaagcaacctaaccattgttaagtgtgcagttcagtggcattaaatatagtcatattgttaggcaatcgttaccaccatccctctccagaactctttttatatgcaccactgaaactctgcacccattaaataaatccctattttctcctctctcctattcctacatacacacagagtcccatctattttgatactttgtatattacttaaataattttggatgatagtgactgcaaatgatttttttcttagcattcttagtattgtaaaacggtttttcattcatgtagcaaaactataaaaaaagtttcaatatagtttggtcaataggatatgtttatgtttcaaaa

SEQ ID NO: 116163 - DNA, 1046 bp, Homo sapiens
tcattgtcaactttacaatatcaaacatgaaaattctattacattcattcttaacctttaatatcagtgattctcaggagagtccagtaggaagattacatgtgtctgtggtttgtacgcaattatagcaactctgactttatctccactactttttgtatctttctgaaaggcatatagaaatgcagctgagtgagattcatttacttagagggatgttattgaatatactttcttaaaaatacaattttattaatagtaacgcattatatttgacctacctcaaagagtcattgtgtctcactatgggttctaaacttgtttgtgtttaagtccattttttattaatacttaattttatctagtgtctgtaccatatttttgggtgtttttttttttcatttaacattttttcatggtctagttgtttagagcttgctctactttctttttgcttatcctagtatttctcatttaaactttatctcattgtgtattttcagtttatgtagttgctcagtgaatatttcttaaatatttatatagataaatcgttcacacattctgctcatattaaagactgtgatttgtgtgaaggtgcctagcaaagtgtttggctcataattttgcttaataaaatattttcagatccttttactcaattcagtgatttagattccattaacatttgctctctcattagccaatgttgttaaaaaatgaagcatgactgattccgtggaccctatacagaaggaaaccctcatctggtatctccattgtattgtagtacagcatcaccctgaagctaattttgtgtagttcacttgggtctttgctgtggttaggattaactgactcggaattgtcatgtaggtatggaatgaactttacaatcaggatttttagtctttatcccagtcttcaaaggcatctttacctcccagtcttggattattccatatgtatggttcattcctctgtgttttcaccataaaaatgcataacaattatagtgtctttatcttgtttttaagaaactcaga

SEQ ID NO: 116164 - DNA, 2153 bp, Homo sapiens
ggaaactccttaacggatcaaaacggatgcaatgggtatccttctccaaagacacacctcaaacgggccgggagccgggcagttagccacccgctgcctccccttccgcagtccggctcgcagccgctcagctacctctaaagcccggagcaggaaagtccgcgcaggcctggatggcccgggtggtaatctagcaggcctgcacactgcgcatgcgcagggggtggactgccaggtcggctcagggagccgtgacgagtccggaagcgcctgcgcgcgctcctccgtacgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagtgaggagaaaggtttgggttgcggggatgggagggaggagctgcggactcggaggagtgggcgccagggtgggcttcctggagaggagcggggtcgccctgaggtctgagcagggcagggcggtaacgtgtcccgcgggtgggtaggtggggttggttggcggtggtgggagttgtgggagtttggggcgaatgtgtgtaggggtctctagtagttttcaaactttagtgaaaaggaaaccacttggtgagcttagatcccacccctgaagacactgattgaattggacttgggctgggctcaggagtctgaattttgagcatcgtcttctagtttatttaccgttcgccggatcagactttaatacattccctgattagggtgaaaggagtgttttggtgaaggtgagagtgcgagtgttgcttgtgggaagttattttgtgaccccggagtgtaggagcagagaggtggatttaggctgtttgaatggacaaactggtttacaccagtattaatgttcttggattatgtcctttgcactacagacaaaaacaccaatccaaaataagcatatgaatagaaaatattttaaaagagtgttactgtgaacaaatccaaaacttttacagattaataatgtgaattttaaaaacgaatgttaaacaaggtacacttagttttgtaaaaagtatcaccgagaaatggaaagaaatcccaagttgtttgttttggggggtgggttggtggtagtggttacatttaccagaattatcatttttacatttctcttattttaaatctttcattactaagcaatagggtcacataatagtctgtcactaaattcatgctaaattaaggtagaatagctgtgctagtagctttgcagatctgttagagggtataattaaaatttaaattaaacgttactaacaatattgggtagtctagaaagtgctactacttcaaattgggattacattttggctgtattgaggatcaaaatcatatatatagcatgtaagatacaatcttttcctttttcccaaggttagaaaagtttaaaagtaaggtaactgatttcatttttcattatatgcatttgatgatccattgttctagaacaagtacggagcttgttgcctctactattagcaaaatgtttagactgaattaacctgtatatcggcatcaatctgtttcgcaaattaatttacttttatggtttgtgaacatctacgatgttttctcttagatttttgtcagatttggggccaggcactgcggctcacgcctgtaatcccagcactttgggagggtgaggtgggcggatcgcttgaggccaggagttcgagaccagcctggccaacatggtgaaaccccgtctctactaaaaatacaaaaattagccgggcgtggtggctcgtgcctgtaatcccagctactcgggaggctgaggcaggagaatcgcttgaacccgggaggcggaagctgcagtgagccgagatcgcgccacagcactcaaacgtgggcgacagagtgagactccgtctcaaaaaaagaaaaaaaagaaaaagatttttgtcaaatttggacctgatttggaaaaaaaaaacaaaaaaaacttacggctttgactctgt

SEQ ID NO: 116165 - DNA, 1046 bp, Homo sapiens
ttgagtctattctccttatataatataaccatagtggtttacttgattttattggttcttgtaaggctatttgctggattcagttcatttttttttgttgagcccctgctttatattctagtggttttcctaggcttagtgaatggttttatgaaatttgaatggctttcattgcgcatcaagaaacttggaataactggaaatctgtagtgatcgaaaagaaaataggtgattaattatatagaagtttctgaggatccactcttgagctgttaaaatggggttttaaagctatagagggaaaaatattttctgtatagtcaacatgtaattattgaagaattgctgtatgtcctttgttttctgttgagtttattcattcaacaaatactgaagaagtgtctctgtccttatggctattagtctaacagtgagacaaatatgcttggaaaatgaatgaaaggggagagtttaataaccagcagaggtcagcaatataggctcttacaagtcagcataagagtgtatggttaagtgccggaacaagtgcagtttgttcataaaaggaagaaattagtaagtggtcagaaaattttcatgctttatgcttttgcatattaacatgataattgattgaataagatagttcattatggaaataacatttaaattaatttttaaaatatgaagagaattagaatttcacagctgggggggcaaattcttaaaatatattcagtcagatctcatagattaaaaaacaaagcccacagaggcacacttgctcattgtcttgtgcccatgtgtaggtagtgtagaattggcattagaacttaggtctcctgatttctagtccattactggtgacactgtatgtgctccctggttgcattttgataccaaaattcttgttttgtatttggaggttagagttgaggggaggcagcagaggataggattaaaaaattttggctcaagaatttgaaaagatctgggcttgatcctggctttgacactaactggttgtgagaccttggaaagttact

SEQ ID NO: 116166 - DNA, 2247 bp, Homo sapiens
taaaaactgtgggatataacatctaaaatcgggaaatggccttaggtgctgtttttacccgctattttcatgttttgacttctttattttaattttttatttcccccaccatttctcaagtcttatttttaatctggtttctttatgtagacacatttttttccctttacagtttgaatttgtttttctctgcatttttaaaggttctataattcttcagcttccttatcatgactgtttcatgttttctttgttgtagggttttcgtacatgtatcttttggatattattttttcccagattttgagtattctaaatttgattctttggtattggtttaatcttggacttaacagaaaacttgaaaaaattagaagctagtctttctccacttgagataggaattataacagaattatatttgaagatttaagatgctgaggagaaaattgaagtttaaaaactggatggccctttcatgccagccagactctttggactgtgaaataaatctgttttagggtagaagcactggatatgtgctttctttttgtttcttgttttttctgtacataaatggttcctgctaaacatggtatgatatgacactggaaaattattttactatctaatgtgctctaaggtgatgatattctgagaaaattttttaaaaatctaaagcttgtctttcagagttctaggaatacaaagatatagttctacagtttttctgaacttttgttaacataatagagtttttctttattatgaaacaaaaaataatatcacatttgttataatataaataaccttttctttttctaaaaaaaatttacaggtagaaaaaataattggccacctcttcctagcaattttcctgtcggaccttgtttctatcaggatttttctgtagacattcctgtagaattccaaaagacagtaaagcttatgtactacttgtggatgtgtgagtatacaacaatttacatctttgcttagaatttgtatttttgttgtcaaaatccgcatttttatttcaaggatagtatagcaaaccagtcttctttttctatagataaagcttaataatcatgatttcagagtgaaacatatcctatttaggtacttcagaattgtactatatgtgacaatgtaagtccttggctgagaaaaacttgtatgttgagaactggcattcttttgaggaaaagacaacttctctgtcatgtgggtaaaattttataagattctttttccttgaaagatgttatctagacatgatttgcttggaaaaaatagtgcatactaattttatgcagaggaaggccatttaaaagaattctgttaaatgtaggcgttttagctatttttaaaagggcataaaattattacataaactaagtgttctttttatagctttgagtacagtttactttttgttttcaattgcgatacttttattattgaaagtgcttaattaatacaggacattttgttgaacggaacattagaatatacgtttggggctctgatgcttacatcactttgagtataataactcatggaatactgaaacaaaatgtcaagccgttaacagttttactctgtgtgcacagacctcccacttactctctgtttcatttttattccaaacagtagtctcagcctcattttgataccctgtcagaaggggaggtagctattgagggttctcacatgcacaacatctgggttaatggataatttgtagggtacattcttgatggaggaaatttacttgtttttactttatgattaatgagactaccacccttcccttaatggatgagataattttccttaaaatcttttaggagcattcttcatgtatgtcaagttgttttggaatgtgagaagtgtttcctaatggatagtctatttttaactcttcattagtatttttcgagatattcttgatctaatatcttttgctgaatcctcagtgtcagtagtatatatttttaatattaaatgtctgattccatatatgtacatgctaaccaactcttatttaatcaatataatatatgcatttatattttatatatgtttatttttttaaatgggcagaaattgtcctagcattttattttattttgagacagagtcttgctttgttgcctaggctggagtgcaatggcacgatcttggttcactgcaacctccgcttcccgggttcaagtgattctcgtgcctcagcctcctgag

SEQ ID NO: 116167 - DNA, 1050 bp, Homo sapiens
gggtggggctaccaaggggctcaaggaaactttggggatatgctcatcatagtgattggggaatcaagtatataaatatgtcaaaaattattaaagcgatattttaaatatttgcaattcattgtgtgttgattgtaattctatgatgctgtttaataaaagaagaaaacgagtaagtttttttgtcaagagggattgtggtgcagttggaaattgaaagtttgtccttgtgaggttagaataacgatatctagtgttagcatgacgagttcacataagttattacaatgttgttaacttgaggcctcaggtggttgccacttttttttgtttgtgcttttaaggtttgaatgtcattctgcaggtaaatgtaaagataatgagaaaaatgacgtttttccccttctttctctccccctaacccccttttttctttctttctttttttttttcaaaggagtgacagttcatttagattctttgtattcttcttcgtctatatttgtcagtttgctgtacatgtactccaagctgcaggatttcataactggggcattggtaagtttttttttttactagttttcagctttaatctaatattgtaatataatttttggcttcctaatctagttaacacagataaaccagattagaaaaattaaataaaaagcaaaaattgttttaaaaatacaattttaaaatgtcataaggcataaactttggacaaacctgtgtctttgaagattatgttcccatctataaaaacagcacattttttctagtttaaataaaacatgtatgtaagggcgctaagaggaagactgcaaaagagactgaggtggtcagagagatagagggaccaaggaatgtggaagggacaggaaagagcttcagggattctaaggaaaagggatacctattatgtataaagccctattttaggtatacaaacagatatatttttatatacgaatatacatggacacttgtctttgaaaggtagaataactgcacacacgttatatacatatatctttaaacaatcgaatc

SEQ ID NO: 116168 - DNA, 1050 bp, Homo sapiens
gcacgcacctgtaatcccagctactcaggaggctgaggtaggagaatcgcttgaacccaggaggcggagattacaatgagccgagatcatgccactatactgcagcctgggcaacagagcgagcttctgtctcaaaaaaaagagtaataataaattcaaaactcataagcttaaaaaatgtacagcttaaaaaatgtacagtctggaattaaacacttgagactctggagtttggtttgcttttgaatttagactatgccatttataagctgtgtgacctcgggcagattactgaatgtctcagttcctcatttgtcaaatggggatttaaaacagcatctatcctattgggtgggttgtgagaattaaatgcactaatacacataaagaacttgaatattgcctggctgataagtgttgaatatgtgttagatattatgctatttttaaaaagtttacatcaacttttgcctaattacactttttattactttttagtggttggatttcatcccttactggtctcaaccaaaatattcctgttggaatcatgatgataatcatagcagcacttttcacagcatcagcagtcatctcactagttatgttcaaaaaagtaagtgaaattttatgtctaaatttttatagtgaacgtgatgtaaagttctcattttcctattttgctataatttggtgtaacctgaagccattttatcgttattgtatgagtttgctctctgaggattactttttacaattaaaagttatgcataagtacattttagaaaattgcatcacattttaaacttcagtaaaaagggaatattttaaaatcattttaactgaaggctttcatgagttaaagagtcagcctcatttttaaaatttggatttttaaatatactctaaatttcttttttttgatatgaaggatattagcctgttaataaatagaagtaaaattattatgtgatatgtacattttattcatatatatctcttaggtttttgttttgttttttaattttttattataaattcagagggaac

SEQ ID NO: 116169 - DNA, 1086 bp, Homo sapiens
tgactctagaattgttgggttttattaagctgttcttctcttaaggtaaatgtgctctgtcctatatatttatcctaattgaagtgaataggattttggtaatttcgttggctttctgttgtcttgcataactgaagtgggtcatcattggtgctgcagggcccagtatgagattgtgctgtttgtttcccccacagtgttgttttatactccacatttcaaatattgaaagaatatatgtctcctatacatctgcatggagaagggtctagtttagtccttatctttcacaaatagatttcttgttttctttcagattatttccaaatggtgtttttacaaaagctcctctttctattagaactatcagaaagaattgagtaatggttttgggccaagcagggagttgttataaatgtgtcaaataacagtaaatgaatgcatcacaggagactatggatcagggaatccaaaacttttcccttctgttaattggtatggctagaataacttaatatggaagtaattaatagatgatatatcatttgtattccttttgggacctgattttgaatgattatcacttccatgaaatttgttcatagactgtcatgttcacattaagtagtttttaatagtgaattttttgcattttgaaagaattttagaaaaaagttattttacctctttaaaaaacaagttttctgaagtgtttcaaatcttgtttatttactacagtatatattctgcagatactcatttttgtgggagcgctgaattgggtctatgatagagaacactgtgattaagtctcattagttggtgttttatggtaaatgctttgtgaagatatcctattatatataaagtgatagttttcttaggtgaaaagtgactcttacagttatccctctatatgcaggggattggtttcagaacccacacatccatataccaaatctatgcatactcaagtcttggagtcagccctgcagaacccatgtatacaaaaagccttctgtgtacttgggttttacatcccatgaatactgtattttctatgtgagtttggttggaaaaaaatca

SEQ ID NO: 116170 - DNA, 1144 bp, Homo sapiens
catggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattctt

SEQ ID NO: 116171 - DNA, 1059 bp, Homo sapiens
tgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatat

SEQ ID NO: 116172 - DNA, 1049 bp, Homo sapiens
atttaatatgggtgaagctcatgttccattacctgtaaaggtctaatgcaacagaaaaatggtcattttacattggttagaatttttaactaggtctttcatattattttgtttagcacatgacagacttatacacatattttaaaaaatcaaacatggaatttctatatacatcaaacctttaacaatgtctgtctctgaattgctattatagtgttcaaaattatacaaacaaacatccagtaaacagcattttattttatgacactctgtgttaatacaataaatatacaaaacttccaacccactgaaacatgcaacattagagggacacatggagggcatttctgtagaaccatgacagtcaccatgatggcagcgcagtattagttactgacaaaatatacaaacatctctagataaataatccaagtcccaaattacaaatcactgagtaatgactttccggtgttcaaactttagtttgaaataaaattgccataatttaatattacaaaatgataaatgacacggatgactgctgtgtgaagaccattttatgactatgatttcatgactgtgattttagtactaaatatagaacacttaacaaatgccaatcttttgctgagtgaaaatttaacaatttactgagagaaaagtaaatataagaatttaaagttcctttcatacttgatcatactataagcattgccatcatttcaatgcacatatatttttaaaaaacaattttctctctcaaactcatattaaataactggattttaaaacattttccccatccacacaaaaaaagatatgtgggttctaattattctttgctatttaataatgctacctttgaagatttctacataatataaacattccaattctgaagcaaagtatttcagcatttttcaaaagtctctaatatatcttttgtttgtagtgtacaggaaaaaatggacttgggatataagttaatggtgaatataggtgcacttgctgtattttgtggttaatgttttgaatgtatgcaaaatcca

SEQ ID NO: 116173 - DNA, 1047 bp, Homo sapiens
caatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtcatcttggggtacctctgc

SEQ ID NO: 116174 - DNA, 1968 bp, Homo sapiens
tggaatcgtagttcaggcctccagtctgtcttggaaccagtgctgttttataatgggacaagtgcatctatgtcacagtaagacttctgttttttacaggatagttttccagatagatggttatccactttttattatttttacccaagacattcattctaaattgtatcatgtatgtctctttcttctgaagtagggtgtctcttgtcttggtgagtaaggatcagtactgcagagtgtctccagagtccctgcacatgggaagtctgcaggttcacactgtggtctttgggaagagaatatcttaatggcaaattcagtggcgagggaactggatgtggtctgatacatgtgccctcctcaaagcacagtcttcagactgtctgacagtttgccttaggatattgtaaaagagaaaatatctccacctagcaacagttggtggcctacaaatagctgctaggggctgccagaatgacttctgactatcagcatggaagatgacttggggaaagattaaaaacgtagaaaacagagggaagcacacagatgagcattaaccacacacagagatgctgcttattactcagtcaccagttgttgtacacttgactgagacagatggcctgacttctaaacatctactggaaacagaaaaacacacccccaccctgagaggttgatctgcgatgctgccaagaggagtgggcgttttcctgggctgcagaacagttctgcatcctctgcccatagtgctggtaccttcgcagtggtgttttccgttctccaggctcacactgctaatatttaccaccctgcctctttcacaagtggtcgtggctcacctcattcccccacgtatcctttgtcttctctcacctgtcctttcccgtccttctcccgcgtgctgctcctctcctggccagtgcctggccagctctcacaggtcagccgcggcctgtcttggcagctgtccttgctgcagccaggccaagctggaaacaatttcagagatctgagcctagactcaggctggtgtctagatacctgaaagtgtattacatttaatcaactgactacttttttctgtgtgatttcctaacaaccaggtattttctgtagccaggaaggttttcagtgcaggcagttatgcaaaagaccagtcctgtggtttggtctgcacatgtgtttcagtagtaactgtgtagctggcgttctgttggccagaattgcaaactgaagcttttcctccaaccatttcaaaaacttgtcaagaactttctacaatggctttgtttaaaaatgtaatataatcacatcaccttatcttttcattcatccattcaaatcagtgaatatttactaagcacctgttacatgtcagaccttgttctaggcagttgggacacaaagaacaaactgcataaagttccctgtcctcatggagtttacattcaagctggcgggggtagacaataaataagataagtaaactatatagtatgttaaaaggtagtgtgcagtagggtagaggagccaggagaaggtgtagcccgggtgagagaggccggggtatgctggaatagtgagagggaatgttgaagatagttagggtaggatttattgaaaagaagagatttaattaaccacagccttaaaggagatagaggagttagccatgtgggtatcaggagaaaacattccaggcaaagggaacagctagaatgaaggcccacaggctttgccgatagagtaaattgggatttctgagaaaggagtcaaagatgatagcaaggtctctggcctgcacatgtctaagaattgaactcccatttgttgagatcaggtggacaaggtgaagaacaggttttgagtggggaatggaaatcaagagtcctggtttggacataattttcaagtgccttgctagaggccaagtagacagctggatatgcacatctggagttc

SEQ ID NO: 116175 - DNA, 1061 bp, Homo sapiens
ctctttccagtctggaagctttaacttcctccctacccctgttacttatgcagcatctcaaaaattctgaaattactcagaattttaaattggcacaaggcagagattcctgcatagtttgactgctgtctaggagccactgatctaagactaagtgctgaaatacaggaaagaactggtttcttttctccttccagcctagcatcacccctcagagaaaaaatcataaaaaagagggactgagctatccttctcatgattcagtgggcactttctcccctattggaggtctcatcatgcacatcaagccaatgtaaagggcagctgtggttcttgaatctgtggctgaggacattgccatactggcatctgaaagggctggcttgctttctcccgttggccaatctgtgatagcctctggtcagccccagcctcagcaaggacttgctgcagctgggagcatctgccttttctctccctatgccccctctccctcagccctggatctcttcaacactgaaacaaatggtgagaaaggaggctgttgccagagcaacaaaaggattctttagaaatacactcaggctgtgtttgttcttacaacttacattttggcaaaaatgtgactggatgagaaatgatcgtaagcatattcttttgctacacctaattttaagatataaataggccacaggcttgtgtagccttcactgtctataaaaaaacacagcataaataatcaaaatcttgatattctgagtttagaaactgggtgtgaaagaatctgctacttcaatggaaatcccaaactctgggctaacttaagcagtaatgaaatataatcattgcctgttatgtgaatccagatagcaggatctgccttcagggcaccattaggtggacacccggctgatactttctaaatactgtgcacatgtccttgacattcagcactcactcagtaatgagggttcaggcctcacctgaatgtgcctgtgaaacacggaccaatttgcctcacttttctgaaccatagttttctcacttgtaaaatgggcata

SEQ ID NO: 116176 - DNA, 1069 bp, Homo sapiens
agcgttagttagctttggtatggaagctgtgactggtggtcttcatagaagaaaggccaggaatacctctgcacaggtgtcccacacgccatgtgactcccatgtccccatggagaatgcctaggtccccgtagggcataaacagttattctgatgctcagaactctgagactggggggctcccacttgtgattttgatactaacctatagattgttatgagttcgtgtcagagtccggcacctgttgtcatgtgaaatgttgaggtcaggtctgggaggagccacagcctgcccttccccaaggtgttccccctgccgtaaggaagctacagccatgcggcagtgtcggggctagataggagctccagaggcgcccccagccacaggcttggtggggagtgggtctcagcctcacccacctactgcagcatcagcattggggtgggagctgagctagcaggtggagcaggcttgggaggagacagcgctgggggctgacggtgagggaggggccttctctctcctggcccctttagtgtcccctggctgctctggctttgtgtggctctggtgggagagggggtcctaggtcgtctttgctctcctttattcctcccctcacactagccatcgtggacaatcccctcttccctttgggaggcactgagagatgaggcaggcagcagggggtgagatgggaagggaggcagctccagatctggggaatctgaggggggtctgtctgtcagtgtctgtgtctgtcctccctgatttgctcagggaggaggtgggtggaaggccaggaccctgcctacgtgggcgctcagcgtagtgccagttcaggactgtccgtgcagcccctcggcaaatggcctgctctggcgacaccactccttgatgtctgaccctgtggcgtggcttggggttcagatgaagcctcatttcctcttgtgggattcagaggaagaaaatgtaatggaaccagttctagaacactagaaaatgggctttctctcctcctaagaagtcgttgggttttttccgtacattccaacaaacttgttcagc

SEQ ID NO: 116177 - DNA, 1046 bp, Homo sapiens
ccatgaggtccccatttgcctagcagacatttatgaacagtaccttggtggcttaaaaatgttcattttctttcccaagtgcctaactctcttcctgaaagtagtgttttcattgaaggcttggaccatgctggatcttcacagagaaatcctactcttgattctatagcagacaatggtgactttgctgagatagagccttcggtgttgcctcctgatggggaatgtgttgggtaagggggacatgaagaagtggctaagtatcagccatctaataccctgcagatcgtattggagctggacgtgaagaagcgctctctgcgtggttttggaccaaatggctgtgaaagtgtatgatccgcctcacagtgacaagcagcttgtcagtggtttccaaaacatctgtctcaaagtggcggttgaaattcctacaagggagtgtttccattcattgtccatgagaaatgagagagagtgggagtgagtgatgcacgatccagaggaaatgcgtgcactctccacttgggattacaatgcagatgaattccatattttggttagggaattttttcttttaaaaaaagaaaagacaagaaagaaaagcttgtcgctgtcctggttactgaaaagcagactaaaatggagttaaatgcaggctggaacgttcatttcagctggatttttttttctgttttggggtgtgtgtgtgtatacgtgtgtgtgtgtgtgtgtaagaagatggcctgggacttcctggcacacttttctgcctttggccccagtttcccaccaaggtggcctgaccttgctgatgagtcactttaaaactgctgcggtcagcaagctgtggctccgtcactgcatccgcacagatcagctacttgaagattcagacaactgctacatatacatcctattaacaaaaatcacaacagaggttttcccagctaaagttttactgtaaaaatggtagccctataagaaagccactattagttttcatttagagatttttttttatgtctacccctgtcccctactatgtc

SEQ ID NO: 116178 - DNA, 1669 bp, Homo sapiens
gctcataaacctgtttaaagtttggctaatagtactgccatgtgctgttcagatgcaaaatttcagatgcttgtcagctagatgacactggggttgatagtgaggtctggtttgtgctcatagagttctacaactgtagatattctcattggaggcaggcctgtgccggggaggggcatttatttctactcccaggcactgtctgcctgagtggaagcaggagcgattttcattttacctgttatttaaggagctgcatgtgaaaacccgagtgaagaggccctacacttctcatgtgtttcccagtaatggcttagtcccccctttgtgggttgtcaccctggtcactgccagactggcctgtttaatcctgctctggggaaaagccaatttcattctgccaaagccttcaggatccaggtggtgtgttcccttgaaatgcccctctctgaatacttaacctaataaaaccagccttctctgtcttttttttaaagttgtgaattcatcccatagaaatacagtaacactttatcaagtcagacaaacacaagaacagacattctgagttaattgtgtctgaattgtagagcaatctgatcctgctttctttcttttttttttttttttgaggtggaatctcactctgtcactcaggctggagtgcagtgacatgatcttggctcactgcagcctccgcctccccagttcaagtagttcttctgcctcagcctcccaagtagctgggattacaggcatctgccaccatgcccagctaatttttgtatttttagcagagactgggtttcgccatgttggtgatcttgctttctgttatgtagtcagtcgcattatatgaacttggtggaaggtttgttttgagcaaagagcacagttgcagtctggggtgagccttcatgtcaggtggtccttggcagaggttccgtctctgtggacacagacctggattgggaccctggctgtggtaccagcaggctctgtgacctagggcacttttcattaccatgtggaattctcatctctactcatggataatcctttcttcccaaagtggtgggaagattgaccaacaaaaagatgggaatgcgtgtgatacgtagtaaacagcaggtgttcctctgcctgttccctggcactgggtatcatggaaagagcacagcatgtggagtctgaggggttgctctgccaggctctttctgtgcctctttgggggaatctcttaccacctgtgcctcactggcaaagtggcaagggtaatacctgctcagttttgcctgtctattccatgagaattgtgagaaggctttgaaaagtgtgaatttagggtgggtgattagcataaggggcctctactaggcatgctttttaataatccagactctctgggattaaatccctgctctaaccacttataattaggtgaatgtcctcgagcaaatgactgtcaccctgtctcgttctcacctatctcacctgatttctctgagagtaaatgatgtactgtttgaagactggggcatacagaactagcacctaatgaatctcagtaaacatgctcgtaaattcactaggacataagaagggaagccgagaatcagacatgaaaaaatatccacagttttaaaacccctcatgtttgaaccgtgtc

SEQ ID NO: 116179 - DNA, 1069 bp, Homo sapiens
aatcctggctgccacctgacagccacttgacctttctgaacttcatggaaaaaggggataataaaacctgccacacattatggttggcaggattaaatgagatatgtaacaatatatattagtccctccccttttcttagcacattgaaacagaatggcttgaaaaaggtaagttattttgaaaggggctgatgaaacaagaacacaggattcactatgaataaggagagtaacttacattaggtaccatttattgagtcaggcactgttttaagtgctctctttgcagttacttattccttcctcacactaacagtgtcagggactgttattttatctccactttgcagatgagaaaattgaggctagagaggttaagtaacttttatcaaccctgcctggctggcctcagagctcttaaacatcagcatggagcttttgaagaggataacagcagtaatgatatcttagattatttacagagcttcatcctttgaagaacacttctatgtacattgttaactttgtttctcattaaaaaaaataggagatggctagacattagattagaaaactaaggtacccagatggaggtgttatttgcccaaggttactaaatcaatatgtggccttgttggtacaagaactttttccacttgactcttgtgagtgtttatagaatgaaagatagaagagttcagaaatttttttaaagaaatgtttgctgttaaattttttaagatataagctgggtgctgtgtcatgcacctgtattcgtaatcactcgggaggctgaggcaggaagatcacttgatcccaggagttgcaggcagcagtgagctatgattgcaccactgcactccagcctaggccacaaagccagatgctgtctcttaaacaaattaaaaaacaatatggaacagacacaggaagttagttttgttgcttaaggtctctgtcaggctgttggccagctagaattagaaaagatagatccagcttctgagtgactcaagtgaaagaactggaaaagtaccaatgcatctattttcttggccacttggaacca

SEQ ID NO: 116180 - DNA, 1601 bp, Homo sapiens
ttactagtgagctgtgtttctttgttggatacctcatggcttcgcaagcctaggagtcagatttgacattcccaccttggtttcctgttccacattgatgttcaaatgtgcttggcttattatcatagtaattgcaaaaaccagtttcacaaagagatgatgtcatcaaaaggaatgtaatgcattttgtgaattaacttgaactagtagtttgtataattcccacacttcaccatgctttccttaaaaaactgtagtatcccttcatgctcctgtgagtttgctgtggctctccagatcatcttgacacatggggtgggaacccaggccttaacctatatttgctatctatgactaagtcagggttgccttaaggggtctttgtattaactgcattattcaaaagttggattccattgttatttagtttgtggttgtcaagttttggtgagcaacaaaaacatttctggctctgcatcctggaaatggatttataatgtttgggaagaggggtgtggacccaggtgtctgtattttctaacaagcttgcccagtgataccaatgcatatgaagatactaattcagtgcatatgatgcactgaattccatcacaaatagcttgagttcagggaccatgttgttcttcacttaaattctttcttattcctgtaacataccatcatgcacatttggtaagtgttcattgaatactactgacttatttgttacttcatttctctttcctcccaacttttcttttgttctgtatcttaaaaagaaaaacaaagaaggaagaattgaagaattgggtcttagagtttcctgactttccaagctgcttgttcacagtcttccataatctgctacgtcagttcaccactctcccacacaaactcttacgtcatgttgaatcattctactctgagacacactttggtatatttgtcttcattttttcttgcttctgtcccacacaaagagacctttaagtttcctaagtggaaaaaacactaggtttgggaaaaaattagaaaaacttgtgttagtttcctaagtggaaaaaactctggggttgggagaaaattgaaaaaaactggaagagacttagattatcttttcatacaatgcccccattttagagctccctgtgaggaaacacagggaagagatgtgatgtcccagaggccacacaggaagtgcaaagtctagctgggattagactgctgctctcttggcgcctcgctcgtgggctgtttccactgcaccccagccccaccagaccttactctcctagggtggtgctgatcatcagtgattttcctgagtcccacaggtgactgtgatatggaaacaatggctgagaaccaggtttagcaatttgctttgcttacaaaattattgtttggtgtgttaaatattactttgcagtttagtcaatagtaattgaatttctttttatgaggttaaatttttgtttcatatgaatgtatagactgtgcaacatgggcaacctagatcacttaatttttgttgtttaatgggaagaaggcaaaaatttgggagcagaagaaactgtcaatattattatcaaaggaagatt

SEQ ID NO: 116181 - DNA, 1035 bp, Homo sapiens
cagcccaccctagagacagtgcgtgagaagctggaatgatttctttcccttctagtgctgttgaattcactggtggtataaatttgctacacagacatggtttatagtcttattagatttactcgttattagtttgttcttaaagaataaaaacagttccttttgggggaggctgcctaacttacagggacccttcaccatcaatattaattacatacaaacatgagaataattcacattgctagtgagaacttcccctggacagaggaattcagtgagtgggccatgtctgtacattcttggtactgtctgctctgggacctgccttctcaactgtgaacatggctgaatcatctcagcttagtaaatctcaaggcacaccaaatcatcccttcgagaaaagatgtttgttctgttactttatcctcacagagaagtcaagggtccaaatatttatcatcctcagtgacacctcatttctcctttcatcactaggccaaatggtaggaattgttctactttattgtgttttcacagtttttcctctgaggcttccctgcctgttgttacttgatcttttggacttgagtacccccagggcctgcagggtcactctgatgtggggttggagcaaatggcacacatgctggtcaagtgttgggcagatttaaatccgattttcttttactttctagtgtttttggagtttcagttaacttttttttaaacagctaatttgagttcagacacaggccaaaataaaacattgtcctggtcatctgctatttatgttccattgtggaaagtgttttctcagccagaacctttgactttagttaccaacttccttcatactattttgttagtagtatctctctgaggacgttaagtatattgtctgcttgtcatttatttctctgaaagctttatttatttattttgagacggagtttcgctcttgttgcccaggctgcagtgcaatggcatgatcttggctcaccgcagcctccacctcccgggttcaagtgattctcc

SEQ ID NO: 116182 - DNA, 1015 bp, Homo sapiens
tagctaaccccaaattagggtatttgaggtctttccagtttgaagctggcataaataatgctgcaaacatctgtgtgtttttttaaaaatttttttaactgaaaaaaattttttagtagaatagggtcttgcttgtttcccaagctggtcttgaactcttgggctcaagccatcctctcatctcagcctctcaaagtgctgggaatataggcatgggccaccatgcccggccagcaaacatctttaagtagattgcttttccccctctcttggggtccattcctgcggatatatttctccaaagagaagtttctggtaaagggtatggactcattcgtagctctcattccatgttgctagttcccatttgtttcaagagccctctgaggacatataatgagaaagaacaaaacaactggaaggaaaaaagaatcgacttggaggtttaaaccctttttactgatgggggataacagttttcagatatctgaattgagactttgcttgctgtaggctaatcaataaatgagaaaattcagtgtagtggttaagagcacaggttgtgacatccaagtcagttacttaaccctgcggagcctcagtttccatcttgctaaaatgcatataatacctacctcggctaggtatggtggctcatgcctgtaatcccagcactttgggaggccgaggcaggtggatcacgaggtcagcagatcgagaccatcctggccaacatggtgaaaccccgtttcagctaaaaaaaatacaaaaattagctgggtgtggtggcacgcgcctgtagtcccagctattcaggaggctgaggcaggagaatggcttgaacccaggaggcgaaggttgcagtgagctgagatcgcaccactgcactctagcctggtgacagagcaagactccgtctcaaacaaaacaaaacaaaacaaaacaaaacaaaaccctacctcattgtgggtggtagtaaggtttaaataagataattgctatgaagtgattaatt

SEQ ID NO: 116183 - DNA, 1007 bp, Homo sapiens
tttaatggctattttcctatttttaatttttaaagggaaatttatgcaaagatcaggatgatttttatattttcattaaaattttcaactagattaaaaaaccctctttaatcggatgggagaagtcttcacaaagtcagtttgaatagtaagtaggagatagtaggaaaaatgctccattgtcagccaacagctaaccaaattaatgtgtaatggaatgtcataatccttttctataaagtaatattttgtttctctcttcctattctcttttgtcttttgggagaagaaacaaataaataaaaatagttgtttcgttgtttcggagagaaatacactgtctagaaaggactgtcttaaaatgcactgtggctttttaactcatgaagctcctaccatgtgtgcatgcgttctcagaactcgtctgtatcacatgtgggaaaatggaattagaaagacttctccctttgtggcctccgtatattctgagttttaacgatagattttctgtaaaaaaagtttgtgctcctacatgatctgcgatacacacagcagctttcagaattcttaaaaatgtaaattaggtggcaaattagaccactttcactcccttgcttaaaatcttcagtcttctcctgtcacaggtaggataaaatccacattcctcccagactccctaggctggtgtcatctggtcctgcctgcttcaccatcccccttagtaattgcctctgggctccttctgccccagccctgaagcctttctgatcctcagccctcaggcttctccggagggacttcccagtctttttccccaggattctggcgggacttcctggggccaggggctgagctcagcatcctctccttaagctctggaatgtgaattactgagcagggagcccagaaacctcataggccagggtcagaagatgacactgagccctgctggagtgcagaagctgacaatggacagagttcaaagcccaggtggagttctcctttga

SEQ ID NO: 116184 - DNA, 1117 bp, Homo sapiens
caggcctgacctgctaacagttctgcactgcagtttgcaccaacccagcaatgcagtaatttatttcactgagggaattgtggttttacttgccatgtattggtgtcattgaaaccacgttttaagaggaaagtagcaattaatgtttagaaatgggaaatagctttacaaatttgtggtggaagagacccaataaaaatgactatcaggagttttccaaaggtgaacccaacagtttctaaatggtgttttctgtctggtagcttgacagcttttgatttgtaagtgttaaccaaagcatgactgccacaaacagagcagggtgtgtgagagagagtattactgcaaggaagaaagtaactccaccgagatgcaggcaggcatctgtgctgacttaggaatgggtggagaggtctagagtgtgtttgctcagattacaccctgtctgtgtcattgctgctgctgttctccctctgccagacgacagcactgaaagagtggctgttactctctaacttggggtttgcctgcatccatgcataaacatttcagctcattatcttaagaaacggaggaccagagcatttgggaaccactgaatactgaatcctttaaggtttgttttctgtttgtttttattatgattgatgagattggggattctaaattaaaagtgactcctaaggattcagttaaaggatggtgtcataatgagaatgatggttttacctgggaggcagaggttgcagtgagccgagatcgagccactacactccagcctgggtgacagagcaagactccatctccaaaaaaaaaaaaaaaggagtttgagaatgatgattttcttttagtaggagaactctttttaaaaatgagatatttcactggagccacggcatatgtgcatttaactcataaaaattaaactgtacacacatggtccgaaaatagagagaaatcacattgagaatagtttggagctgcttggcagtcggctccattagagcgggcgccccagcacagggtttctcagcctcggtgctcatagcgttctgcgctgatcatgtggcattgtgggtgctctgttgtcctgtgcttcctatagtggatgcctagc

SEQ ID NO: 116185 - DNA, 1033 bp, Homo sapiens
ctgcttttatagattggccttgatccaaagacactgtccaacatgggccccttgtgtccagggttgacatttgggagaaatcagagcaaaggcaactagcagacacagcagcttgtctcctgatctgggactccagtgacattagcatactgggctctgcatcgcagtttcctttattgctgaaatgcctgggaaccaggtattagtacaaagattaatacatggcacatcctccctcagcctttgtggatttttgtttttcaggtgaagcctttatctttagttgtagttccttaaagaggaagcaaagtctctgaaacagcctttcaagtttcattgcaaagctgcatgcatatattgacatctctgggaagagtttgctctattccatttccagagcacaatcaatgcataatttaggaaccaccatttacttggactaggtagcttgtcagctgtgattgggtgaccagtttgtcttacctactgtaggggttttgttgttgatttcaggaaaacgtacaggtacttgtttccaggaaaagttgattttaaattgaatatcttagactttttcccttacaaaaagataggaggtattgttttatcattatcatgtcccctttcagttaagaaatgactgtttcctgttccttagcatcttcttaacactatgggcctttttaagaaggaagtcctttggataagtagttaataggagtaatatttccaaataggcaaaagactgaaaaaagtcctcatccatcttttttaatgttaaagagtaaatattctgcgttctatgattccttttcccccttttccctataaatcattcttatattgagcaatgtctcaggcttctgaaatcctgttttctcaggtttcttcttcaaatctggggaagacttggttggctcccttcagacctcctccattgatgcttatctttcctgactttatttcctaatggccaagcttcagggctcacctcgcctgcatttcatctacttacttgacatgactgcagaga

SEQ ID NO: 116186 - DNA, 1072 bp, Homo sapiens
ttgagaggtgtttctgttgtattgataagaagtactgaaataaacctgattgataagaaatactgaattaaataagtgctgtactggcatgtttgattttttttttgttttttaatttcactgttcagttgaaccttaaccagcagtgagatcttaaatatttctttagcaacaagctccccacatgcccggaaaattaagagggactctttttcctctcctgattctattgttcagcattttctttctttccacactgtgctgtgttgtcggggcacctggagttcaagcttcctttctcctggggcaggctgcaattggactgaatttcacatgttttctagttttaaggcatttagccagttgtttaaggaaggctgtaattgcattcacaggagcctcattcaatcttcagataagtggtgcatggcacacacttattaagggcaaaataacttcttaaaaaattaactttctcttgctcatagagaacacattttctgaattaaaaataacagactggatagtctgggaattacaaacttaccagtaagcagtgtttttgtatttgtaaatgactaacacttgtatattaaatagatacgtaagaaaaacatggctcacaactttaaaaacaatctaaaatcacatttgttttttttttaaaatggccaactgtccgttcttagaagatgattctacattctagagaggtatgtctaaacagatactctttcatttgctccttcttacagtgggcctttcagggttcttctgcagtgaaaactcataattaccgacttaattactgactctgcatggattcatgctgtaattcgtagcatagtgtgccggcttaaactggtgactgtaagtcatttttgatctgaatccttttggtaagtgggtgtgcttaggttgtcttgactatttatgcattttgtttgtttgtttgtttgtttgtttttcccagcttgtgcttaagtgtattgtaaagaaagggcagcatgagagggaactaagctgatgtgtgaaatgtttacactatgttaccaagccaaaaagagctgta

SEQ ID NO: 116187 - DNA, 1079 bp, Homo sapiens
ctagttttgtgtatgtctacaaaatattgaatacggttaaaaaggtgtgttatctgcacattttcctaaactttaatcagctagatcaggagaaacacccaactttgattttgacagttggcaggtccagaaaggagaacctcagtgtatttggatttttcttctgggtttgttctgactttgatttaataacatgttataatgattaagtggttttatggagactattttacaaatatttttgtcaaactttatttaagacttccaaggtatttacttgggggtgaactttggaagttcagtcaaactaactttcacaactcttcaccttaaaaaaaaataagcaaggaaacctgcacccagttatagtatttgaaagaagaatatttcagctggttaataatgaacaatgtttaacgctgaggtgacatcagcagtagaaacaattctttccttgtgccttaagcacagagcatggttcaactagacgtaaccaggttgtctggcctttgactgcacaagggtaataggtggatgatagtagcccaggttgatgtatggaaactagggtgttctgacagttttaaagctcttcctgtttgtgggactaagaacatttcccttgtgggctgaatctctctggtcctaaaagcacacagattcccaggaacccttgcattgctaatgggcagctgcacatgtgtgtggttcccaggtcttcatctccaactgctttgcacacccttcctctgaaacatttccttccctgccttagagagggtggccaggctctcctactctctgtactaggataactaactcttgttttcatgtccaccagggatgaggtttatctaccttcttttttgaggttaccaaatggccctcaagggctactggtgttaatttgcatttcattcatttgtggcataaatgagagtgtgccaagcaggccccagtgaatgcttgttgaattgcaggcacaaccgttactcctcttactgctgtggatttagggtaagtccagtggggatgattaatcattgttagtctgtgtaaccagcaataacacctcacct

SEQ ID NO: 116188 - DNA, 1296 bp, Homo sapiens
cgccgggttccagcgcgcctggcaccgctccctgggggccgccccgtggtcgcccctgctgtccctggtccgtggcgtgtgggtcactctggccacagacgtcagctgcttctcaaatctggactgcatttttgtgggcagctcagtgatttggggtgcgggctggaagaggtgggcgtggagtggggaagaccgcatctgggatgggcggcttgagcccacgggctgggcaaaggactggggagactctgcgtgtgtttctggatgtttttaggcacacagtttttttttttcttttcccttccattcagcggcccagtgttcttcgaacttagaaaagcaaaggattttcttcaatcccgttcgacttttctgttatttcaggatggtcatgagttccatgaaagtccatgtgcttgtttcaatgggagcaacaccagagtaaagacaaagtcctatccccacccccgtcctcgcctccacccgggccatttcctgtatgtcccattttctctgttgtgattgtgcgagtgtgtttgtgcatgtaggttaccatcggtgggtgacctacgtggaaaggagaactctttgaaattgcaacgcggccgctatggaaagtgtgtgctggagccgagggaggaaagattccggcgagccagagctgttagaggctcaccccagagaggtaaaccggagtaactgagcttgaagggacatttataacctgcacattgcttttgccttaccccttggccagagagctccactcctgctaggtttaagagaggatcagatactgacttctttgatgttgacttttgctggtattcctgattctttcctactggttctcttttagaaactactcctttttaaatttaagagatagagaacacatgttcgcgggaagaggaaatgttttttaagataggaaagagaaatagaatccaagagtctcatttctttttgctgtcatactgtgataagcttattgatctgttagaaatctgattctgattttgaagtaatatcagataaaacactatcttataatagtatttttctctaagtggtcacatggagagcagactgtggcttcttgtggtttgcaaagggtgcagcaaacattttatatcaggaaaaagacattgtgtgttgtaggagagggggatggggaggggcagtcatttgtcttcagagcagcctaattaggaagaataattacactgcaaatgaacattgttgaatataaattgagtcatgatatgtgaaccagtcatttgtctataggaagga

SEQ ID NO: 116189 - DNA, 1008 bp, Homo sapiens
gcctcattttttaaaacaaatgaataaatggacaaatgagtaaatgagaaagtctcacaccatgaaagatgctagtccaatgagctgaatacagaggtaatataaatgtcttccagctgttgcttttctgttctcaagctgcccctcctggggtaggagcataatctacatcactgggcagtcacaggacactctatagcaaggttgtagcgtcctctccagtggggggagaaaaggaactgtgcctaccaaaggtactctcttgtcagcaatttccatttctatactttatgggacactagaaactaaaagcaacaaataatctgatataagtccttgtatagtcatccttcaattcagtagcaatattttctggtcactactaacctgtattgtattaaaatgagactattggaaggaaatggtgctaaaactaataacatctcttaccaacctttacccaactcctgggttggcaaacagctgaccaaactgccatcacctcccacttggaagtgtatggccgacagcatgaaatagctgagcccagatgttccttctgcatcctccgaatcccagggctgggtgtaggtagccgttggaggccatcgctacagggcacctatctgttatcgctgctgtcctcccaacagctgtctccagttctagttccttggttttcaggcacagtgggggatgttctgcacccagtggacttcaaaagagttttgaagacttaattttttgtaaaacaagtacttgagattttggtttatccataatagaatgtatttcattagattctctgattctatataagaatgtgaaaagattgatatattgttgttagaaataatgttatttctttccaattttttttttttttttttttgagatggagtctcgctctgtcacccaggctggagtgcagtggtgtgatctcggctcactgcagcctctaactcccaggttcaagctattctcctgcctcagcctcccaagtagctg

SEQ ID NO: 116190 - DNA, 1065 bp, Homo sapiens
tgggtggatcatctgaggtcaggagttcgagaccaacctggctgacatggtgaaactctgtctctactaaaattacaaaaaaattagctgggcgtgctggtggatgcctgtaatcccagctactcaggaggctgaggcaggagaatagcttgaacccgggaggcagaggttgcagtgagctgagatcacgctattgcactctagcctgggtgacaagagcaaaactccgtctcagataaataaataaataaaacaaaacaaagttcactatgacccttattccctgtccccctccacagaggtgaccactgctaacagttttgactttatagaccactttagatgtgcttatgtatacaatatggatttatggagcagtggtgtgtacaatacttttttttttttacatagataatatcatataaaatgttgtggggttttttttttgccacatacttttttctgtcaatgatctgtcttggagatctttccagatccgtaagtataaatcagtggttttcaaccaggggctagtgagccccccaggggagatttggcaatttttgcaggcatttttggtggtcacgacctgagtggggaatgctattggcatctagtaggtagaagtcagggatgtactaaacatcccacaatgcacagaacagccctatgacaaagagttttccacctgaaatgtcaataatgctgaggctgagaaaccctgataaaggtctactttattcttttaactgctgcatggtattctgtagtttatttagccagtcatgtagcagtgtatatttacatgatttttttttcttttttgagttggagtcttgctctgttgcccaggctggagtgcagtggtgcgatttcgactcactgcaacctctacctcccgggttcaagcgattctcctgcctcagcctcccgagtaggtgggactataggcgtccaccaccacacccagctaatttctgtatttttagtagagacttttaaaaacatgtttatttgtagatatcagtgaatgtttcttccatttacttttgacccaactgcaat

SEQ ID NO: 116191 - DNA, 1047 bp, Homo sapiens
caatgtaaacaaacgatgactgcttgaagatgcaccagccgtgattgtggagacctccaaattcatgacagagttgttaactggcaggtttgttatttcctataagtacaaggaagggaagtattaaaataattcatgcccattagagagaggaaattaacattcccttaaaaattgttttccagtgaaggaagcccatcccccagaattgagctgctgcataatattgacccgaacttcgtggactcttcaccgtgtgagtaccagtgcattgctactagattaaatctaattggcccaccaagatggtttgattacctagtgtgtctctagcctagctttctcttttttcctgagttgctataaaggtaaacagttcttcgggacatatctcccgctcatctcagagggcagtgtgctgtgaaagcaacaccagcttatgaaataagaaaggtgaattctattcttgctctgccgcttactagcctttaagccattgaactctccctgccccagccttccccatttacaaaagaagaactcatggcatctctgaggctccttctcactgtagatgtcatgttgctgccctgttcttacctgagagctccagagccaccttccagaaaactcacagtcagataagccacagttgggttccaggtagtgtgagcaaccacattatctgattgggctggtcaggtactgcccaacacctgctgggtgtcacaagtgtgactttcctagcagtcctggaagtgattccgcttgattctgcctcctgcctaaattaacctgtaaagagccttaccatttccttcagggcaggcatgcatgtagtgcttccagatcacaacggactgtaataggcctgtataaataccatgcgagtggccctaatgccctcagcatagtgagtttgggcatagaaagccttagcaattagaccctttgcccagctttcatcataatgctcatcttgcaaacagtgcccttatattcccttattcacatgggggctcccatccgctcctttctggacatact

SEQ ID NO: 116192 - DNA, 1070 bp, Homo sapiens
attctttgaaatacccaggagactgaactagaacttatggaccgcaccctatttctcatatagttaaccaactaatgtcctaactcagtggattctgccccattgctgataagtggcaaccatcggccaggtgccatctgtgggggtacaaggacaggcgaagctgaactgcccttctgctgaggccacatctgcagttggcgctatgccaggagagccttggagaagttgcacatgtgtccattgacagtgctttctctttggagtgctcttaaaaagaataactgttgatagaatcgcttattgctaatggcaaaacatcacagagaactaattgcaaaaacagtcacacttactacatccgtggcctcccctaatgatatgtggaaacaccttccctttcctacagtagcaaaagtggccaaattctctgtacaacccggagaattttcctatctgagtcataactgaagagctgctcctagaatcagattccagatccagccacccttgtccccatcatctccactcttatttccaccaccatcttcatccaatactttccgttgagcactaacaaatatgtgcaactgaaggacactacataatacctcagagaagtgtatctatttaaaacagagacaacaggcttcttctaaagtattgagccagcatcacttacagcaatccagacaacagagtgaaataatcgttctgtctcagcctttcttgatatcacgggaagagtgtaggtatttctttccagtgtatttttgtatcacatgaatagcaccttcttctaagtttcgatacattggttatgagtgattgctactctgtgcagtatcatgaacatggaggaatttcttctttctactgatggtgaccttttgttgttttgaatatacgggtctgctcagcttcaatatgaaatggaatgtgtatttcaacaactggcctgagtgaatgtttgggccttgagtttttgtcaagaagtgatgtggggaggtttgaagaaagattcttgtaagtctgtgatgtcaaatgatgagattgtctgtcaccgaccc

SEQ ID NO: 116193 - DNA, 1048 bp, Homo sapiens
attatcaccatcctaacagatgtgaagtgttacctcattgtggttttaatttgcatcttaataatgactgatgatgttgactgtctttacatgtgtttattgccttttgtgtatcctctttggagaaattgctattcagattctttgcccattttgtagttgagttatcattgagttgtaagggttctttatatattctggagatgagtcccttatcatacatgtgattcacaaatactttcaatgcattctgtaggttgtcttgatattatttttattaatgcataaatctgaactgtcttatccttctatatttaatgcttcaatatcctcttaactggtttgcacaaactttctttccagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacaggtaagtctgtcaataggaaaatcatctcttggcaaagcctaggacatggtatttgataagtggaatgaagacaaattggagcggttagcattgccttattaaaataaatgcaaactgcaatagtggagacatggtaattgtggatggaaagatatatctaaggaaaaagaatgatgggcttcccccgttccctcagatatcaaaatattctgggactgtggcttgaaaacacatgttcactaactgagtaagtatgagtggacatcactcatatacagggctgctgggtagtgaatccctagagtggcttgttcccagctctctctacaacccagacatcctctatggtcacaactcccaccaactagaagggtctctgtatcactgcaaagagacagattgtgacattatgaagacaaataatggagccatttaaatctatgaaagtgtctccaagtttagatttttttggtatta

SEQ ID NO: 116194 - DNA, 1039 bp, Homo sapiens
ctgacctcatgatccgcacacctctgccttccaaagtgctgggattacaggcttgagccactacgcccagcctcagtgtttaaaatttctatgaatatttttatacttttcctacatatttttgatctataaacaatatatagttgtacttcaaatgttttaaaattttatagaagtaacatatatacctcttttttcttgagatggggtctccctgtgtttcccaggctggtctcaaactcctcagttcaagggatcctccctcctcagcgcccccaacagtgctgatattacaggcatgagccaccatgccctgcctacatgcttttttctgtttgtggttgttctctttttttttttttttttggtcacttaacatcatgtttctgagaattaatcatgttgaaagatggtaaatttagtttttcacagacgtcatattagttcattcattttttctgtatttttttattgtagggactatcctatatacatttattgattactatatgatggagattgaggttgtttccagatttttactattatagataatattattattggtggaggtctattccaatggggcttttcctgtagctgcatgttgttggaaactcctcatagactaactctgtggttttgctttactcacaggactattagttaggtctgtgggaaggaactacaagacagttgctaaaattatgaaagacctaataatgtatcttttactgtagatattggcatattccacagatctgtactattattcttgagtgtgatagcttagaaatgagtatgattgaacacatgtttagagagggtgtcaaattgagaaccaggaagatccacctactctaaaaattaccctaaagtaaattggttgtagaaattagatcccaaagattattgattttttccataggtgaattttgaagcctccgtgaatatatccatattaaaaggagatgaaagaagccaaaataaagaattatggtatgacgggataactgaattaagcatcacttctattaaa

SEQ ID NO: 116195 - DNA, 1370 bp, Homo sapiens
aggggagaacctaacaggctgggggcgagccccacatagttcagcacaccgttccccgcggcaacacgctacttctgaacgcaggagcgactctccgtccgggctccctccaggagaatggaggcaaatgtacattcgagggtctcaatacctggaattcgaaacgtctcagttcctccgccttagttcctcttttcccgggttcggaggccacctgtgcagcagggcacacctgccactctcatcgccctcggagccggcaaccagccgacagccggctccagccccggggaactggaggctgcgcggaaggaaggagagtcgggagcgcggccgctcgcgggctggctcaggggacgccgagaggaggcgccggcgcgcgcgggcggggtgcgcgcgccgccgccgccgcgtcaccagcgtgcggcacgtgcccatgtttacgtccctcgtggagccgccgacgtcagcagtcgaatggcaacattgtggcgatgctgaggcgcagagtttaggagacgggttcatcagtcaggccggctccgggctttctgcagcagcaccaggggcgggggcggggatcttgacctgggcgagcgaccgggacgcatacagcgccggcctgaccccgcgggacccgcgcctcaccaccggagcgccgcagacgcagctccacggcctcgcgcggggggcggcgggcggccgcgaggcgctgcggcagcgcggagcttgtaaacagatccggccgcaggtgaccatgtgaactacctgctcccgggacgcttattgtccttctctcgatccgcgccacaaaggagctcggcggtcggggcgcggagggacaggcgaacgagccgggagagccggccggcgcactaagatggctgaaggcgcccggcgagggtgagcggggggcgcggcgcagccagcggggagtcctcgggcgggccgggccggcggcccttccccgcggcgagaagccggagccaccatgtcgttcgcgctggaggagacgctcgagtcggactgggtggctgtgcggccccatgtgttcgacgagcgcgagaaacacaaattcgtctttattgtggcctggaacgagattgagggcaagtttgccataacctgccacaaccggacggcccagaggcagaggagcggctcccgggagcaagcgggggcgcgagggggcgccgaggccggcggagctgcgtccgacgggagccgcgggcccggcagcccggcgggcaggggtcggcccgaggccactgcctctgcaactctggttaggagccccgggccccggcggagctcggcctgggcggagggcggctctcctcggagcactcgcagccttctgggggacccgc

SEQ ID NO: 116196 - DNA, 1068 bp, Homo sapiens
tccctaatggatactactacacgtagtttctcaaagcaagttactgtttttactattaatgcaattgagattggtggagaaatgcacccccgccctccgcgccttcttttttttttttttttttggaagcagttttgctccgtctcccaggctggagtacagtggcaccatctgggctcactgcagcctccccctcccgggttcaagcgattctcctgcctcagactcctgagtagctgggactacaggtgcgcgccaccacgcccggctaacacgttagcccggctactttttgtgtttttagtagagacggggtttcaccatcttggccagtatggtctcgatctcctgacctcgtgatccgcccgcctcggcctcccaaagtgctgggattacaggcgtgagccactgtgcccggcctgaaatgccccttttaatggtgtttatattcctaagattgtgttgttatctgcttatgtatatataatagttgaaccttgttgttagattagggagctagagcctcatgtttttttcgtagaatattagatatttttctttattagatttgagtatttaagaaatgtttgtttctcacttataccatagtactctcttacaacttcccgaatccagattttcactgcttcctgttggtttactgtatgctaaatgtcacccactataacatgatcctagagttccagggatctgtttttatttcccttttttatcacctcacttcgggagtctaccttaaattattttgaaggaagtgacaaatcttaagtgaccacatatattctcagaagtgtttggttaatattgacctgtatttctcttaaactgcaagaaccgttagtgcttctttctcttattagatttacagatatattttttaaaatacatattcttaaaaatcccttaatgaatgggcctgtctgattgtaactttttggatactcagaaaaagcgactgtcaggccggtcgcggtggctcatgcctgtaatcccaacactttgggaggccgaggcgggcggatcacgaggtcaggagatcgagaccat

SEQ ID NO: 116197 - DNA, 1034 bp, Homo sapiens
agcctgggcaacatggtgagaccccgtctctacaaaaaaaaaaaaatatatacaataactagccaggtgtggtggtgtgtgcctgtagtcccagctacttgggaggctaatgcaggagaatcacttcagcccaggaggtggaggttgcagcaagctgagatcgcaccattgcactccagcctgggtgacaggagtgaaaccctgtctcaaaaacaaaaaaaaaaggaaaataaaaaatgggaagtgttaaggctaagctcaatactttgagcctcaaaagaaatattcaggccatggtcttgagtagtgagacaccagaagtatggagatagtgatgaaaagcagtcaatgcttttcattccctcttgcttctgtgttttagggttccgaggtcctggcatgatagggagagttcaaagcaagtatttataggttattagaattgattttcttagttgtgaaactgtcttgttccacagctcttggataagcacaagaatacagagagcatggtggagcttctggacttgtatcagatggaggatgaagcctacagcagccttgcagaagctacaaccgaactctatcagtatttactacagccattccgagacatgagagaacttgccatgctacgaagacagcagatcaaggtatttttttattaatcctaactagtagcctgcctgtttcatagttctcagcctgaaaggccatgcgttatccacaagaggaactttaaaaaaaaaaaaaaaaagaaggtacctggtcctatttctgcaaagtttcttgtttggtagaatagggttgtagcctgagtatccattctaaagcacctcaaaaggcaattctgctgagtagccagggttgaggatagcccagaaagtaatgtgttcaagttagcacaaagttgtaaatacattgggaggattcctattttctccctttcctgcactttccttcctcctctagtcatgtctcctctttaatgttttggagactgtgtactcttagacttcattaccagaaatttt

SEQ ID NO: 116198 - DNA, 2014 bp, Homo sapiens
caagactctgtctcaaaaataaaattaaattttttcccccacaacatgggtgaaaaagcattttttgaggcaagcatttaagggtttgattttatagctgaccttaaatgttatgtgtaattcatatataaatgttgctgaactagaacattaaaattgtctttttacctaataggttaagttggaatatcattatgtaagattgagtatttgagaaaattagcaattactttgagaaccttatgcgtggggacaggggtgagtatatttgaaaaggtatgagaaagtaaggttgtctgtgtgtcttattttctctttactaacgtatcagggtggagagtaggacagtcacacgacttagacatactcctttatcaatacttttggaaaatagctgtgctgtcagctttttgagggggggatttgttttggtcagtcagttttatcataaatttggcatttgggttaaaacagcaacatggaacaaataatttttagatgttggaaattcctggttttttttgttttgttttgttttgtttttttgagacagcgtctttgtcacctgggctggagtacagtggcatgatctcagctcactgcagtctcgatgtcctgggttcaagcagtcttcccacctcagccccacaagtagctgggactatgggcgcatgccaccacgcccagctgttttttgtcgtagtttttgtgcggaggtctccatctgttgcccaggctggtccagaactcttgaactccagcaatctgcccaccttgattgcccaaagtgctgggattataggcatgagccactgcccagcctggaaattcctgtttctttaaatgaatcatggatatttgtctgctaagaacttgactagaaggccaggaataaactggacgacctggatacccacctactttagactgctgcattgtttagcagacataatctctatagcacagcactgactatccagaatctgtacacattcttttacataattatatcatgatttgtattgggtattaatattagcaaattggttgaccctacttgtcagcctatattgtccactagcatcacttaactgctacatttttcctgggaagtagaatgtaggtgaagaggaacagaaaacatattttgaaaatttgtgtcttttctgacagtaaaaatggtatttcactgcatttctttttctaagacattgagaaaatgccccatcaatcatgactattcttttattcttgatcctacttgtgaatttgcagatataagtttttgttagccaacaactagatttagttagcaactcatacattacattagattgagtgtgttgtattgctttaaaaagatccgctaatttaattatcacacaaccttgtaagttgggtactcttattatttgtattttcctacttcatagataagaaaactaatattgggataattatgtacttgttcacagctaatttgtaagtggtagaactgatacagtactcaaatcaggcatttctgattccaaagattttttttttttaactgcattactggttacttgttacttctaagttaaaaaatctactcagactttttaaatctggaggagctaaaaaaaaaaaagcaagtataattgattagcaaagtagttgttttaagtattactaagatgtattagtaatagaaaaaaagaaaataatttatttttatttttatttttatttatttatttttttgagacagagtctcgctctgttgcccaggctggagtgcagtggcgcgattttggctcactgcaagctccgcctcccgggttcgtgccattctcctgcctcagcttcccgagtagctgggactacaggcacctgccaccacacccggctaattttttgtatttttagtagagacggggtttcactgtgttggccaggatggtctcgatctcctgacctcgtgatccacccacctcggcctcccaaagtgctgggattacaggcgtgagtcact

SEQ ID NO: 116199 - DNA, 1067 bp, Homo sapiens
ttaaattaaaatgaaatgaaataaagccatcatgaagcaaatcatgaaacatctggattaaattgtagacttctattttgtggttaaccgggattaaccagaaaaccctttagattccaattcgtgtggctgaaagactttaaaaagtatatcagggccaggcgcagtggcttatgcctgtaatcctagcactttgggaggccaagacgggcggatcatctgaggtcaggagttcgagaccagcctggccaagatgacgaaattctgtctccactaaaaataccaaaaattagccagatgtggtggtgagcacctataatcccagctactcgggaggctgaagcaggagaatagcttgaactcaggaggcacaggttgcagtgagtcgagatgatgccactgcactcaagcctgtgcgacaagagtgaaactctgtctcaaaaaaaaaaaaaaaggtatatcagtgtgctttctttccctggcagaggattttaacaattccccatctatttataattccttgataatttctctgaacatacataatctaatagaatatgaatgcatactagtcttgaagattagctacttatttttgtctttctcctacaagcatgtagctaaattatgattaactaaggttatattcccctctttcagttttaattcgtcaagtatttattgagcattgattatataccatggtggatatgagcttaggatttggacagtgctgtccagcagaacgccctgtaatcatggaaatgttctatgtttaccctctccagtagggtagttttcagccatatgtggctaatgagcttttgaaatgaggcttatgcaacagaggaacagcattttaaattaaatttaaataaccacatgtggcttgtggctaccttactgaacagagcacctctatagatctcagttctgcaaacttaactctttaggaaagcttcagtgagttccttaacctgtctttgaaatgtaaatattatataccttctggaatgttatgatttcatgagttaatgcatataaagcatttgctatagcacttgaca

SEQ ID NO: 116200 - DNA, 1028 bp, Homo sapiens
caagtagctgggattacaggcatgcatcaccacgaccggctaatttttgtattttgggtagagatagggtttcaccatgttggcctggctggtctcgaacccctgacctgaggtgatccacccgcctcagcctcccaaagtgctaggattataggtgtgagccaccgtgtctggctggttgctgattttattttttaaagtcatctacatttaagttagcataatatagcagctagaagtattttacactaaaactgtgtattaaaaatatttcatgtttcatgctttcatatttcatgtttcatgaagtattaaaaatatttcatgtttcatgaacaaaaaaaaattttgttcagtgaatcatcccctttggcccacattaggataacttctcatcttttttcctattaatgataaaaattgggacacagcataatggaattattattaattttttaccagaagagagaaaaattacatgatgaagaagaaagaaaaagtgcctgggttagccaagagagacagagaacactggatagacttcgaacatttaaacaggtattaaaagtaatggtccatttattgtttttcttttttttttttttttaacagagctacatatacacctgtaggatttctttgtgggaaaaacttggttttcccttatttataaactattataaccatggaagtcctttttaaaattgttttaatggcatggctccatttcctctggtggttttccgaatttagtattcttgtgacctttgacccacagcttcagtagtataagaggaatgataagggcctctgggaaacctagattcctcttgagtttaaaaaattagttaaatcacaactgactatccagctcaagcatcagcatgttatttattccacatacatcagcctgtggtggtaatacatcaaatgaccattggcagaattagaggtggaggggagcagcatatttgagaaatgcttcagcagttctcttgccagggtaagccatgaccacacactgatac

SEQ ID NO: 116201 - DNA, 1335 bp, Homo sapiens
ctcactgcaacttccgcctcccgggttcaagcaattctcctgcctcagcctcctgagtagctgggactacaggtgcctgccaccacacccagctaatttttgtatttttagtagtgacggggtttcaccatgtcggccaggctggtctcaaactcctgatctcaggtgatccacccgcctcggcctcccaaagtgctgggattacaggcgtgagccaccacacccggccacataacatcttttatttgaaggagaaaataaataggcatgtgctcataaattgtttcaataacatttaaccagttccaataacttctggtattttagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccacctcccccacctcctccccctcccccaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagaggtacgtcaacatattttcatggtccatctgttgtatgacatcaggcatagtaaaaaactatattttttgacgttgcaaagcttaaaacactttatttttgacattatttgatagtaaacaggttttcaaagtcacactagaggagaattcttagtgcataaagtacacagaaatgtatgccttcttgggctgttaggcatgttttaaaaacagatcttctaaagtgatacattcatgtttggtaatgtataatgggtggctccttttgtgttagggaaaaagttttgattttaaacctgagatttttaaaaaaatactcatatcagaaagggtaagatatctggtaaggactgtcaccacagggaagacattggcaggatcatgtaacatttgttcatacatttgttgaggac

SEQ ID NO: 116202 - DNA, 1058 bp, Homo sapiens
aagtgacagtctcattcttgccctaaaaaaacagaaaagggcctggcacagtggctcacacctgtagttctagcactttgggaggctgaagcaggcagatcacttgaggtcaggagttcaagactagcctggccaacatggtgaaacctcttctctactaaaaatataaaaattagccgggcgtggtggcgggcatctgtaatcccagctactcgagaggctgaggcaagagaatcacttgaacccaggaggcggaggttgcagtgagctgagatcgtgccactgccctgggcaacagagtgagactcagtcttaaaaaaaaaaaaaaaaaaaaaaaaggctttccaggttcagtggttcgcttctgtagtcccagttactcagaggttgaggcatgaggatctcttgagcccaggcgttcaaatccggcctgggcaatatagcaataccccgtctgtaaaaagaaatcaatacgtcaattttttttttaatgcaaagccttttctgacaaagtatttcagtaacaaactgttatgcacactgaattttgatgtcatgttagctgacctcaaaggagttttctaagatcattctggaaaaattgttgcattgtctgattatttaactttctaaacccttaaaaaaaactacttattgtcacagttactgtattatctagacaaatttgcaggtatcattaatatataaaaattatctacatatctaatgaatactcctatacatattaagattctctttggttacacatgtagcattctcctaatataatagagagctatagtctactacattttaatatactaattatagagtaatatggcacagattacaccaaatatatagaaacattaaagataacatggtataaattaaacagtatatcaaatttataatgatggtaactgaaatgttgtaatttgtataaaatttatagagtatacaaacatgttctattaattattattctttcttgatggaatatgtttctctaggcttcaaacattcaccaaagtagggaagacttgagtcctagaagg

SEQ ID NO: 116203 - DNA, 1051 bp, Homo sapiens
tactctagtagcagtttatggggcaaatagtttagactgaatttacctttttagtatatagttttcatacagtgttagagtaaaaataataaaaatgaaaatctaatagtcttttaaaagtgatcaaaatctgtatttagattattttgttttcatttttactgctttaagaatacagtcatggccttttgtaaaaaatgtcttttttacactttttgagggaacgtaaatacactgtatctttaaagggtcttttttttaatggtctgtattattttgtttgtaaacaggtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatgg

SEQ ID NO: 116204 - DNA, 1093 bp, Homo sapiens
atcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgccagcctcggcctgctaaagtgctaggattataggcgtgagcctctgtgcccagcctgacaaaatcttttatttatttaaatgttagtaatacgtttattgatgagactaggagcttctctgcagcatcttcataatacattggttttagttcccacactattcccacatcttatctgggaagattagaaatacagatgtaatatggaagcttcaacagcatgggggtggtgatagtgtcctatttgcccttggtaaaatattaaagcgtatttcttaacccaaagagtgattggttatatgaatatatttgaaaaagttaaagcaaatttgcaaacctttacaaaatcatgtatcaattttatgctatccagtttttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtgtgctgtaatcataagtctctagcaaagagtggagggtggagggtgtgtagaactccactcagcctcatggatacatctacaagtctctcaacccatcctgttacagttctccatgagagtcacc

SEQ ID NO: 116205 - DNA, 1308 bp, Homo sapiens
cagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggattttttttttttttacttgcatgttctatggg

SEQ ID NO: 116206 - DNA, 1065 bp, Homo sapiens
ccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaattaacctgattttgtttgtttaaaatatcagtggtacatattttcacttcatttcaaataggaggaccatagcaagttgtatatctgttatgacaaaagttataacatggagaacaggatccagagaccatccatgcctgtatttctgcctcttcctgagcgctgtttgttgtgacatattttgatggcaactttctttgtgctattaatgaactttctcattgtttataaatattcacaaagtttggaagtgctgacttccaaattggaaaatttttaaatgggggtggggagaggcagaaaaatatttataaagttacaca

SEQ ID NO: 116207 - DNA, 1052 bp, Homo sapiens
ggtaagaaagagattacacatgtggctggagcccagtaagcagtggggtggatagcaggggccaaatcacatctccttgtagtttatgggtaggaaatttatggctttattccaactgcagtggaaattggagagctttatgcaggggagagacatgatctcaccacgttgtgggtatagaatgagttgcaggcagacaagagtagcagtgggaagacagggcaggaagccagtgaagcgtctagtggatagatgacgtaggctgggacccaagggtggcaggggatagagaaagaagtgtgtgtgtgccaggtgtatattagagttaggtatgacaggactgggagatttggatgggagccgggaagtgaggttgagaaaggtatcaaggataacttctaaattctgaaaggcagaactggaggaattgtgaaagacggggaaaagtgggaaaattagggttcaggttttgatggtgatagggtcaaggggactgttttgggcatgttatatttcagatacgtgtgaggcttccaaagaaagaggtcactaggcaactgaacacatatggacctgcgtacatacagtgaactgagaagaggcgaggacatggagtcatgatgagagagatgtcatctggaaccatgagaaagagtaactaggcagagagggaagagttatgaaagaagcctagaaatacttagatattttttgtttcaaccatccatgaaagccaaatcatcacgcttctatgtaacggagtgaaagcatgactggggttgagatgatgctgaagtactgccttctgataagtcaacttgatgcaatgacaaaagttagataacggtaggcaaagttggaattggcattagaaaacctttcagcaagtgctgggtcacaataaatgtttggttgcattttctgacaactcttggaagttccagagttaatcctgtgtttcagaaattgtgggactgacccacgagcttgttgcacaggtaagccatcctgtttctgaaaagaggtgggtcacaaagtgccctatagggaag

SEQ ID NO: 116208 - DNA, 1039 bp, Homo sapiens
caaccaaacatttattgtgacccagcacttgctgaaaggttttctaatgccaattccaactttgcctaccgttatctaacttttgtcattgcatcaagttgacttatcagaaggcagtacttcagcatcatctcaaccccagtcatgctttcactccgttacatagaagcgtgatgatttggctttcatggatggttgaaacaaaaaatatctaagtatttctaggcttctttcataactcttccctctctgcctagttactctttctcatggttccagatgacatctctctcatcatgactccatgtcctcgcctcttctcagttcactgtatgtacgcaggtccatatgtgttcagttgcctagtgacctctttctttggaagcctcacacgtatctgaaatataacatgcccaaaacagtccccttgaccctatcaccatcaaaacctgaaccctaattttcccacttttccccgtctttcacaattcctccagttctgcctttcagaatttagaagttatccttgatacctttctcaacctcacttcccggctcccatccaaatctcccagtcctgtcatacctaactctaatatacacctggcacacacacacttctttctctatcccctgccacccttgggtcccagcctacgtcatctatccactagacgcttcactggcttcctgccctgtcttcccactgctactcttgtctgcctgcaactcattctatacccacaacgtggtgagatcatgtctctcccctgcataaagctctccaatttccactgcagttggaataaagccataaatttcctacccataaactacaaggagatgtgatttggcccctgctatccaccccactgcttactgggctccagccacatgtgtaatctctttcttaccttaggacctgtgcgcagactctgccctctccctagaattgttcacctccctcccttttgtaagtatggccaacttggtgtctcccaaaattcatactttaagttctaacccctagtacctcaga

SEQ ID NO: 116209 - DNA, 1566 bp, Homo sapiens
cacacctggaacttgaggcatgggcgtcctctgctcttcaatctcctatcctgtctgaaggttcacttttttaccctccctgctcccatctaaggctgatgtactagacaaccggagaaaggaggttgtgctcagggctcttccatagtgatatttgccaccctctcatttccttccactctccttccttgctacgtggggggtgtcattaaaaaaaaaaagtctcatttgaggtgggaaattcaaaagtagagaactgaccctttcattactacagtaataacccaaaactgagggccaagtgcatagaatacatttgttgaaaggaagaataaatgccaggaaagcagcagaaatccaaatttcaaaatatcatcccatcacgtacctcttgaacatctctcatattcagttcagctgtttttgcatcatttacagttttctgtgtctcttacctggattgctacaattaaaaaaaaaagatcttcctgaatatggttttctataagctttcttgttttaagaaactattattaatttttataaagatgaggtctcacaatgttgcccagggtggtcttgaactcctgggttcaagcaatcttcctacctcggcctcccaaagtgctgggattataggcatgagccattgcacctggcctcccataagcttttttttttttttttggacagagtctcactctgtcacccaggctagagagcagtggtgtgatttcagctcattgcaatctctgcctcctgggttaaagtgattctcatgtctcagcctcccgagtagctggaattacaggcaagtgccaccatgcctggcaaatttttgtacttttagtagacagggtttcatcatgttggccaggctggtctcaaactcctgacctcaagtgattcgtccacctcggcctcccaaagtgccaggattatatgcgtgagccaccacgcctggccccataagctttctttaggccattcttgatactgtagccagaatgttttactgtctctaaaatgtgcatccagtcatgctatgtctcctcctcaaaggtttcagtggctttccactgcctttgggaaaagtcagaactgctgaggacatgaaacaaagtccgtagtctggactctatgacttgctctgattccccaagctcagccagagtgtatgtcaggactgtgaattcaaatgtgtggcttgctttcctccatcactccaatcttcaaagtgaacatctattcgtcttttacacttagttccaatgttaccttctcagtgatattggctaattctctcctgtgtatatacctttcataacagcattgatgtatgattgcttcttggttaatatgcatgcttccctcattagattataagcttctggaggatagggctgtgtcttcccatctttgcattccagtgcctggcagagtgcctagtgacattgtaggtattcacaagatgtttgactgaacagcaaactggcagaggatgctgtcagaagaaaagccaccaatcaggagacaaaaggctcttgacataagagagagaaatgt

SEQ ID NO: 116210 - DNA, 1127 bp, Homo sapiens
atcagggagtttagtatgaagagttaaaaaaatttaaaaaacagtgtaagctgttgaaatggcaagtgaattattttaatgatgtaataaaatatttttaaattttgacatagtgatcatttaatgaaaaaactcaccaaaatgtctccatttgaattgtattgataatgtgggacatatgtgtgattcaatatatacatatacccatatgtatatacagaaaattatttttaatactttcctactgataatgaaatttaaaattggaaattttgtgagtgtttttcttgtccaatagagcctaattgtttccttttttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacatggaggaggaggttgatcccattgtgtataagttaatatgtgataactattgaatcttgtacaaaaacaaaaattgaaaaaaaaaaagaaaagcaaaaatacagtttttattttgaaatacatttgttctctggagaatgtactttatctttttttcctccagtcttttacagatatttaaaagcatttaaatgatgacagcatttacttaaatctttcaggtgctactggattttgcattagtgtgttatgttgtgaaatcctaactttgacataaaaggttttataagtattcccctgcctggaaaattagtttttgttctcctctctctctctttctcttttccactttctttctgcagactaaaacatgctcacgaagttgcatctctccttgtctctatagaagatctccagcaccatcatagatttgatgttctgctgtc

SEQ ID NO: 116211 - DNA, 1032 bp, Homo sapiens
caggcccctgtagtcccagctactcaggaggctgaggcaggagaatggcgtgaacccgggaggcggagctttcagtgagccgagattgcaccactgcactccagcctgggcaacagagcgagacttcgtctcaaaaaaaaaaaaaaagtaggggtgcggggaggggaaatagggaaatcaacaaaaatactgacttttgtgaatctagtagatacataattcacagcatcaccttgggtcaattcgtttttcttctcacttaggaactagcagtaggtccactgaatagctttttattcccttcccttagatctggctctcaaccttccaaattcactgatgtagggaaactatgatttacgttaaagtatttaaaacacctgtaaggcactttgaacctttcacaaatatccctgagcaagaagttagtatccacatctccttcctaaaagaggataagctgcttaaaattttcaaagggaatttcttaagaggctttagagtatcatgggtagaaaccagcagcgaggatacaaagtggaagtgaaactgggacctcctgtggctcttcacccttgtatttccattcctcagccacagctacattagggcatgtggcaaagactacagaaggcactgtgccaggcaagcagtgcacagatgttagcagatgttacagtgtggagccatctccaatggagctgcccatcagcacatagaaatgttgctcttactgctagaagcacagttacaggaaccaggacatttctcgggccctcttatgggactctccattgtagcaaataaaaatggaagtagagctagacttttgctgtgctctctcaaatcaaatgggaaactatgcactaaagtacagagtgtttttatggagtacacataacatagattcccttctcccctctcacaatcagaaattaaccataccacttcttagaatcatttctgtttacttattttctcattgcttcattaacttgctaaatttattctgaggttacataaaaggtttaa

SEQ ID NO: 116212 - DNA, 1878 bp, Homo sapiens
acgactggctaatttttgtatttttagtagagacaggatttcagcatgtaagccaggctggtgactgaggtcgaactcctgacctcaaattatccacctgcctcggccccccaaaggagatgacaggtgtgagccaccacgcccagccctgatcttaaatatagtttggatttactgtacttttaagatgataaaaacaggaaaaaagtgaatggctgttaagagctctcaggtactatattctccacactgtgacatgtttccctttttaatgggtggtaagcaaatcttagattatagtaataaactagaatagaaataatttctgggaataacttttgtttggatgagactgtggactgtatgtaaagctgggacttggtttcacaagaagtgactttatcattgatataattgtaggtgaaaaatttaagttgtaggattctctttaataattgacttaaatatcattattcctccactatcaaacctcaaaaactagattaagtttttctagattaatttgaaggcaaggaatatttgtgagagatcataacttaacaatttagagatgtcagaatttttttactataattgtgaacaatagtattttacaagaagtacggtagtaatttggtcatgtacattgttctgcattctctggaaactgagaagcagtttatatattttaaaataagatgaaataaatataatttagtgactaagagtgtttattagctttctgaatagatacatttacattttcatgtcttgattttttttaagaactgaccttcattctctaaagattttgaggaaagtgttaaaatttgctaaaccattttgtcaagcactatcacttggtaaagattattcacaagaaaaaaactattctttatgtgagataaagacattactaacccacctccaatggcgattagacccttcctcttctctacctctgccttactgttacaattaatgggaaagaattgttcatcaatccattcctagtgattctcagtttctcttttcaagaagactagctggaattacaggtgtggtcatttgccatggaacagattgatcctagattaattatgatctctttcttgtggagggctttaaaaaattcctttttcccctccatttctgttcttagcctgctacatggggatttcattggaagggaggtaggtgatacggacagttttgctctaggacgtagagaagaatgtttttttcctttggatttggccatctttcctcttacccaaatagttagggccaagatcaaggtgtaaacctaggcagaggccaggcaagccacaaaatgtgtgacatttgtgatatatgtgacagtaaatagtggtaaggcctttggtaaaatggagtgtgcagggttcacctaaacatattaaagctgtttaaaatgaagccaaaagaggttggagactaggtaacccacatagtttctagtctacatctttaaaagaaatctctgtaaagattggatccagttcttgcttcatggggataatacataagattcatacttcatgtggaaataaggtcacaatcactgatattgaaagtggtcattctccagggactgccttccttgtagaatgtgtcaaatgtagatatgactgaacagtttaaataaatgtacattgtacttttgttttctgtctgccattttccatttagagtttagcttggccgtatattcactgttgacaaaattgttaattttggggaccttgttttattatatctcagctttattgagatataattcaaatactaaataacaactacctcaggtatacaattcagtggtttttagtatattcacagagttgtataaccatcacc

SEQ ID NO: 116213 - DNA, 2892 bp, Homo sapiens
cagataaaacgtgttgcaaatttcattcacccctttgccctccccctctcctcatccacttcttctcctgtaccccttccattatctacttctttcaccaaaatcacatcttcttgcatttttgtgcatcttttcttctgaagtatagtaattctttgaatatcttttattctgaccaattagttaaataaaccaaacatttttaaattattcgaaactgtttctaaattgtgttatatttccgtttctaaattgtatgtttcagagagttttcttgtgagtagcccagcttcaaaaaactttttctcctagcttgccatgaataaaaaataaaaatttccatgttttatgtttttaagtctttgactcaaatttcagttgaaatttggttcatcagtaagcatacatcaaaggcagttttaacctcaagatgatattgtgtactttaacaaaagtgtaactattttttatcccccacccctttttttaaaggaatccgcaggcggggatcttcagtctcctttaacaccggaaagtatcaacgggacagatgatgaaagaacacctgatgtgacacagaactcagagccaagggctgaaccaactcagaatgcattgccattttcacataggtacagattcaattcagcaattatgattaagtaaatgtgtaaatatggaaatgtttggtttcaggaacccttgtagttacaagctttgagtgaaaactccaggttgactttgactttttttttttttttttttactgcttctgttaacctcagaaatgaaatacacaaactttttattaatttatagtttatagttgcatagatggactgcagtgaacatttcctttatgtagaaaaaggagcactaggctaattacagtacaaattgtttttcagtgaaataaaatcttgtaagttgcttctacctgtcttttaacatagcctctaaaaggcctcctttattaacctggtttctatttttgtgtatgttcttgaaggttataagttggaatttttttttaagtaggctttccactctgaaattaagctttatcatagtctttgagatgatctcaccacgtgatttcacagaaggaaacagtgggataacttttagcatgggtttgttaatgttaatggcagatttatctttgcacaccaactaacaggagataagtcttcacttgcttttgaattttaaaagaatctgtttctctgaaaacatactatttatcctaaatgtgttccaaaccagttacattcattattggccatacttggtgtatttaggatgtaaggaggtctgtgcaattgcaatcttgcaaatgtaaaacaagtacctatcagtcatctgttttaaagttaattttttgtccttctttggaaacttttcactaggttagttttagttaaagttaggaaaacattttccttcattgaacatttcttttggggaccaattttaaaaaaatcctttggcatattaagcaaaattgaagtgagatactcttcaaccctctttctcatgagaatttttattttgattgaaatttgttgaatattaagggcattggattaaatgcccttagtagaggcttagtagaggctaacattgggagacctcattgtcaggctgaggaagaagaaaaaattagttaaggttttttaaggaatggccaggtgcagtggcatatgcctgtaatcccagcactttgggaagctgaggtaggaggatcacctgaggacaggagttcaagatcagcctgggcaacatagtgagacccctgtctctaaaaatatgtaaaaacttaggccaggcatgttggtgcacacacctgtagtcttagctacttgggaggctgaggaaggaggatcacttgagcctgggaatccaaggctgcagtgagctacgattgtgccacggtgttgcagcctgagtgacagagtaagaccttgtctataaaaaacaaaaaaggtttgtttaggaatgaacagaggaaaactgtgaggctattctaatttgttgctaacagtgctaataattttacataaaacagtagatatattgtggagttatagatttattgttgtggtataacgatattttctgtttatagtgataaagatgactgaacacatgaaaaattttagttgtttctatctgaataatatgtttacattacatagtcttttaaaatatgcagttacaattaaataatcatattagtatgcaattttaaaaaatattttactatgttgaggaaaggaaaaattttcttcctattaaactatatttaacatatccatttaataaacagacttaaaacttcactgaacataattatatacttgatttctttggctaacacttaaattgagccatctgtgtggaatactgtagcatttagaaataaattctgtatttaacatttgtaaaagctatttctagtttactttatgcacctaaaattttctaaatgtctacgattttgttaatccttagtatttggagttactacctggaattggtcttctctacgatttttctctgttctcaagagtctaataagagttactttgacttgaagtacatagctgctttgactactggaatttatagatgagtcatggagatacttgacagagttctgaatataaaatttaacaggtcaatttaagtttttaattatgtgaaaggtattacataatcttgtagttcttacagaaaaatacttcacaggatttttttaagacattctctgaacttgttttgattttacattaatcagtattaatcagtattcactagttacttgactgaaaacaagatttccacctgaggtatagaacactgagtattttaagttaatgctagaatccc

SEQ ID NO: 116214 - DNA, 1060 bp, Homo sapiens
caccgtttatggattgggattctcctctgagcatcatctttcgaaagtgagttaaatcataaaatttgaatgaaaatcttcatcttcaagtcgtatatcttaaatatataataccaaatggagagtataaaatataggagaaatttatttaatattctcgaaacagcagtagtgacttcagagcaagaagtaagagatcattagattctgctgtcacttggaaaatgtacacattaaaaacagtcaccattggttgagaaggatttatgtggttaattgtctgtgtgataggaattaaaaggtggggattatcacttcagaatggatttttgtcagagattagtaccctcaattggagatggtctacaagataggcagataccaagctcttttgaattgtgaaaactcaagctgacagtgatatagatttcagcattttgatgtgacagcaggtacatataaattactgtgtttaggggaaattgtgctttatctggatgtggaatactccgagctctgatgcagtgcagactgagatactatagacatcatgaggaatttttagataatactcaccatgtgaccagaaaggccaataaaatgcaaagcatcaccaggctaaatattggaaataagacagttctcctgtcaataagcaaaagccatgtaatgtttataccagcagcaccttgggttcttgtggatgttacacagaaaagaatatataagaaaaaacaatctcagtatactaagtgatcaaagagaaaagtaaaactcacttttctcttcagagcttgtgcctgccagacctaaagatttattcttaaaacctctgtttgaagcattcagttaaaagaataaccatatattttaaatactttacatatgatttggtatatgcaggatctgatactggaactcaggctagagagttgaaattatccaagtgcagagaaatcaggctcttgtagatatacagtgtttatatttacattaaattttaagctgtttttctttacagaaattattctgtattcaaattcttaaactgggttctttt

SEQ ID NO: 116215 - DNA, 1157 bp, Homo sapiens
cacgacattttcatcaactaatcaatacataactatgttttatgtgtgtttctacttaaagacaccttgcttaatatatattgttaatgcattaacattgaactgatggccaacagcactgtaactcatgcctcagtgaaacttatctaacacatattttctccacatcacagccttcttgcacctaggaacagctagcatctgggaacacttcagcatgatgcttatgggccattttacacagtaaaagcaccaacaaagtgtgaaatgtgtaaaacatggtgctaaatagaccataaaaaggacacttgtaaatgtagtatgagaactgaaacaagaaggcattgtcactttgttcagtttcagatggaaatgtgccatgtcaggtgatgcatggttttgcactgccctgtgtgtgtctgtgaaagactaagaatgtgccacactattgatttggcggttacagataaattttagtgagtaggtgaattcacatgtacagactcttcaaataatgaggattgactataattgtttttagaaaccttatgactgaatacttagaatatgcaaatttgaaagtttctcttactttcaggtatgtggaaattgttgattaagcagaatcatccttgcagttttcatgttctcttgtctagtgaaataaaactggctgctttcagtccatcattttcttttctgccctgcagggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggtaagctacgtttactttgaatgatttggctggttttgcttttttcagtatgacattttagttctattcagaacattttatcttcattaatataaaatgtttccttttgagttcttaaaacttttaagaaacaaaatggattattaaggtagcaacatgttttgtccactaaatgactaaccactttattacattgttacatgccaaaatattctacaaatttgaggtcattccatttatttaatgttcattgcatatctgttatgtgtcaggcattatgccaggtacta

SEQ ID NO: 116216 - DNA, 1011 bp, Homo sapiens
agaatgggattgccatgattatccttagcgaagctcacagtcatatggaagagggtagagtatctgaggtttgttggggagcagcaaggaagaacagttggtagatagtcagcgaacagggtctgcagcagagtcaaatcctcagtggaaaatattaccagccttatttctaatacttcttagaatacttagaatactttcaggctactttcttttggaaaattaaaaagaaaggaaattatttgaaaccataaccttctttataatctcctttgctgcagtagccatttgtacttacatatctgaaaaggatacttctaagctaggcattaaaggtataccaggaaatgtacaatttctcttcctttccttgagtttgattgtatttattggacctatgcctttgcactctcttgggatgaagatttactggttaatcatataatatttttgaaagtatagacttcattggtaactgtaaaacagcatcatcattgatttttaaaaatcagagctatccaagtgatgaatgttaactgtctgctttttttctagaccaaaacttatgtatctcctggaaaatagttttttgttttgctctagtttttttatgatcctcgtttctttcttattacgcagatgcctgagagctaaatgtagtaattctttatgtcagctctagtgagtttgagtaagtcttgtttttaaaataaaattctgattttattacttttttctcagggttatcttaacattcttccagttttccacatccatagtaagttttagcatccatcactgtatgtagtacttttaaagaattgtagctcaagatgaagaacttgagaattattgttacaccaatttcctagaattcgtttatgaatcaacagaaaaatactccagtaagcttttcttatgtcagtaaagtagtttgaattacttactgttctggttattcatgtaagaagttaccgaatagatagtgctctatgattaaagtgtgtgtgt

SEQ ID NO: 116217 - DNA, 1035 bp, Homo sapiens
agattaaaagatcaaggaattcagatcatacatttttttttcttttttaaagagacagggtcttgctctgtcacccatcctggaatgcagtggtgtacaatcatagctcgctgcagcctccaactcctgggctcaaatgatcctcctgcctcatcctcttgagtagctgagactataggcatgtgccaccacagccagctaatttttaaattttttatggaggcgaggtcttgctgttggccaacctggtctggaactcatgggctcaagcgatcctcccgctttggcctcccacagcactaggactacagaggtgagccactgtgcctggccagatcatacaattaaaaaaaaaaatccttccagaagtctcgatacttctattatagcaaggttactttacaattttgtatttgctatagagtaacttccaggttttaaaaaacatgcacctgctatatttttggttcatcactaggtggagttgttgcagtataattatgtgttgggtagccattagcagaaaaacctttgcattcttcaaagttcgtatatggtttttaaaaaagaacattgtatgtataagcaatcagcttattacacatatcatggcatagggacatacagttggtagtatgttatattatgcagtcataatctctgagcagcatcaaaacaggtatcttaatgagatttttcatggggtaggatatatgtatgagaaagagaggaggtggtgagatttaaaccagttccctgataatcgtgtggagtttcaatttatattattaagttgtacaggataattctttctaggaaattccagtgcttgagctgctgcatccaaagtcatgctatgccacttcatagtggcactgaaactaaattctccagccattacctatcaagttaaatggtaattagtgtccgtctattcctggacttatccttgtcattctcattttggcctgaacaagtattgttcagcttctcttgccacttcagtcacccaaaagcaagctgagggtagaatgt

SEQ ID NO: 116218 - DNA, 1538 bp, Homo sapiens
cacagaattttcattaaggttaaatagaagcattttttatgcccaggtctttaaatcttttggccatgatctgcagggggaagaaaatgcatcttacattgtgacaagcatatataaatacgtggctgaaagtttcttggaacaagatatatgtcctcaccatgtatgatgcacttctgatattgtacattttcattcacttttaaaaataccccttgttgaccagtagattgatcatgactccctggattgtgacctagggtttgaaaaacactgtagtaaacttgtcttgttaagatgcccgtttatctataggattccctctctcaggtagctcagaagtcagtctccctctacctctaataaaattcactttcaggaaagctaaatagggaaaaggcctcccacttagattattgtattcctgtattatatttttggtcagtgaaaaatgttaattgcttttcacagtcagaaaatgtatttgggtttctatgatgccatggtgactgggttgtattaacactacttttatgaaatagagctaatgcatctaagcacaaacaccacatcactacagggattatatttgcaaaacccaaaattgagacattatctgacaaaagagttttgtctatagtttttgttacgtgaaacgctgacaaaatttgaaagtaatgtggggcgaggtagcttgtgtccaatgtcccagcgggaggctgaggtgagaggatcccttgagcccaggagttcaagttaggcctgggcaacataaccccatctcttaaaaataaaaaaaaaaggcaaattataagtcacatttaattatacttaatatagccccttttcaacagataaaaataaaataatatgaaacctggataatcttgggaaattgagactgtatgactaccatacataaaataacagatgtgctattcattggtaggcttatagctagatgactcgaggaccatgtagaaaagacttagctgtaattagtacctgtgactagacaaaacttgatcaaatgaaagttagagtcacttccaagtctgagggatgttggaaagaaaaatgcatagagaaagagagtgggaatttactgcttgaaaaacactcaggagtttaacttatttggcaatagaattgtgttatttttgacgtctagtttaacattaaatatgttttgtgtaaattgttttttgacgctgagccaggaaaacattttaagcagctctaagttaaaagtttgactaacatgcatttacttactcctccattacctccaccagctcaccctttcacaatggagtaatttagaggagtatcagaaacactttggtatggaaaaatagaacctaaattttataccaaaggaccataatttacctttatgtggttagaattggatatatgagatgtcgtttgagtactgaattttagattctgtctttttcactattggagctaaaataaggttttaaacaagctcagaaatgagtatagcaatttgttgcgctcagatggcccagaaa

SEQ ID NO: 116219 - DNA, 2125 bp, Homo sapiens
tgacagtgatctagatagatattatgaggtaaaagagattgccttggtcagccattagttgataaagggaaccaagaggagagaaacaagtttgtagcaaggtgagatgacaaattgaaggaaccttgagatatttgtcgtcagccccgtgggaatgctttatagttggatattattggtctggtattcaggaaaagagaactgggctgaggatagagttttgggaatcagaatgtgtaatttttggttggagctatgaatgtggatgagctcatgcagggtatttatagaaaagagcagatcaggcatctctgggaatagtcatttaaggggcagctgagaaagctgtcaggtgagaatagtgtcacaagagccaagaaagggagtgagtttcaagaaatgagtagtagccaggatcacatgtaccagaaacatcaaatgaggcaagaaataattagattggataagtaatggtcctttaacaatcttaccttgaagtttgagaagtgtagggtggaaatcaaattgccatgaagtgaaggtgttgaaggatgaggagcagacactagaaatgtgtctgcttctcctttaagaccaagcatctttgaaatagtagctcagcaagctctagggttcaggaaattcttttggttttgtttacagaatgggattaagcattccttttaggatctggcaaaggagtctgtggcaaggtgtatttaaaatattagagtagagagggataattattgagaaagagatgggtgagaatgcaatatggagcacagatggaggagttaaccttcagtaggagaaatattgtcctcatagaccgaaggaaaggatatgaatagtttgtaggttaaagaaggagactgagggaattccttagctgatggactctgtttcctccattcattcattgctttaacaaacattcattgattacctgttatgtgtcaggcggtgttctaagtatatgagatctgtgaacaaagagccttgccttcatggagcttacattccagtgaatgataaaaggcagggccatctgctaagtgtagggatataaaggttggtcagagccttgggaatagagggaagaatgggagacagtgctgaggagcttaaaggtcccagctgagattagaagccacacattctggtgttcttgaagccgtctaaatctagttattattgtacctgaagagcacagtagagttagaagggttttcattttcaagccaggtgcggtggctcaggcctgtaatcccagcactttgggaggctgagacaggcgatcgcctgaggtcaggagttcaagaccagcctggccaacatggcgaaactccgtctctactaataatacaaaaattagccaggtgtggtggtgcatgcctgtagttccagctacttgggagactgaggcacgagaattgcttgaacctggaaggcggaggttacattgagccacgatcgtgccactgcactccagcctgggcaacagagtgagactctgtctttaaaaaaaaaaaaaaaaaaaaaaaaaaaagacaaagttttcgttttcttcattctgctgaaaatgaagcaagaagtgggtatatggcatttttgtagtgttctattctgttattttaatatacgtatcactttttccccccttagcggcccctttccttctataaagaacatttcttatcttggaagaccaacctaatacgtattaagtttgccaaaatatcaccaattttttaaacatttgatggcttttctgtggaaaacatcctgaaaccaagtcctatggaaagtcttagaggtcttttgagggctgcgactgcgtttaatatttatattcccatttcctgctactgctcagtacacataccacatgcgaagcacttgcgctcgtgtgaaccaaagtgtatagggattctttaatacggtgggttttttttttccttctttcatagttaggaaagtcacagaagttaattgattggtataagcacttaaacattgttctgattcttactgagaattcagtatattattattttggaaacagtttcagaagttatcctatcttccttattcttgataaatatttttagtctttctagac

SEQ ID NO: 116220 - DNA, 1037 bp, Homo sapiens
gtgggaaggggtgggaatttcattgctctgttatttaaactttcagtcagttcctccatttcagtcgcatacttcacacctcctctgcagtccctttgcctctaaattctagccagcaggttgttcacttagttccctctttgcaggcacttttattatagtttccttggttttgtcaaaccaggcaccattccttctattttccatctttaatacattttgaaaactgtattaaagttacttaagaactgctgctgctttttacagtctttggtgttataggtttatacctttttttccactccccttaactttcattttagtggaattttggaaaaggaagataaatgagtacaattaatttgccatgtttgaccagaatcaccgagcccttagcttttgaatttctataaggcatctttcagaatgtgttgacactgttgacagttaattgattggaatttggcggatgataaagtgttggctttctaaaaatctctccctgtaaccaacacctgaaaaatcaatgcatgatgtaagcacatgttaaaattaaaaacttaaaattgatcatcaacccaaacctaaggaaaacagagcactgactcagctgtgtcaggtaactaaggtgttgctacagtctcctaacactgtgcctcatgagcatttgtaaaaaacgttaagcacttaatttgtgtcgtgagtcatgccaggcactggtagtacaaagataagtagatagccatgtaaacaaaaaattacaatactgtgatttaagtgctgtaatagagatgtatgttgtgtttggtagcacagagaaggaagtgcccacctccaccttggaaggtcagagaaagcttcacatagccagtcatgtttgttttgagccttaacaaacaaataagagttgggggaggggaagatgtatgagtggttgttagggtattttaggtagagaggtggcataggtaaagcttcagaggtgaagtatgctaattagaaagttaaggtagttaagggagatgtgactagaagga

SEQ ID NO: 116221 - DNA, 1049 bp, Homo sapiens
gataagtgaagcttacaaatcaaacgtgagaaacttttgtccattcaaaagcttcagtgactcctgaagcatgcttgcttgcttgctgccccttccttttgaagttgcaaaaactagaagtttgaactaagggaggaaaacttgattaagctgccttttttttttttttttttttctttgagacagagccttactctgtctcctgggctgcagtacacgatcttggctcactgcaacctccgcctcccgggttcaaatgattctcctgcctcagtcccctgagtagctgggattacagatgagtacaccatgcctggctaattatttatttatttatttatttattttttagtagagacggggttttgccatgttggccaggctagtctcgaaatcctgacctcaggtgatccacccgcctcagcctcccaaagtgctgggattacaggcatgagccactgcacccagctctattttttataagggaaaatatccaagacaacttgaaactggtctctaatctttttaaacctgattacttttaacagtacttaccagttatgcccatttcttggtcagagttctgctttttgatatttctgaatgtatggttttaaactaccagatactgctttgacttctgaagttttctgcttttagaagacatcttacttacttctatgttattctgtctagatatccttaagtttgtccagtgtcgttgaagcctacatgtttctttctttctttctttccttttttttttttttttttttttgagacaaagtctcactctgttacccaggctagagtgcagtggtatgatctcagctcactgaagcctcctgggttcaggcaattcttctgcctcagcctcccaagtagctgggactacaggtgcatgccaccacaactggctaatttttgtattttttagtagagatggggtttcatcatgttggccaggctggtctcgaactctcggcctcaagtgatccacccacctcggcctcccaaagagctggaattacaggcatgagccaccgtgc

SEQ ID NO: 116222 - DNA, 1804 bp, Homo sapiens
ggaggaccccagccccacagccccatgcagatggcagcctggcggggggtcgcaccagtcctgtcctcacgttggcagatagagatatctactctgaagcctctgtaggggcctgggcacctttgggagcctgagctggaactgaagctggagctgcagcctgggccttggtttgatccttgtccttggcctttggccagcacaccctgagccccttggcaatgcgggcacgagcatgcttcccaagcttggggtggacagtgtaggcaagttgagcttgcggctgacaccctttgggatcttgggcttaacctccttgggctttaggagggccttgatagccttggcatgtgcactcatggccttggcactgttagcctgcatcttctttaggcccttcttgttgtgtttcttggcaaactgcatgttcctcaggaacttggggtccacccccttaagagattcgtatctttgtgcttcgggtttcttgataccatttctgtgccatttttgggactggttgtgtgtggtgtggttcttggacttggccatgtctgcaccttaaggcgcggctcctgaagcgcctagaatctgaagagacaggatgaatttaatactaagggggctgttgtttaaagtgggaaagttagcaccacacataacatgcatttagacacttagcataattaatttgtttataaatgaatgtatctgccctttagttaataaagttctatatatggactgaggagaaaaaggagcgagcattttgtggtgctatttttttttttttggaaagcctgtatttggggctatgaccctttctcattgatagtgacttgagtagagagaggaagggtagatggaagtagaagagcatacagcaaaggcatttgctgacgtttccacactttatgcgtatttatgcctaataaatgtttgtggaattagcatagctgcctggacctatttcaagcaaaaggaaacagggctttaaatggcttttaaagctttaccttggcaatccataattaccttactgtaatagatatctaaaatttaatactgtgggtaaagtgtttcacatattacaaccttctttttttaaactaatgttaggttataataaggatttatcttcgtcttaattgtagataattattgcaagtctaggggcagtctaagcaaaggaattatttttaataaaatcagtgattgggcagaaaaaaattatggctcccctaatagtagtttatgaactttttggaaatggagaagaacagctgaaacttgacagttggcaaagtctgtcaaagtatcttggatgttgcatgaactgttaattgcagtgaaggcaactaaagtatgggtttgtaaaataggtgtatcagatcccctaaaaattaaggcattcatgtatgtaaaatgaagtctctgaaaagttttgaagcctcagtgaggagcccctgttaggtatgacccccacccccacctccaaatagtatctcataatgacagcagtgagtcagtagctatttcagaactatcacagtaggcaacagaaatcaagtaacttcaaccacttatttcatgaaaccctttgtttttacttagctcattttggcaacctagtgccatcagcaatggtaaagaattctttccctcccttcccttattaagagctacttatacataaaatggggctctccctgctaatggaatctgttaatgctgtttctgatttatctcacctgcctatgggaacttctggagtccttccttcccctctttccccaaataactt

SEQ ID NO: 116223 - DNA, 1091 bp, Homo sapiens
cgaatctgtttatgtatgtgtattattgagcggtggtggtgattgtgttttgtgttttcaaacaaacttgccaccttgctaagctggtcatactttaaagaaataggcatgctaaccttttaggttatttttgcatttttgtagagcggtaccagaggtcataatttaaaaacacatatatcgtttgtaacttgaatatggatttgtgagtaatgtttacaaagacaacgcattctacactttactggtcagactgctgcatcagtttgtaatcaaaatcacattattttagcttttgctgacggttatctttcaaagagaagtactgcattctctcagtacttttagataatcagttgcacaaaggaacgattttaatgagtggttagacaacagtccttgaaagtgatccagagtaaattgttgccctcaccgtgccctctgtcttgtccttgaatattcaaagctaaaatgtatagaattgatttactggggcgttaaaacgaaaatctgaaattcagtcttactgatgcggtcaccacggtacgggtgcatttcgtaggaaaaagctttttgtttaaggaacttgttcactccttttgtttttcgcttttaagctcagcccttcagtttgagttaacagtatcagatctacaccttccttcggacccagagccaactgagagtgcattttccagtcttttattaactcttcacactgtgggttgatgaaatgctagtgacacttcctaatttaagctggaaacccataatatattaatggagcaatctgatttcattgacaggttgtcactgctttttggcagaagaacttccagaattttctctttttgtgtgtgtgtggttgaacaaacacatctgaagtgtagttgaggggcatgttttaaagaatggactctgcaattcatcgtgatggtttaggtgtgtacacacgcttgaaactttctgaggaaagttcttgaatagtaccttccttttggagttagaatttgaagtttaacatgcataactttgaaaatttagagcatgttgtaggagacgttcctcagaaattaatgacaaagttataa

SEQ ID NO: 116224 - DNA, 1010 bp, Homo sapiens
aattacttaagtcagggttcctttttttttttttttttttgagacagagtcttgctctttagcccaggctggagggaagtggtgtgatctcagtttactgcaacctccgcccccgccggggttcaagcgattctcctgcctcagcctcccgagtagctgggattacaggcacctgccaccacgcccggctaattttttatatttttagtagagatggggtttcaccatgttggccaggctggtctcgaactcctgacctcagatgatccacccaccttggcctcccaaagtgctaggattacaggtgtgagccacagcgcccagcctagtcagggttcttaacgaggtagctagagcaaacaacagcatctgctgtaactagaacacagggatttagtaggatagtatacgtagctcatagaatcattgggagagctggggaattctcctgctgaagtcccaggaacaagaacttgtaggaaacagaacactcaaattaggtattttgagtcatgcttaataaaaattactactttttttttccccagagacgggatctcgctctgtcacccaagttggagtgcagtggcataatcacagctcactgcagcctcagcctcccagggtcaagtgatcttcctgccttagtctcccaagtagctgggactacaggcacatgccaatacggccaactaatttttgtattttttgtagagatggggtctcactatattgcccagactggctcaaattcctgggcccaagcaatccttccgcctcggcctcccaaagtgttaggattacaggtgcgagccactatgcccagcaaaatgctactctttacaaaggtggggcacagtataggaaaaccataagagagaggagagtgcctggcatagcagcacagactgtcccctctgtgcctgaaaggacaggaggaaggagcaatggatggaacctggagacagagatggctgtgtggaaagcgttgtctgaagtagctatgtcct

SEQ ID NO: 116225 - DNA, 1204 bp, Homo sapiens
ttgtagcatacacatcagtacttcattcctttttatagctgaataatactctattgtatgaatatacatcactttgttaatgcagtcctcagctgatgaatttctgggttgtttccactttttgtctgttatgaatagtgcagctataaatatctgtgtacagatttttgcatggacatatgttttcacctctcttggagtgaaattgcttggtcatatggtagctctgtgtttaactttgtgaggaactgctgaagtgttttctaaagtggttgcaccattttgcatcctatcaacagcgtataggttgcactttctttacatgcttttgaacttgcaaaacttgttattgtctgcctttttgattatagccattctagtgggtatgaaatggtatctcatcatgttttggatttgcatttccctaatgcctaatgatattgagcatcttttcatttgcttattggacatttgtatatcttcttggggaaatgtctattcatctagatctcttgcccatttttaaattggactgtttgtctttttactgttggttggtaagagttctttatgcattctacatattagacccttatcagataatgacttgtgaatttatgctcccattatgtggcttgtctttttactttctttttggtatcctttgaagcacaaaaacctttcattttgatgcagtccagtttatctattttcctttggttggttgtgcttttggtgtcatatctaagaaaccattgttaaaggtcacagagattaatgcctatgtgctaatttttaaaatttatttattttattattattttttccctgccccgcctatgtgttattctgagttttatagttttaattcttatatttaggactttgatccattttgagtcaatttttgtatatgatgtaaagtagggggtccagctttattcttttgctgttggtccagttgtcctagcagcttattgaaaaaactgttcttttctcctctgtaatttttttttaaccatattgaaataggaaaaacaatcaggcaaaatcagtgggagaaaggaaaaaggcaaaggaaactgagaaaagattaacttgggtttttttagttagctgtttttttttttttgatatagagtctagctctgccgcccaggctggagtgcagtggtgcgatctcggctcactgaacctccacctc

SEQ ID NO: 116226 - DNA, 1015 bp, Homo sapiens
tttttaacaatgactaaaagtagaaattatttagcttgctgcctatacttggcctaaatagttcgccaaccctgctctaggtcagtaaaacttaatccttcaagtatcatgtaaaattttatgttagccacttttactggagatctttttcacatttgttacaaacttggacacttttctttttagctttttattatggaaaatatcaaaccatatactagagagaaaaacgtatcataaatccttatgttgcccactttaacaattgccaacatatgaccataacaattaacaacatatgactaatcttatttcacctttacctccctccctcattagtttgaatcagattgcagttattttatttgtaaatatttcagtattctgatattcagttgatcttttttgtttatccttctgccagggccatactatcttgattactgtagtgttatattaagtatagaagtcaggtaggttaaattccccaatttttttctcagctattcttggacttttgcctaagtcaaatttaaaattcttctgtcagtttctagaaagaagccttctgggcttttgatttctttttcatttcttgtgaaacaaatatcagatgggcttttgattttgattgcattgaatctaaaggtcaattctgggagaattgacatccttgacaatagtcttttgatccatgaatgtggtgtatctctccctttatttaggtctttaggttctctcaatattttctagttttcagtatacaaatcctgcacatctcttggtacatagatttctaaatatttcatgctttttgctgctattgtgaagttcttaaaaagtaaatttttaattgtttgttgatagtatgtatgctttaagtagtgaattatctttttagaaaattaaaacatgagagaaaaggccttggttttttatattatgttaaaaatattagttttgtttacacattcttctggtgtgctttattgtctgtagaaatgttaccctgcag

SEQ ID NO: 116227 - DNA, 1128 bp, Homo sapiens
tgattctcttgcctcagcctcccaaatagctgggactacaggcacgtgccactgttcccggctaatttttttgtatttttattagagatgggatttcaccatgttgtccaggatggtcttgatctcttgacctcgtgatctgcctgcattggcctcccaaagtgctgggattacaggcatgagccaccacgcccagccttcttctgttcttacatagtattcagaaatatacttccttagtgcctttgcttttttcctttcccacttttatctagagtagaattttttaccctctgtactattggcattttgggccagataatctttgctgtggtagagttgtcctctgcattgtaggatgttcggtgacatcctggcgtctacctactagatgccagggacctttcacctgccctgcctggtcctgttataataaaaaatgttttcatattcatatgtccactgagagtcagaatcattttacacctttccttttctcctgatggctctgtactgtgcagtttaggtttctcttcctggcagtttctgctgttgctttttcttggaagggaacctcattttgtttggaggtctctgatctttctgtggtccccttgcatttacctatgaattgtagcctatgaagctgcttgcctattttggttgtggtacattgatgtgggctgctgaatttggtgagtgagggggagaaggtattacctataagcaatttgatttctgcatgttctgcttttaagactgtttcaaatcccattcccttttttattgtgtctgataccatgtgaatcttgctgctgttggtatttgtcccactcctgagtattcatgatgaatacccggtcagtcaattgtgttttattttgtggccacattttggtttggtttgatctctttgatttattctcctagttgctctgtcttttgtggggtgagtattcagagatttaaaaaaatgttatgcttctttcattgccaaattgcccagaatgcctctgccttcttaaaatgaggattctaaatatgtgaaagacaacattttacgtgatgggtgatacttttgcctcattatggactataaggcagtcctagagagggagagattaaaaa

SEQ ID NO: 116228 - DNA, 1035 bp, Homo sapiens
ggcttgaatacaaaattattggtagagagattagctttgaacaggggaaaaggacgcctttttttttttccccagatatgttcatttttaggtctgtggttaagaggctgaggaatatcacatttggtattctcaattttcttagtaaactttaatttaactgtatttgctagagaaagggagataagtttagagggcttgaaaaaggtagtaaacattttggaatggtatgaaaaacagaagtgatatctaaccaaagacttggaagtaattgctaagtgatgctaagggccaacctaagactataaacttgaaatactccaattttatgatttttaatttttttttcagttttgtttcttagcaacttagatgtaagagcagtgaaggtggttttttttttttatattgacctaagattagggttttgtaggacaagtattagaacatgacaaggagataatgttgttgaggcacgataagagagtggttcaagggatgcactgtgtagtatagactgcatagggaaagaaataacaccatttttatgctgatggcttgggagaaaatggaggattcaagggaatctagatctcttgtggttctagagcaggtatgaggagagtgagaaagtgtgaactggatagaagattgaagccaagatattatattggaatttaaaatttcagagctagagcagttccagtttattgtaaagaccacattataggagtgtatactgatgaagaatactggaggaaataaaagtccggaaagggagtatgttgtgatatgtagcccatttcagatagggaaatcacctatgttgatggcaagagttgggctggagggaaaagtgtgaaccagatcagtagataaaagggtggtagggccgggtgtgatggctcacacctgtaatcccagcactttgggaggctgaggcaggcagatcacttgaggtcaggggttcgagagcagcctgggcagcatggcaaaaccctgtctctacaaagattgaaaaattagctgggtgtg

SEQ ID NO: 116229 - DNA, 1089 bp, Homo sapiens
ctggtgacatctcttatatttggtatttgtgggtgtgaatactagggattgggcaaacttctttaaaaagccagatagtaaatacttcaggctttgccactcacatattgtttgttgcatatttttatttgtttgttttcataatcctttaaaaatataaaaaaattcttttctcaggggccatactaataaagtgagcaagtgttaaacagtttgctgacccatggattatttttattacgaagtatctgtgactgtacttttctgtgacttgtatattttactttgtaaaatttatgtgtggtttttcagaccattctcttcctgtacttgagtaatagtagctttgttttgggaaatattaagaagataatacatactcccttttaaaatagtgtcagtataattgatttatgcttctccatatagcaattacttttacattgctgaacaaaacttttacttttttttgcggtggattcaagttgagtcagcagatactggagttatttgaaacatgtcagcagcaaataagtgatttaaagaagaaagaactctgtcgaacacagctgcagagagaaattcagctgttatttccacgtatgtttccctattttgcatgtcctttaggtatatgcattcctattttaaattttatcttttttttttttaataggcacagaaccatgcacctactttagattttaaatactcttattactttcttctgtttctttagaaagcagactttttttggttgggtcctctttaaatggatttggtacccggagcagtgatggtgatttatgcctagttgttaaggaagaaccagtaagtaaggaaacatttattccaagtgtgtttctcatgttaatgagttaagaaattttacataaaagtcattgagggaaaaaacttgctttgttgtgattacttctttgaattttgtttaccataattgcaggaaacctaggtaattttttatttttaaggcatgtgcacaataagcataataggaagtatagcattaatttaattctaagtttttaaagtgagatggcttcactatgtgtttttttttttttcaag

SEQ ID NO: 116230 - DNA, 1901 bp, Homo sapiens
agtttggatatgttaccaggatgcagcaaagaagagtatgtggcaatattatcttcttgatgtatttcctttccatttgaattctcactgattctatttttaatctttactttttttctctttgaaaatgcttattaagggaaaatagatttcactaaaatttaaaataagactcgtgtttattaaatttaaaatatttttctctatgaatgacattttgcctttgtttttttttctttttctttagcaacaatattgtgttaatttagtacaggttgagtattcattatctaaaatgcttgggactagagttttttggattgtagatttttttttttgaatacttgcattatacttaacatttgaacatccctgatgcaaatctgaaatgctccaatgaacatttcctttgagtatcatgtcagcactcagaaagtttcagattttggatttcaggtttttggattagggatgctcaacctgtagtatgtttacctgaatttcctgttaactgatactcctgtgtataatactgtagtaattggtattcattaagctgacttgaggcagcctttttaagatgctgaggtttcttctgaactaccaatgattaattaagctcagtgtaattttaatatgccttattatgttttacatctttaaaaatacaaaaaattattgagtgttaatgtatatttttactattcatattattccactagcgaaaatgacttctagttactgcaagtcagaaagagatttattccaggaagaatgatatttttctaggctttgaaatcatataaagagaaagtttaaaaaaactcacattataaacagtggagagtacaagggttgtaattaaaactttttcgtgctgctagattatactcaagcacatcccactcatcctctagtgttattcacatatctaaatcatgatgtcatagcttttacacaaactgaggcaccatagatatgaaactatccttgagcagcttaaaatctaaatagggctaaaattctgtttatttttgttggaggttgctttttgtacatttatgctgaaggggaaaatgacatagatggctatttcagaatttctttgaaaattgtgctttaagcttaaaatcaggaattgatttagaaatgtagatgtgaaagatagcattaaaggttgactttttctgttatttagaaaaataaattgaatatactttgagtatattgaaaaataactccaaaggaaagtatatcttgtatgttttctttttgttgagatactttaggaaaatgaaacattaaacttagaaagataatgaaaaaacactttatttttaacttttcagtgtttttttcaggtaaatcagaagactgaagcacggcatatactcaccttagtccataaacacttctgtactagactttgtaagtctgacatgcctcaagtttgtatgtcacctgacgtaactttacttaaaatgcctcttacattatcttctggtaagaactgtttattctggtcaggatcagtataatatgaattcttttttccaaatgaatttcttttaacttttgatgaaaaagaagagtgatcatttattcaacatatctttattgcacttactgcaaaatataccacctgctgcagtgggggggattcaaagatatgtaagttttagttctttttctcaaaagtttataggttgttagggaaattaaagcatgaatataaatagttgtaatacagagtatctgtgaaaagctaaaagccctataggactttatatgtgtgagagagaatttcatctggcttgcaatgatatgcatctttacttgttttaaaaatatcatcactgaacatgagacctaaatgtattacttcaacagaaagctaattg

SEQ ID NO: 116231 - DNA, 6255 bp, Homo sapiens
ctcatagagatcacacttatcgaatgcatccaagccccgtgtatcatgttgcaaagcatttccacacataagactctgtaattatgatttctacagttaccatgataccttactgtgtgctgtaccaaaattagctattccctctgctgctagcctagatatattttcactcttacagtggtctaatgaacttctctatagatactatattagatcacattcctgaaaataaccttaatataaagccccctaaatggtattactggagcctccaaccttagaagaatttgataatgtcctcacttgtattctttttcaaagacgttttcttaaattattttagcttagtaaatactattttttaaaaaatgtgcgttggaacactgtgaattctagaaacatttgcagctattcacattatcttttgtctttcagcgggctacattgagagacctcagctgattcgagcaaaagtgccaattgtgaagttcagggataaagtcaggtaaataattaatgagctttctttttttagttcctttagatcatttttagatactcatctgataaagataattaagaagtgtatgttgtagcattacagtttattttaatcagtttttagaaatcatttgacttggtgtttgaaatggttttttaaaattgagcaatactttatgcttaactgtacttagctattctgcttgacattttgaatatgtgagactatctaatttaaagagtacatatttgtattttagatttttaaatgatctcttgccttttggaagtgtaatgcattctgaagaatataattaatgaaatttgacatgtactaatatcaaggggtttgttttaaatacagttatgattaaacaagttgtgtttcatttttatgaaagatacatataatacctagagtaatagatatgaaaggaaaacagcaaaatatacttgttccatttcaaaatttacatttatatattctaccagcttgggttctgaatgtcttatgggcattggaattgttttgtaaatagatgttgattatttcattagttaaactgatttgttactgttttctaaaaatagaattgtgacagatttcataaaatttgtccagttttacaaaattaatactgaaattgtgcccacaaacacacacacacacacattgttgatccttatcattcatagtttgtgttttcacgaatttgcctacttgctaaaagttatttgtaactgcctacatgaatattcatacgcttttgtggtcatttcgtggacatacacagagtaatgaaaatttcagatcacccaataccatgtttccagctgagatagaattaggtgacacactgtcttcttgttcagcttcatactgtaaacaaataaccttctcacagtctaattaatgccatatttttcacatttttgtgcttttttgctatttagaatggcccccaagcatagtgtggagttactttctagtgtccccaagtgcaagaaggctgtgatggtgccctatggagaaaatatgtgttaggtaggcttcgctcaggcatgagttatagtactcttggccatgagtccactgttaatgaatcaaccgtatatattaaatacaatgtcttcaaatagaagcacaacataaaacttggttatgtattgatgagtttatgaaaatgtgaccaggctggcagatacctaaccctgtgcttaccctaggagcaatggtatagtattcactaattcagtgtttgcagcaactttatagaacgtagctactatgaatgatgactgaatatatatattttaaacaaactttaatgcctggctcaagccattcctttatatatctaaacatcaatcagatctataaatacttattaaatttctgccaagtaaattgtgtcagattttcctaaagcagatataaaatatatagggagataaaacataaagttataatattagctaattataagtttttaataatatatggttgtagttatagttacaaaggtagttttattctttttctatttaagatcatcctgcaaactttttttgttcctaagctttttttttttttttaagagacagggttttaccatgttgcccaggctggagtgcagtggcatgatcatagctcactgtaacctcaaatgcctggactcaagtgatcctcccatctcagcctactgagtaggtaggacaacaggcacacaccaacacacttggttaatttttgtatttttggtagagacagggtctcgccatgttgcccagcctagtctcgaacccctggcctcaagcaatccttctaccttagcctcccaaagttctggaattacaggagtgtgccgctgcacctggccaaatcctgcttcccaacagaaccatatctcatgaatatttggttatatcattaaatagtgttctacagcatcatttttaatggctttatagtatttcattgagtgaataaattgtcattaacttaaccattctcctgtatttgaacatttggtgtgtttctggtttttagataatataaataagtattttgtgcataaatgctttccatattgaggatcacttttttagtatttctagaagtagtgtttgaagcaggaactgtggatatttttaaagccctgaattcaattttggaaaaatttttaactgcagactagttgccatctatgtgtttttcttttctattgagttactatgtggatgtagtacaaattggcttcagtgttagaattacacaaacacaaagaataactctattattactgtaagtttcccaaagccaaataacgtataatatctgaagtgttaatactactatccatttttattaatatgcatggataatggaaagattgtaagattttcttttgttccaccaaataagaaagactgaaatggtagatttcaaattttatacttaaaagctataattaatatagaaatattttgtttttattttagacagtcttttcacagaaaaaattagtatttagaagttgggatctcgcataggtatgagtagaactgacttacataaagtaatccttaattttttatgagtttagccattttttatacattgcatcattattgccgtattttctaaattatgaactgcatatatttgctttcaaagaagtaatcattatgtgtttgagtagtatagatagctcttcccaggtatcaatagccaaatttgacatgatactgtaatttactagcctttttagaggaaatataatgtgtagacagagcttttaaattatttcccctgtatttaatttggctttttattcctgttgttttaaagtatatgatgctataattccagattatttgagagtgtataacttaatgggataacttgctcagaaatgtttttggtcacatagttttgtttatctggaaacttgtgagatttaaaaattttcggctggatatggtggttcctacctataatactggtgatttgggaggctgaggtgggggaattgcttgagcccaggagcttgaggctggagtaagctatgactgtgctactgcactccagcctaggccacagagcgagactccatctctttaaagaaaaaaaaaaagatttaaaaattttatttggggtaattggagccttagcagtatgttactgatctttccactggaatcttattttatattttcagtactcatcagatcacattgaaataacatactgagtatttgttcattcttatttctttagtgtgtcattttaaaaacacagatctatggcctttgggcccatactattttgcatcatgggatggatgagcattaatttagttattaggaaggaagtttttttgttcttcagctaaagtttatttatttatttattttttcttaaatagttgtgtggagtttgacttgaatgtaaacaatattgttggaataagaaacacattccttctcagaacttatgcataccgtaagtttgttgtttgtttattaaaaattagcctttttttctttattcatttttaaagatgtttggcataaatagtgacatctctttagttgtgtttaagtatagtgtatcttattttatttgtatatgttgctacactaaaatcatatactgtcagttataggtgaatcaagtggcattttaataattgataatttttaaaaggtaactaaggtaagttttagacataagacacaaagtgaacagacacagtgtttaatatacacggagacagtgttctttgttttggtatggagctgggaaatgatgtaaactttcaaagaaactataacgtctcttaccatgttaagttttaattttactttcagttgaaaatcgagttcgtccgttagtgctggtgattaagaagtgggcaagtcaccatcagataaatgatgccagtcgtggtactttaagcagctatagtcttgtattgatggttttgcactatttacaaagtaagtataatggggttttacccaatttttaaaagtaaaagacagctttattatggtgtcttctctgttgaccctattttcaaatagtattgttttaaaagttctttctaaggtccatgaaacacatttcctgttttgttgctttggacaaatgtttcagaagtgttattccttggaaaatatagaagtttcactgtttttttttttattttttggaagtttttctatagtcacttttgttttcaaagaactttcaccactgtattgtggacccattatcttgaagcagacgaatgttcaaaaggcctataaaagttagctcaagtactattcatcatatttttaattttgaatttgagacaggaattaaattattttcctgttggttaaagaagcttttaatctctgagttgccctccttaactagattttatcttcatagggctgttttatcagattggctcccaaattttaattttgtctggttagtcattgtttatgaggccattctggtaaaagctatacttttgtcgcatgcatagtggcaaacagtaataagtgaacacttgtaatttggaccattcataagtgtgagaatttttacggtactgaaaatttcctagacgtataggacagactgactggatctatttgaaacccttactttcatatttctcaaaaatatcttacatatgtagcaatccaagaaataaacattaagctgctttatactttctacttagcctgacaccaagagttgttaaaagatggatgcatctactgttttgtagttattagaccaggagactgagatgtttaataactaaccaactgaacatatgaatatgtggtgacatgaagaccgagtgaaagacttggtatgaatgtagtagaagaccgtttgccaggatgtctggggcttgatctgttctgggttggtgatacttccacagtttagagtcttggtttccaaagattacaataataggagaaaacatattttagcatatataatactcatttcttcattctatgaatatgtatagaatacctaccaaataaatgctaggtattctaggatctgagaatacagcagtgaacaacatacaaaaacaattaccttcttcatgaagcttacatttttgacttgtaaaatgtcacattttcatagctgttacctaccaaaacgtgaattattaaacaactcacagattactaataaaatgtgacatttttaccacggttgtgaattgagctgctgatagagcactatcaacatgtgatatgctcaataataattattacagtgtagtcattaaaaaaaagtattgaaaaatatccttttattgcattgtttggtgctccttgtatttagattctgagagggataacagataatattagcaattttgtcaacagcagcttgggcttggaaagttgagatgatttgatgcccttatagctgtgtttctgtactgaggatactgggaactgggaaaagaagaaggcacctttccttatgctatagatcaaaaatggttagggttggggattacaattttgttaacctaattcctggtagactgggcttctttggatagggattggaggatgatacccaaattgagaatttctttatagtgagtcacttttactagtataggaggatagatagaagtggttgggacaaaaacaaagattgtcttaccaatgccttaaaaaagagcagttcagaggtgagattggttgtca

SEQ ID NO: 116232 - DNA, 1065 bp, Homo sapiens
ctgccataagcagagaaaggaaataggtcctctgtatgtagaaaaggttaaaaagattaacacatttcctagaataaattccagtagtcaataattgactacagatacttgaaagatgactcatcaaagcatgagggggaattgagaaaggattttaattataatttaagagttaatgaaaaaggaggccgggcacggtggctcacgcctgtaatcccagcagtttgggaggctgaggcgggtggatcacttgaggtcaggaattcgagactagcctgaccaacatggtgaaaccccgtctctactaaaaatacaaaattagctgggcgtggtagtgcacggctgtaatcccagctacttgggaggctgaggcagtagaatcacttgaaaccaggaggcggaggttgcagtgagcctagattgtgccattgcactccagcctgggcaacaagagcgaaactctgtctcaaaaaaaaaaagtaatgaaaaaggtaagatcatcaattggctagaaataataacattaatgaatattcatggaatgtttaccatattcctaggcatacagagctttctggtagacattttaaaattgtctttgcagagcctggccaacgtggcgaaaccctgtctctactaaaatacaaaaaactagctggatgtggtggtgcacacttgtcatcccagctagtggggtggctgaggcatgagaatcacttgaattcgggaggtggaggctgcagtgagcccaaatcgtgccactgtactccagcctgggtgacagagcgagaccctgtctcaaaaaaaaaaattaataaataagtaaataaagttgttcttgcgctttcaaaattaatgattcttagtgtgattgaagacctgctatttaaaatttaaatttttggtacatctatatggaaagtttatgggtataaatttgtggggtctctaccagcaagctgttatggaaactatgggcaaagtaaaattttgtagattagctgtattcaaggcattacctattaatcatgtattctgataatgagcttttgttttgtttttact

SEQ ID NO: 116233 - DNA, 1401 bp, Homo sapiens
gaacatgcacacataccatggaattttattttatgccagttttcaacatggggatgaaatgtgatacataaaggaaatttaaataaagcatcctactttgtactgcgtggtaaaaatttatacccttttaattatagttggagaccgtgtaagttggtcataatggttcattacatttacattaatagatttcagaagtcattttttaaagtttttgctaaatcatacattaaaagtgaattaatatgctttgttattgagtttatgtagttgttatacatagtgtattcctaattcttaaatccttcctaattcttaaatttgaaaatgtattacttgtattttaccatactcatgacattatattttacagttatttcttatattgtgaatgttaggcactttacctttttatattgttcttttcatattaaaacaatgtaaaattactgttaattaatgagattggatttgtttaaaacgattggtgaaggatgacacaaatatggtgataacatgaggatataatttctttgtatgaaattttattaatagcagattgtgcccttagttttctgacttttgctgagcattctttaaaaatgtactaatgaggttaaagatttttctttcatttttatttgattttttttgttgttatttgcagtatatcagttttcctgaacgatttcaattttggtattgttagtggaaattaaataataaagggacaattatgaaagaactatttttatctcctagtgtcattgaactgtatttttaaaattgtagtttttgattgctacatccatcttaataatgtctattcagtatctgtagagcaatccttgtcttgcttattgtgtgtgtatgtctgatgttggacaaattatgtatgtccctttattgatagcctattattctaaaaccatgtgaggaacattgatttacatagggatatatgtagtttattaataaaaccttagtttgtcaacttaaatatattttaaatacaaacttagggataagaattaatttcatgaaatatttgaaaattgttgaattttagcataaacccttatggtcttatacctgggatgtagctgacaaattattgcattgtaaaatgagtcacgtgaatcacggaagctttaaactttttctttttatagccctacctgaacccatccttccatccctccaaaaaatttacccagtaagtgtttcttataaattattataatacattttatgtcaagtgtatgtagaactattataagtagtattaatgtgattataaaagtagtaaggctaagtacatgataacattttctatatataccaagagaacatttaaaatgtttcatatactgtttcagaaaactctcttacttgttattt

SEQ ID NO: 116234 - DNA, 2800 bp, Homo sapiens
tatgtattcataatctataagaatccttgtgtttctttttcagttttcatgtattctttctccagaattctctgtttctttgttttatatcattagtgttttcctccatagtcattctttttcctgcatttatttggaaataatatttaagctacttgtttagaatgtttgactactcttctgaaaccacgtaatttttacatattggtttcatatacttataagaagagctgtcttctaaacttactaaatggtcatatttcaaagagaaatatcaccagcttagatgattaattttcaaaaaacttatttattgtgtcacacaaaatataacaaatttacttgacatggaacatcagttaaatatagtttaatatctgataattgagaagaaccaatgttcttggttttgaacataagttattattgtaatgcacacatgcaaggtgctggataataaacgttcattttaatacagccctgctgtggtggagatctcacattctgtggaaggtcatctgctaggagagactgtataacaagagccttttagaatcttgctatctcatcttcctttttttaaactagtttctgctattatgaagaattattataatgagtttccagtatagctaaggatcagtctttatggtctcttaaacattatgaaaaatgaaagaaagaacagaaatagaggtaacttgaactttttggccttattcttttgaatctttttatttattcttttttttttttttcttagagacggtcttgctgtgatgcccagtttggtctcaaatgcctggcctcaagcgagccttctaccttggcctcccaaagttctgggattacaggcatgagccactacacccagcctgttggccttaattttgaatgtttttctctctccataaagtattgactctcttgtttgtactgaaaggtcatatttcattttattgacccaacctcatcttgctttaagacacaggtgtcagtgtagaaagagttgcatatgttctttagcaaaggagctaataaacttatcccaaaataatattgtgtattgaaaaatgcttctgcagcagtctcacttaaaaccctatgctacatgaagctctttttactaatataggagactggcgaaatatcagtgtactgtggttggggtcagagggaatgctttcataatactcagattcttactgacggccccattttcacttctgtgttctgtttttcttattagctttctcccatgacagagtcctgacttctgttcatatccactacctctggccctatgctttccatctgttttgcttgtaagcttatttctatacctgtaatggggaaatagatttagccccaaggccttaaaaaatactaatagcaagacctgcgagattaggaatctcctaatttgcatttacatatggttacattgccatcataaatatttaattaatttacctttactataagatttttgtttacatggatagggacttactacctgttctcacacaagattttttgttttatatgaaacctgtaggctggtcagcagaacacatttttaatggtccgtctgatggaacaaacaagtcagcttgtttgctattattaataataaccatccgggcgtggtggctcacgcctgtaatcccagcactttgggaggctaaggtgggtggatcacgaggtcaggagttaaagaccagcctggccaagatagtgaaaccccgtctctactaaaaatacaaaaattagctgggcatggtggcaggtgcctgtaatcccagctactcaggagggtgaggaggagaattgcttgaacctgggaggcggaggttgcagtgagcccagattgcgccactgtactccagcctcggcgacagagcgagactctgtctcaaaaaaaaaaaaaaaaaaaaaaatgtatatatatatatatatatatatatatatatatatataatagccatcgtttatttagtatccattatatatgtcagcatactgtacattttatacacaatttaaaaaatcctgaacaaataaacttgcaaggtattattcctctttcactaatgaagaaactgttttagaaatgttacatgattgatacaagtggtactaacaatttttccattatactctttcttgggggaaggcaaaattacagtagtattcactaacattttatctaatttctgttgcttattacattttatttgtatacatctgattgttcatatacagatatacctttaagggcagcagttacggcagaatttcagcttgtataaataagtttaagataagttaacaacaacgaaaaaacaactttgttactttacaaaggaaaccgcggagttcttttaaatttctagcttctctaatacaaaatagggtttatttttaaaataagagaaaacagttttggaatggaataaatttgttcagtatactatgctttttagtcattttcatattttcaaaatttataacattttaaatatttttaaaattggtatatttcagttcagttgtgatatgaaagggataaaaggctataaacatcattgtctctaaaaactgtattatagtatagaattactgcttattactaaattcttattgacttaacgtagctgatggaggggtacgttattcagttgaataaatgaagctgagaaagttaaatatataaacagattgagcttatgaaggaatctttattttaatgcaagcatattactatgagggttaacttaaatttatgctaggtagattt

SEQ ID NO: 116235 - DNA, 1022 bp, Homo sapiens
taatatcctcttttataaatattatggtaaaagcttgctgaatattgcttgttggtatgtttcctgtctcattttccctgccttctttgtcttttcaagcttaattcaggttgaacatctctcttcttttccatctaagatacagaaacaaaagaaagcaaaatttataaaatcttaaaattagtataagtactatttctatattaaagttactcttacggcctttgggagaagtttgaagtgacagaaaaaactcttactttgtgcttgatatagcctttatacatgaagtataactgctccttgtaggaataattaagaatgagataacctttgtgaagaaatctatatggtattgggtagatcttggtttgtatagtaaggttttatttatgagttagaaaatcttctgctaaatagcgatctgtttggttaactgagtgatatactcaagccaaggattagaatgttagtttttcaggtacattctggtctactgcaaatactggtgaagtctttagtggaagaaaaatttcaggtttccaaattgccaaatagagtaaatttcttctctctttttcaaagaggagcctagttcaggatttataaagtttcttagtgtgtgttttaaatggctttacattttttccccttcttctttttgacaggagtcttttagtcctgctatacagctgcaccttgtacatcaagctccatgtaatgttcctccttacctctcaaagaatgaatcaaaccttggggacctcttactgggctttcttaaatattatgctacagaatttgagtaagtaaaactttaaattgtgtttgttcacttatatgtgtgtgtgtgtgtatgtatgtatatatatgaatacgaatatataagtaaatgctacagatttagtcaggagctgtgtttgtcacttccagtgttgtaaagttgtccagaaatgtatagtttataaaatttcctatgtgacaatgaattattggaagctagatagattttatattcttag

SEQ ID NO: 116236 - DNA, 1093 bp, Homo sapiens
caggctggtctcaaactcttgacctagtgatctgcccgcctcagcctcccaaagtgctgggattacaggtgtgagccaccgtgctcggccacggagctttcatttatattaagatgaagaaagattaaagactggatgagacatagtacataaatagactgtgaaggtttaatggttattctagagttctctttaagatattgcaataacaatagctaatgtttagtgagaatttatctagtgtgctgtagtaagctgagtgattcccatggatttcagttaatcctcataataacctctgtcaagcttagggaatttgtgtacatgaaacttgcccatggcaatctacagctagattgtgggagagttgggattcactttcaagctggactccaaaactacattcttaattgttagactgtattgacattgtttattatgttatataaattagggactgggggatgtttgtggagggggaaaaggattcacagaacaaagataacttttttcccatgtatagtgtaggattagagcatctgtatacaaataccttgaaaatcacctgctttgttgaacagaaacaagatagtggatgtgtaggtttgtatgttaatttaatattaaaggaaactagtctgctgggtcagatgatactgatgcttggaaagaggtttcagaacttcaccatctagtacatttgtcatttcatatgagatattttcagaaatttgaaatgtggggatcacagccaagaatgtagtcatggtaataaactagaagctgtataaaagaattatggcaattgttaaaaatgtctataaggatttcttctgaactttgaggtaatcatttaaaaagttcttttttctttttctttttttttttttgaaacagaaccttgctctgttgcccaggctggagtgcagtggtgcgatcttagctcactgcaacctccgcctcatgggttcaagcaattctcctgcctcagcctcctgagtagctgggattccaggtgcgtgccaccatgcctggctaatatttttttgtatttttagtagagatggggtttcaccatattggccaggttggt

SEQ ID NO: 116237 - DNA, 1373 bp, Homo sapiens
tagaagattacttctgtcttaacaaataacagattgttactgcgttgttaactatgaccatagttgtttttgtttgtttacttgtactttcttttcttttcttttcttttttctttttttgagatggagtctcgccctgtcaccaggctggagtgcagtggcatgacctctgctcactgcaacctccgcctcctgggttcaagcgattcccctgcctcagcctcctgagtagctgggactacaggtgcacgctactgcgcctggctaatttttgtatttttagtagagatggggtttcaccatcttggccaggctggtcttgaactcttaacctcgtgatccacctgcctcagcctcccaaagtgctgagattacaggagtgagcctctgcgcccagcctgtactttcttatttttccagttacttcattttttcaataaatatgtgttgaaaacctggtatgtactatgcacctaggtgaagagtgaaaaaaagaaatatccagtatcttggagctttcatcctacttgagggagacacaatgaagaataacataataaatagtaaatgtaagaaacaaattcttagaagatgataagtgttgtggaaaaaaaaatatagaggtgggaaatagggattgtggtgctgagggttggggcacaggtttcagtgttccacaagaaaattggggtaggccttagtattgatacaataaaaataatataagagaaattatgaaaatagttaacatggttactgtttttcttcttatagctggaatagtcaaatgatttcagttcgtgaagccaaagccattccaaggcctgatggtattgaatggagaaataaatacatctgtgtagaaggtagttttctgtttaccatctacgtatcatcatggtactaagagaattacttgagtaatttcagctgtgtttcagttaaaagtaatacatttatgtctgaagtgatttgtaagtcttttagtttaaaatttttaattttaaaaagtcatttaaaattttttaggtatgagaaataataaacataaactttaggcattcaccctttctagttggtaagattcgagctgtctttatccctcttacttgtggttgatggataatttcatgacttacagatggaagaaaatagaatctttatatgtgattcttatattgacataaaatgagttatattcttttatacttaaaatattagtgcaagttggacttttattaatagaaattgatgttgctttaaaaattaaatgatctgaagaaattttcttctctaaaattaatttacatgtagttgaatatatccttgagacactttgagtgagtagaaaactgacttcaagggacaaaatt

SEQ ID NO: 116238 - DNA, 1475 bp, Homo sapiens
gtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggacattgttgaggtgccttttttttctgtgaaaatctttgctttgagatgagaccgaggctgtagttatca

SEQ ID NO: 116239 - DNA, 1133 bp, Homo sapiens
ccttggaaatcatgaaaaataacttgccagagtttgcatcagccctcagtaagtcatgaaccatagagaaggtcatggggccatttattctttggaccactggctacttctgaagttctggcttccttctctctaggaggagtcgtgtattcaagcttttaagttaaatgcataaaaatgagttttacttctcttctgacttgatttttaattttatgaaatgggaaataatgtttttccatttttctgttcattttgaagtgggaatttgaggtgtttgtaatgtcatgttactgttctgaaagattgacagtaaagaagacaagaaatatatgtatgtagtatgcatattagttttgtcccaccaagcctatctttgaatggcaaacattttaaaaacatctgttctagttgcacaactactctagcttctttataaagtaaacaatcttaaagtaagcaatgttggccataatttcaatattctagccttgccgagtgtgaatatattttactcagagactatgtacaaatacactaaagtggtgatggtgatcaatattgtaaagaatttattctgataaatgagaaactggatataatgtcaaaatagctattttctcaataaaaatctcaaatctcctgactgcttatgaattctcgatttaatgttatttattctttgaggtaaatcttttcatcgcgaagaattttttgctggttgaatgtggttgttcagggctgggactgagctatagacatagtgggtttttaaaaaatgtccattctttttttttttttttgagacagagttttgctcttatcacccaggctggagtgcaatggtgtgaactcggctcactgcaaccttcgccacctgggttcaagcaattctcctgccttagcctcccaagtagctgggattacaggcacctgccaccttacccggctaaattttttttttttttttttggtatttttttttttttttttaagtagagacggggtttcaccatgttggccaggctggtcttgaactcctgacctcaggtgatccacccgtctcggtctcccagagtgctgggattacaggcgtgagccaccgtgcctggccagaaaatgtccattctttc

SEQ ID NO: 116240 - DNA, 1024 bp, Homo sapiens
agctgtaaagaacattgaaggtggtcattccttcaaaactgtgttttgaccacacaaggtgggcattaacaaaccaaatttcaacttaagtttgtttgtattatattgggggtgctgcgagactggagattttataaaagcaagcatttttatttccatttataatttctattcaatattgctagatatattaacatgaaggaatggggaagcttatttcaatcaaagctaaaattttcagaagtctgtaaaaatggaaaaacaccattgaaagaggcagaaacaggtaagggggatagtatcttagaaaacctgttggttaaggcagctgcatgtgataaaagtggtacttgaacttggtagtgtttccttagaacctcctccaaaaatatgcatttaccaggcttgttacaattttttgacagtttttcatcaactgtcaaaaacttcaacccttttaaaacctagatataaatgcttacatgtaaagaaaggaagctaagcagtgggtacctgggatctctctgaactatttttataacttcttgtgagtcttaagtatttcaaaataaaagtggttttaaagtaaattcatagattaaatgtatcattatctatatataaaccatgatttaaaactttaattttctaaacatagtattcaacttagttgaataaatatatgatagaagttaaatagaatttttatttcattcttaagaaaaactcatgtttgtaacaaatgatatctaaagatctattttgccttaccagaaaagaaaaaaaaaaccctaaaaccaaaaactccttttccctaggaagtcaaaaatgctgtgatttaaaatatctaattatatttttttctttctatggtagtggggtttacttctgaggataaaatattttgaaaaagctctgtcccttgacatggtagttctcccgtgccttgtacttgttctctctccatatgcacagtgtgacaagatgctcacctttaatgaagaaggtgtagcttttcgtttta

SEQ ID NO: 116241 - DNA, 1088 bp, Homo sapiens
tgtctttgtagtacatcttcagttgtctttcttgtattaattccagaagaagtgaatgtactggttatcgttactatgctaggctgtaaaattcttactgaaattgcccacttgttagacactactcaggaggagcccatggccagggtagtagaaatactgtgcatctggtccaagttttctatgcttggctcatattctttcataagatgcatattctttcataagatgcatatcatgtagtcaaaagctttctgacaaccaattatttttcatatgtttcacttatagtcgaagaatacaaaggaacaatcagaaatagcagcttttaatgaatattttctatttattggttgctgaactgttaagggatttgctgtgtggtaattttacttataatagaaacttgcttattttagtggttgaggtgcttctgttgtcctaaaactacttctgaggtttttaaaatgtagaaccatgtttttgattagtgtcttaaaagattactgtggtgctcagcaaatcttatcaagtcgtgcaggaacccatatgttaagaaaatgagctttgtagtcaaaagactcatctaatttgagctgagtggagctcagctgtgtttgacccacatcctcccaatttgttctgtatttaggtagttatttatacaagagtctttaagtcattctaaatattttttcttgaaagttttaactaagtgagaaataaggtagtcttcaaaatcttggtcatctgtttggatgagggaaagtacctcatgagttgcacattacttctacaacagggtgtgtgtgtgtgtgtttgtgtgtgtcagtcatcttcaaaggcagattattagattccagcaatctgaaatctattattccagcagtctgaaacctaaatatgttatattggaaatcatgactgtgagactttattgtcctctaggatggatgtatattggagaagggtggttagcacattcatcagacatctgcttatgctgtggtcaaggccagtcatttttaatttatatcagatttatatcagaccctccaaaaagtatttgaaatatattacagttataa

SEQ ID NO: 116242 - DNA, 1038 bp, Homo sapiens
tagtaaaccttttaagagactatactgtgtaattcagaattgagaattttgaaaaaaaaattaaacaccatcccaagttagtattttcttatgtgcttaaaaaaatccttaatttaatttttttttttttttttttttgagatggagtcttgctcttgttgcccaggctagagtgcagtggcatgatcttggctcattgcaacctccgcctcctgggttcaagcaattctcctgcctcaacctcccaagtagctgggtttacaggtgcccaccaccacgcccgacttcttttgtatttttagtagagacagggtttcaccatgttggccaggcttatctggaactcctgacctcaagtgatctgcccccgcttgatctcccaaagtactgggattacaggcatgagccaccacacccggccttcagttaatattgtcttatgtgctttaaaaatccttaatttatttctaggccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggaggtaagctggctctttttcagctaatgtttgtttgcatattctcctatgtatgtataagcaaaatccactacttattttaattttagaagtttgtgtattgtctttaaatagtggtttatagcacttcaaggatttgtgtttttccgacttcatttttattctcatgttagttcttatttaaatagataaatagatatttgccttttatctattccgctggatttttacgtttcttcttcttgttctttaaatattacccctttgaagtgggtcattttcttctaaaaggttaaaaccacaggtattaagtctttgctgaaaaacagtatttatcctaatgcaaatggacaattactttaaatgatttttacctgctgcttctagcattttcctgcatgaacagaaatca

SEQ ID NO: 116243 - DNA, 1049 bp, Homo sapiens
gttttatcctgagtcattctaactggaaaatttgtatgaagacacttcatataaagatatttatgaaaaactctcatgttgattgagtgatctttcatttaataaaagaacatccttgtagtgttttttctcttcttttgcagcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacaggtatagtatggattattcttcaagcaagggccctagagagaaaggacaagataaaatgcagacttgagtttacctagagatgccttcctcaaaagtagttttagagtatcttttctacttttgagatataatttcatccttattagatatacagagatgccaaggagtgcctaaatcttctatcaaacagattgggaacatctcagtttttctttggagatacgtgagtattcccttaaaaatcattttggtattttgtgcacatatattcagtgagcagctatttaaagcaagtcctcttatctccccaaaagatgagttttttacttaaaaaaaacaagatttaggccggtgtggtggctcatacctgtaatcacagcactttgggaggccgagttgggcagatcacccgaggccagaagttcaagaccaacctgcccaacatggcgaaaccccatctctactaaaaatacaaaaaattagctgcgtgtggtggtgggcacctgtaatcccagctacttgggaggctgaggcaggagaatcgcttgaacctgggaggtggaggttgcagtgagctgagatcacgccactgcactccagcctgggtgacaagagtgaaactccatgtcaaaaaaccaaaacaaacaagaaaaaaatttaatgggcttttattataggaaactttttctaccagtgataatctaacattgacttaataggctg

SEQ ID NO: 116244 - DNA, 1032 bp, Homo sapiens
aagcaatgtgcccgccttggcttcccaaagtgctgggattataggcgtaaaccactgcacgcagcctaccctctgcctttttaagatgatgtatttatttaatttttgccatcattggtgcttcaccttcctgcgaaggaaattccagagcctgtatttaagctacctaggcttttacactccctttattgcctttccaaatagtatctcatttggtgtactctagtgtcctatacctcttggaaacgaaagagggcccaacctacaactaagaagggacaaaccttgaactaagtaagaccttacacacccagaaagaacactgggccctccttcttcagggacaatgcagtagccacttggcttgtggaatttactgaaggctatttcctgtaacttgctagttaacttagttttgtatttcaggcagaggtgcgctctgtaatgttgggcctttgacttcacagtactggagagctgttcacacagatgtttagacctttctctctctctctcttttcttctttctcaacaactctttcacagaggcagtcattttgaaaggttgaaatatttggcctttaccaaagagctttttttttccttaagcaaaatcctttcagaaagaaacaaatggggaagggcagattaagaatgcatatgtcccaatccacttctataggagtttaatcatattcacatgagtaaaatgatggaagaactctttaaggtaatcctttgggataaaggatcctgggaagttctctcaggtaaagaaagcttacagcagatttgtaatatatgtctggagagctatttataagaaatttaagaggattgttttgttttcctttattaaagatttaagcctttttactttgcaaaaagaaaactacaaaagttttatagatataactttgctaattttttaaacttttctgaaacgattagctgtagccaaattatgtggttacgttttgctacattagaatttgaaaatgcaatatgtgtggtaaatctactgtttgaaat

SEQ ID NO: 116245 - DNA, 1080 bp, Homo sapiens
gcaatgtgtggaagtggccgaatatacttaaaaagaggtgcgcagaggcaggcggatcacttgaggtcaggagttgcaagaccagcctggctaacatggtgaaaccctgtctctattaaaaatagaaaaattagccgggcatggtagcgtgtgcctgtaatgccagctactcgaaggctgaggcatgagaatcacttgaacccgggaggcggaggttgcagtgagccgagatcacgctgcacaggaatttccaaaatacgtacttgcaaagtaatacagaaacgtgactttcggcagctacccaagatgatgcctattttcagtgttgatgtattcaggcagggaaaaggtttacttggtggaaactcctgttagaatttcattcggggtggaaagaatcttctcgagctctctgtaagtgaggatctaagaataaaaggctcagcctagtcatttttttctgtgccctactgtatgagttgggcagaattgagtgccacctaagctgggcttctgtgtgccaaaatgctggtgggtgaaattagtgaaattctttctattcattcctttgcccttctcccaagaaaacccatggggaaacaaattacaggggatgaattcctttagaactttccctacttagagtgtttgagattcagtttcaaaaggcactccatctgtgtgtgtggtttagagagccttgttttgtaaattccattaaatttccttttttagggcaggagctctgtactcagcagttaaaagattcatctggagtcgcaaaatgaaaagccgtgttctaacctgaggaatcagttaggggacaggagttccgtgggccaggaatgggctcagggagtggggctgcgtgtcacacacagtagctgtgttgcagtggcctagggccttgggggttgtctttaggaaacaccctgaggggaagcaggtaaagagcctgggcagtattgtgactagtttcattgttttcctcctgctgaggtctagcagagcccttgctttgtcctctcggctgggtctggctgccagctggtgtgatttgagaaactgaccttacgcgca

SEQ ID NO: 116246 - DNA, 1115 bp, Homo sapiens
ctgaggtgggtggatcacctgaggtcaggagttcgagaccagcctggccaacatggcaaaaccctgtctctactaaaaaacaatacaaaattagccgggcgtggtggcgtgtgcctgtaatcccagctacttgggaggctgaggcaggagaatcgcttgaacctgggaggtggaggttgcagtgacccaagatcatgccactgtactccagccggggcaaaaagagtgaaactccatctcaaaaaataaataaataaaaataaatgtggcattaggtaactcttcctgttacggaagttgctagggtggagtgggggttttgtgcttagggcacagattgaagttgccagagggtacagatggctttctggcatcttttctactgacagccctgtagaattagcgagcgtgactttgctgaatggtaaacacacacattcactcattgagcctgggctccctctgtgcttcacagacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaagtgagtggcccatttgcttaggtatttttgaagcaaagccttaaagttaagagttaagtactgttcgtgtttgtttgtttgagaaggagtctcactctgttgcccaggctggagtgcagtggcacgatcctggctcactgcaacctctgcttcccaggttcaagcgattcttgtgcctcagcctcccgagtagctgggattacatgcatgtaccaccatgcctagctaatttttatatttttagttgagacggggttttgccatgttggccaggctggtcttgaactcctgacctcaagtgatccacctgccttggcctctcaaagtgctgggattacaagcgagttctgagttttaacagtggatgggtatgttttaaccctggaaactggtgatgcttatggcaactttaagaaaatggaaagttagctctatatggacagtctggaaaacatggtaatgaaggaaaaataggaactcctaagcattcatctg

SEQ ID NO: 116247 - DNA, 1065 bp, Homo sapiens
tggagatttcaaagattttaggagttgcatgcaagtaaatgcgaatgaagaccaaatatatatttcacaatatcacatgtagccactcacattaaaaaaaaaacacacctcaggagtttccaagttacagacagaaagataccacgattatcatatcacttacagcaaaatgacttctcaactagtttaggagctattgttggctgttgattcacctcagcactgcttggtatctgcaccctacctctctttagaggctgccttgtcaactgaaaaatgcacctgacttcgagcaagactctttccttaggttctggatctgtttgagccccatggcactgagctggaatctgagggtcttgttccaaggatgtgatgatgtgggagaatgttctttgaaagagcagaaatccagtctgcatggaaacagcctgtagagtagaagtttccagtgataagtgttcactgttctaaggaggtacaccacagctacctgaattttcccaaaatgagtgcttctgtgcgttacaactggcctttgtacttgactgtgatgactttgttttttcttttcaagttctagatgaacatgggaaaaatgttacaatctgtgtgcctgactttggtcaagacctgtacagagatgaaaacttggtgactatactggggaccagcctcttaatcggatgtatcttgtattcatggtaagtcttgggagttactcaaggtcacttttgcagactttaaaattacaggaaaagaattgaaataactttcagtagctgtgaggctgcaaccatttgaggaggggggaaaataaccacaagtaaaaaggcgaagagcgtgaactcatatttgaacttcgttcaccttacttgtttttatttggggtaaataaagcaaatatatggtatgtaaatatttgaacttcgtttaccttacttgtttttatttggggtaaataaagcaaatatatggcatgttgcagcaccgttgcctaaccccctttaaaagatggtcgaatagtagtttgctatacctttactggagggcaggggagcacaa

SEQ ID NO: 116248 - DNA, 1040 bp, Homo sapiens
catgttcttgcttaaaagtgggagctaaatgatgagaacatgtggacacatagaggggaacaacacacactggggcctatcagagggtggaggtgggaggaaggagaggatcaggaaagataactaatgggtactaggcttaatacctgggtgacgaaataatctatatgacaaacccctgtggcaattttccccttacaacaaacctgcacatacacccctaaacctaaaataaaagttaaaaataaatgaataaataaataaataaccttaaagccattctcccagtgaatgctgagccccatagccttcctctttagccaagagcagttcttgtattctgtccccaaaagctttttgatcattggcaggtaagagctttttgccctgtcatagactgtagtatgtgatgaccttgtagaatccagaatacatcccctatgaaatctggtttaccacttactcccctccccaattaagctatgtggttttatcaacaactatggtaattttttttctgatcttgtgatttaagaactaatgttacaaacctcagggagactagttagtgtgttttaagtgtagccataggcttgataaagtattggtagataacttggcagaacctgatgtctttgaagtagcaatgttcagttcagcgtgtaactctctcccccttaatatctttttagttttatctgagaaacatactacatttttttctcttttctttcctttaaaggtggatgctcaagtttgaggactgtcatggggactatcaggttttttaggcatgtgctttctttttcttcaaattaaaacctgttgtctgtctcttgtcacttttcaggacagccacactcggggctcttacaatcaggggtcataagctgctatgtcacctacctcaccttctcagctctgtccagcaaacctgcagaagtaggtaagccagcctgttagtgggcttgtgtttgcggtgtgaatattttcattcatggaggaatgagctattgtttaaatattggagaggccttgga

SEQ ID NO: 116249 - DNA, 1028 bp, Homo sapiens
ttttttttttttgagaccaagtctcgctctgtcacccaggctggagtgcagtggtgcaatctcagctcactgtgacctccacctcacaggttcaagtgattctcctgcctcagcctcctgagtagatgggattacaggcacccgccactatgcctggagtttttttttaagtagagtcagggtttcaccatgtaggccaggctggtttccgactcctgacctcaagtgatccccctgcctcagcctcccaaagtgctaggattgcaggcatgagccactgtgcccagccccagctcagtgatttttatagacaaattggaacccatgtgatgtgacttattcaaggttatagcgtctttgtggcagagccagaagtcgaaccgagtccttgtcccctgtctgaaccttgtttctttactggtcattgttgactttttacccaataaaatttgaacctttgattttcctggcaatatgtgtttgcttttaagttgtgggtcattatggattttatgaattagggcatctattagggtacctggcagatgtagtgtggaggataagcttggatatttcagggtcagactgcctgtgttcagatcccaactataccatttattgactgagatgttgtcaacctacatagattctcaatttttctcttctgtaaagtgagtgacatttataatagtaatacatatcttatatggttgtgtgacaaatatgttaggtacactgatcatctagtaaaaattagctgtggttattctcttttgagcaaaatacaacgaaaggttgcctcattgtgttcttcatggtcttttgcagcctggcgctatgtgggagccgtcggaggcttcctcttcattggcatccagctcctcctgctcgtggagtttgcacataagtggaacaagaactggtgtgtgcctttatggaaagcttcccattgactcacagaaactgcccagttttgaccaaggctgtactcaactgcattgctagggatttgcagttttgtttccctt

SEQ ID NO: 116250 - DNA, 1037 bp, Homo sapiens
ttacttgatagtttgtggctttgagtttggttgctttgagggttggagggaaacgccttgttctcaggggtctgtatagaaacaacatacagcctgcatgcggtggctcacgcatgtaatccctgcactttgggaggccgaggcaggcagatcacctgaggttaggagtttgaaaccagcctggccaacatgacaaaaccccatctactaaaaatacaaaaattagctgggcatagtggtgtatgcctgtaatcccagctacttgggaggctgagacaggagaatcgcttgaacctgggaggcagaggttgcagtgaaccgagattgcgccactgcactccagcctgggcaacagagcaagactgcatcaaaaaaaagaaacaacatacagtgtgtgagcctggcttaagtgccctgtccttgggtgcccagagccagacttaagaggtaacacccttagcaggcacattcctttcaccctgtggtgtggaatttgtatgtgatgtattttttctttttccaaaaatggggtggactttggaacagcaaatatttaatcggagcaaattccccttgccagaatcctgctagcttgttcaccttggaggttctttgcccaaaaatacttaccacatactgaaaactaaatgtgctaagtcacccacagagtataaaggaggtcttgattaggatttggagcaggggggttgtttacctgtttttgatgaatatacagtgtcaatgtactcaccctgtgatgagccttaaagggccctggccgcattccagattctggagtaagcaaacaagggaggggatttgttggggatggtggctcagcctgctgctgttagcattctccttgaaatggattttggaggaagaaaaaagaggtagggaggcagagaaggtctaaaggtgaaagatgggctggtatagatgaaagaggtgctaatgtgcatgtgttatggggaagatgtggttcaggaattagagttgctgatggagtagaagagagaaggtggggaagaaaataa

SEQ ID NO: 116251 - DNA, 1061 bp, Homo sapiens
tctacaaaatatcaaaaaattattcaggcatggtggcatgcacctgtagtcccggctgctcggcagggggatgaggtgggaggatcacttgagccaggctgaggaggtcgagactgcagtgagccatgatcttgccattgcactccagcctgggcagcagagggatacctgtttatatgatttaattaatcatacaaatgtttattttattttccttttggacatttagtgtaatttttaagaatgaatgtaaatactctacactagagccctggaaatagttctgctacaatacaacatgacatacgcattctaaaaattaccacattaagcagaactgcacaatgaaaccacaggtctcacggggaaaatttggttaagggcacaatattctaaaactttgtcagtgacacatctgaaaaaaggaactgaataaaaatgatatagttttataaatgttaaatggttaagaaatacataactactatggtaaatttggcattttatttgaaaaagtcttcaaattaccttgtggaaatgggtttggagagttaggcttttgagcagttgagaagcagtgggaggaaggttatctggaattggatggaaagttgtaacatcaaatgtgtttggtgtgactcagtgcacttgttgagctgagctgtgtgcattttttgtgtattaccacgaagctcaattcagcttggtgcagttttctacctggtgtttctcagtagacagaaatgcacatcctattatgcctaattgttccgtaacatatccatcctgttggagcaattttgtgttttcaaagtaagtatagaataaatagctcagaagccttggacttgcagagcttcaggaaggctgaccaagccttgctcctgttagctgtctgagggagagagctggccccactgacttcctttggaccacctcccagaaaattggcgctggaagggtcttctgttcttctgacccaattgtgctcgatttcttgtaccataataaacaaacaactccagaggcaggaacttcctatctttgaaggcagctctact

SEQ ID NO: 116252 - DNA, 1037 bp, Homo sapiens
ggtgaattttacatattgctgtttgcagttgaatttagggttatgattggatcctgagaacagtatcaatcaagttacctctctaaatcactgtgattgttcccaaatattaggcatcccaagtagcccagagtaaacctttgctgccctgcttaaaatgtattttaaaacatttacagtgagaatatccccatattcttctagcttatatattaatgatatttcaaaacattttagaacttaatctgagagtcagtatagggcagtaggaaattcaaatactgagttggtgtgattacacagaacatctgtttgaattttaaagggaagcaggattttacttttggcttttcttccgtagtttgccttgtgagattaaaattgctgatgtttaaggaaagcagctgttgtggaaagacttagtgggtttttatcagagagtaaattttgaaacaatttgtgggtttttgaagtaaggttacagtatatagtgattagacagcattttcactctctcatgaaaactgtgtagtcaaaacaaaagtaggaaaaacacatgcataaccccttaaatcttatttatgaaaagataactagcgaagatgggaaaatcagacttgtgtttaagtatcatttttttataaactagctaagtgcattttgaaacaaaattcatgaggtctttgtggaatgccttttccatttttttgttttgttttgttttgtttttgcactcacattatgtctcagcaatttaatggagggctgatttcctaatgctttgatccttggtgagtgtggttcaccccaactagggaggaattcagtcttttgttcttgattccatgctcattgatctcctccactgccattctcagaaacaatggcagtattttgtttccatagtaatgaaactgtttgctctaataggattctatagtggtaatttttctttagctttgctagccttatccctaaggactctaggactttgttggacttattttgttagctgttactctttttttttttttttt

SEQ ID NO: 116253 - DNA, 1047 bp, Homo sapiens
caaggccacacaaggtggatggaagagttgtggaaccaaagagagctgtctcgagagaagattctgaaagaccaggtgcccacttaactgtgaaaaagatatttgttggtggcattaaagaagacactgaagaacatcacctaagagatgattttgaacagtatggaaaaattgaagtgattgaaatcatgactgaccgaggcagtggcaagaaaaggggctttgcctttgtaaattttgacgaccatgactccatggataagattgtcattcagaaataccatactgtgaatggccacaactgtgaagttaggaaagccccgtcacagcaagagatggatagtgcttcatccagccaaagaggtcgaagtggttctggaaactttggtggtggtcgtggaggtggtttcggtgggaatgacaactttggtcatggaggaaacttcagtggttgtggtggctttggtggcagtcatggtggtggtggatatggtggcagtggggatggctataatggatttggtaatgatggaagcgattttggaggtggtggaagctacaatgattttggcaattacaacaatcagtcttcaaattttggacccatgaagggaggaaattttggaggcagaagctctggcccttatggtggtggaggccaatactttgcaaaaccacaaaaccaaggtggctatggcggttccagtagcagcggtagctatggcagtggcagaagattttaattaggaaacaaagcttagcaggagcggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagattttttttttgcacctatgctgttgattgctaatgtaatagtctgat

SEQ ID NO: 116254 - DNA, 1056 bp, Homo sapiens
tgctgaaaaatagtttcatttgttagaatataattgtcttccactaaaaaaagaaaaaaaaaagcatttaaggctctaagtatctcttgaagtaccacttttcctgaatcccagagtttttatgtgcattatttttatgcgtttgtagtttgatatgttgtatttataagtagttttagctttccattatgaattcttctttgacccatgagttatttaggtaagtgtttaaaaatttacaatagtttatatatgcaaatattatgttgttagagttggttttcatgtcatttttacatatacaggggcagtttccccaactaaattgtatattccttaaagcagcactcttaaattttatttctgtgtcaatttcttgactgtgtttcctggcatggaatacatggcataaaatttgttatgtaattaaatgaaatattattatactttctattttttaggcatacaagaattaaattctgaataagtctgcaggtaggatggacagttattttaaagcagctgtcagtgacttggacaaactccttgatgattttgaacagaacccaggtttgttgattttccatttttgccgctaatgggatttaaaaatatctgtaattaagttatctcaggtatacagtaatattagcaaaattttctttcaattttggtcacgttatcttctgcaaaaagttcatttatttcataataagatgttagttgattcttagactgaatgggacccatagccagaaacagaagtaaggaacctagaaagtttttttctagatacaaattagctataagacagacatttcttttcttttcttttctttttatttttgagacaaagtctcattctgtctcccaggctgaagtgcagtggcacaatcagagctcattgcagcctcaacccccgaggctcaagcatttctcccacttcagcctccaagtgggaccataggtgcatgccaccatgctggctaatttttcagttatttgtagagacagaatcttcctatgttgcccaggctggtctcgaattccggggtt

SEQ ID NO: 116255 - DNA, 1114 bp, Homo sapiens
aacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgatatcagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtga

SEQ ID NO: 116256 - DNA, 1305 bp, Homo sapiens
gatagtaaccagttttcctttcttatgtatagcatatcctgctcctctaacaagcatcagaggccgaaaacctctttttggagaaataggacacactattatgaacttacttgttgtgagtaattgaactattttattaggtatttttatactgttactttaaaactgtatttagcaaagtttatacatttatattttcctactttaatttgccatatttggtataatgaccattcatttacaataaatcctaattattttaacattagtgctcagtttttgacgaattgctttttagaacgtactatctcctcatgtacgtgtacctgattctaagtgccttttgattcattctcctgcagttcttggatatttaggtaatgtaagaactctatacagacctcttaaagttgttgaaacttttgtaaatgtattagtaaagtcagtcagtcttgtgattttgagcaaattatggccttagttttctcatttataataggaagtgttggattagatgatatctaaagttcccttccacctatactttttgtaattttgtgtttccctgttaccatagaaaaatgtttcagtggactcacttttatttatccatgcctagtttgaagaccttttctattttggaagttctgtaactagaaagttaccctaaatactacaaagtttttcctgagaatgatattctttattactgctgtggagaaggatttcttaaagaaggatttaatggatagaaaaatactcatggttagtagtttatggtaatgcaattattctatgtaggaccttcgaaattaccagtataccttgcataatatagatcaactgttgattcatatggaaatgggaaaaagctgcataaaaataccacggaaaaagtacagtgatgtaagtataattgttttattcaaatgacaattattgaacattagagttcccttagaattgtgtcacattaaattttttgttttgaattagactatctaatgtattatggcaacaaacattgtttttgaaatgatagaatttgtttactgtaaataatctgtttgatcatatttcttttttttcgtactgttttattgaggtgattactgttcaactgaagtgcttttattttaaaacatttgtttccatcacattcccagggagctgtccagaccgaagcttgataattatgaagctggccagaaacgtggctcttagaataggcatataatattaaaagtgtttctaaataaatgttgttgtttttgtttttttccaggtaatgaaagtactaaattc

SEQ ID NO: 116257 - DNA, 1306 bp, Homo sapiens
acttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccagtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatt

SEQ ID NO: 116258 - DNA, 1048 bp, Homo sapiens
aaattctagagtcctggtattttattattactctgtaagttgcctttataaaaattctgaatgcagtatgtttagttgaaaagtgctgtggaaggaaggggaacatcacacaccagggcctgtcgtggggtagggggaggggggagggatagcatgaggagatatacctaatgtaaatgacgagttaatgggtgcagcacaccaacatggcacatgtatacatatgtaacaaacctgcacgttgtgcacatgtaccctagaacttaaataaaaaataaataaataaataaaaagtgctgtggaaatatccaatatgaaccattaaccaacatttaggtttttctggtaatgtaatgcttatcagtcctctaaatcatttggtgtatctcaaaaccttcatttttaacagccacgttagtcacatattctatcatgcatatgtactgtgatttaattattttcctattgttggacatttgttatagccaatcaataatgtgccttctaaaatggctaccttaatattttaaagaatgatggccatgtgttgccatctcagtatgaaaggtctatgactctattatatatgccaaatagggccacgtgttttcagtgagagactgctttggggatagtggatcctccacctaactgtccttttttttttaaattctgcagcccagcgttagaagtgactgctaagtcccatgtatgttagttagaatttgtctttatatgcccctccattctctgatatcttatcagcagtttccgatagccatttttaggtttaaggtttttggttttttggggggcttttaaaaaagatgttagctcatgtcttttattaactcatagacaattacttgtcttctggtttgttgaagcagtaagtcagacaacatttgccacaataatgtctgtcaaagtagcttgccataaacactccagcaccatctgaatggcactctcgacaaaggtgtctaattttgccattctcttccaccttatagtatttcaggacagccagcttcatcttctttctctt

SEQ ID NO: 116259 - DNA, 1021 bp, Homo sapiens
tgtcaatcttatctttcagaaggaaatcagcaatgcattgaagtccctgttgaccaggacccagattctaaccagacaatatttgcttccaccttaagaagtatagttcaaaaaagaaacttgggggcaaatcactacagctctgattcccagctctcagctggccttacccctccaacttcagaagacggcaaagcacttataggaaagaaaaagatcctctcaccatctccttcccaattgtcagagtccaaagaattgttggagaatatccccccaggtcccctgagcaggagaaatcatgcagttttagaaaggcgaggttcaggagctttccctttagatcacagtgttacccaaaccagacaagggtttctcccacccttaaatgtaaattctcaccctcccatctcagatatcaatgtcaacaacaagatttgcagccttctttcttgtggtcaaaaagtgcttatgccaacagttccgattttccctaaagaattcaaaagtaagaaaatgttgttaaggagacaatcattgcaaactgaacaaattaagcaattagtaaacttctaggagatgggtataaaacacatcttcttcaaatgtttatatcagagaaacaaagaactagagaagaaatcttaaatgttcattcttttaaatctcgtgattggttagtccataatggctagatggattaaaatgtaatgtgatttgtactaggcgtcatgagcataaaaaataatacatagtttctgttaagggaattctctcaaacaaaaggaaagcgatttttctcaatgcttctaatatttaacaatctccatgtagtccaaatttgtcattaaaaaaaaatcaaagaaagaaggccacgtatgttggggtaatttttaaaaattttcagattggctaaatattttattaggaaacagttttcaagtcaataatttttttaacatttcatgttaataaatgagattgaaattttttatgatctctaaaccataaaagaaaacac

SEQ ID NO: 116260 - DNA, 1037 bp, Homo sapiens
gagcttgcagtgagccaagattgcaccactgaactctagcctgggctacagagcgagactccgtctcaaaaaaaaaaaaaaaaaaagagaaatgaaacaaaccaataatactagtaggcaccatttatagaacacttgatgtgttaggcacaatgctacattcttttttggttttgggggatgggggcggagtcctgctctgtcactgaagctggagtgcagtggcgccatcttggctcactgcaacctctgcctcccaggttcaagcaattatcctgcctcagcctcctgagtagctgggattacaggcacccgccaccatgcccgggtaatttttgtatttttattagagacaaggtttccccatgttggccaggctggtttcgaactcctgacctcaagtgatccactcaccttggccttccaaagtgctgggattacaggcgtgagccactgcacctggccaacaatgctacattttttacaaggatgaagactttattgacagccaggctcggaggcatgtcacacagcagaaccagagtgaagcacagtctgattcaagcaggcgttcctgaccacctggagcatactggggtgcagcctgcatagtactgaagaagtaaccaaagattggggttcattggaggctggaagggtcagaagattcctcagtggagaagctgggtttggaaggggagctggagagaacacaggcttaagtgagagttagggaacaggaatagcagatcctaataaaggaattacaatctgccacacattgtggaattagggcagtatagtctccatcaatcaaacagaagcagagaacctgtcactgtccagggcacataatttcagttatgttctaaacagcttcagattgtatttttgtcttttgcttacacaagaaatgtgataccaaatgtaagtcttgcaaaaaattcttaagaaatttcctgttagctgggtgatagagtggaaagatacaagggaaactgctgactggtttttgagagaatgaggaatccaaagga

SEQ ID NO: 116261 - DNA, 1048 bp, Homo sapiens
gagagaggaatacggaaattgctccaaagtggagattctaaacaaggctatgggagaaagcaaaaaactcttccattgcaacatttgatggtcatttgtactttcaggcatgtactaacataacatcataacagcctctttaatggaatggagggaattctctaacgggagacctagagtaagtcagtccttcattctatggagaaaaaggaaacctgtgaagataaagtgaatatactttgtccctggaaaacacattgctcagttctggagcggctttctctccagatctctgtgcgctggggaacttagatttgctttctactgtccaaatataaactttggtcattctccacctcccctatccctttccccacagctactcacttagtttaagtcccgttgtctctatcagttaacctcttgtggttatataggtttctgttcaaacataaagtcttttattaacaccattcttcccgatttaaaaaataaacagactaatatagtgaaatacagatgaaagagagaacttgtgagacaagaagagaataaaattagaatgtggaaggagccacaagtgatgggagccagagcagacggtcatattaataaagtaaggtggttttactttgtgtctgccgtcagctctgtacgtcattgtgcagtcgatttttcaacagcactgtgccagcctatcctctagggctctgctctcattcatcttgcctggaagaaatctttctcagactatttcacactagaccccaaccaaaccagcaggcccagatattttatattggcagttttctacttaatgagccccaaacaggcttttacttctagttaacaatcttctgtgtgaccacatagtcaaagagaagacagattaaaagaggcctgtggaggcagtagttggctccagagctgggacagatgccccttatcagtggacaccttgaagtaggttttggatgggctgatgtttcttcttctgaccctaaaacttcctgtcaggatgctggcatactcgtccacatgactcgga

SEQ ID NO: 116262 - DNA, 1954 bp, Homo sapiens
agcctcccaagtagctgggattacaggcatgcgccaccacgcccagctaattttgtattttaagtagagatggagtttctccatgttggtcgggctggtctcaaactcctgacttcaggtgatccacctgcctcggcctcccaaagtgctgggattacagacgtaagccactgcagccgacttataatcaactttaatgcagaacttcaccaccacagtcaatctaataatccagacagctcctaagtgactaaggggcaggtaacatagacagcatgtgcaggacaaagggataattcacgccctaggcaggacagagcagaatggctcaagatttcttcacactacttagaacagcatgtcatttaaatcttatgaattatttctggaattttccagttaatattttcagaccacagttgaccatagataacaaactggaaagtgaaactgcagataaggggggagtctgcattccactttttaaatttttggtacagtaagaattagtagagcatctatttggttgtagcaaagataataaatgatttaatataaaatgatatattgaaaataaaaagtgaaatttgttctgtacccttatttggaattttaaaaataaacacttggatttgttgtgtgtgtgtgtgtgtgtgtgtatttttcttttctataaactatttgagatcaagaattactgctttgttagaattgcaattaagacatactttttatgaatgagaattttaatacactcattctagggcaactttttctgtagaaattatcaaccatattttaggcagtagttagaaaagtcatgtacaatataaagccaaatgttaatacaattgttagcaccaagaagcagaaaaattacctatctactagcattgtaattatcttctgagaattggaagcattacaaaattttatgtatatgtattaagtatgctcttggggttttccatagtcaaggtctcattaaattgtactatcttattcatacaagtttatgtaaatttttctatggagagcaactagataatttggggctcttaactctaaacagccaaagggaaaacaataaaagagaatgcttaaattaaaaagttcttgtaagcaaactggaggccagactatatttaaactcagtctctcataattattgataatggttagtgtcattctcaatataactaaggcatactttgcagcaccccagatgaaagaatagtatattttaataatatgctttggcagcaccaagcatatttttaatacctagtataaacttaactaaacataaatcttagagtttctttgtcttttgacacacattaagaaaactgatgttgttttatttcaaaggaagccatgaatcacccaggccatcttaaactatttgtgacaaggatcatgcaagactttgaaagtgacacgttttttccagaaattgatttggagaaatataaacttctgccagagtaagtataaggttattaattagtctgaagcactttggatttcctgcttaagactatagaaaataacatgtcttttcagactacaaattgggttcactgtgtactgctaggatgatgggtgcaccaaaatctcacagatcactactaaagaacttactcatgtaaccaaatacaacctgttccccaaaaacctatggaaataataaattaaaaaaaaaaaaaaaaagcttggcacagtgactcatgcctgtaatcccagcactttgggaggtcgaggcaggggcagatcacctgaggtcaggagttcaagaccagcctggccaacatggtgaaaccccgtctctactaaaaatacaacaaattagctgggcatggtggtgcatgcctgtaatcccagctacttgggaggctcaggcaggagaactgcttgttcctgggaggcagaggtcgtagtaagccaagatcac

SEQ ID NO: 116263 - DNA, 2623 bp, Homo sapiens
tcaataaagtggcttttaaaagtctttggaaccagccgggcacagtggctcacatctgtaatcccagcactttgggaggccgaggtgggcagatcacgaggtcaggtgttcgagaccagcctggccaacatagcaaaaccccgtctctactgaaaatacaaaaattagccaggcgtggtggcaagcacctgtaatcccagctactcgggaagctgaggcaggagaagctcttgaaccaggaggcagaagttgcagtgagccaagactataccactgcactccagcctgggcaacagagcaagactccgtctcaaaaaaaaaaaaaaaacctcgttggaaccaaaaattaaataaacaagttttactgtaatgctatagtagcctggacaccatctttagaaaatccaaaattgcctccattatgtaagatttaaatagtctcccatccacgaaagttaacttaatttcatgttataattttttacgatctcactatcagaatctccacagtgattaaaacttcttgaaggtgcagttctctctccccctaccactcacacacttggagtagcaaacactgacctggtttctgatgtctactatggcacctaataactttgtgactttaggcaggttacaagtaagccttgttgaacctctttccttacctattaaatgagatgaataatgacaacttttttgggtgattttgaagactcactgaaattttgtatgtaaagtttctggcacacagaagggtatagatatcagttcctacccccacccccataaacttgctactttatatcttatagaacatacacattaatattaatattaatgaaatcacagtgaacagactcatgatctcattttcaccttaacatattactttgttcttgtttccctccatcttgagacaaaaatccactgccacctaaatcaactctctcatctcccctgacttgattctggattcctttttttctatcttcaccttgctctgctgtcccaaccttttagtattatcaaaggcaaaataaaaattttgcgatgaattctctaaatttaacattgtgtttgggaagaaaaaattgcagtttagggcatacatgcagacaagtgaccttccatatgtctgaagaacaaagggaaggttagaggttttatttaaaaggagaaatgttactgctctttgagaaagttcattggcactactaaggtttgggggagctagcaagctccgactggcgagcagtgagtggtgggcaaaatcagttctagagttgcagcaagttatctcagaagctatagataaaactggtttcaggttacaacaagcagttccagcagtcaggcttacagagaattacattcttggagcaatgttttataccctgagtgcttttttcccctggcccctcaactctgatttagttgggtatgacaagaatgacccactgtcacccaggccagagggcagtggtgtgatcgcggctcactgcagcctccacctccctggctcaagcaattctcctgcctcagcctcccaagtagctgggataacaggcatgtgccaccatgcccagctaatttttgtgttttttagtagaaatggggtttctccatgttggccaggctggtctcaaactcctgacctcaggtgatctgcccacctcagcctcccaaagtgctgggattacaggcgtgagccaccgtgttcggcctaccctgttttaaacctcaccatagtttacttttcttctaccctcaactttctcagagctttcttgtattaaataactttagtatgattaaaataaaattctatactacactttggttgtagtctgtcatgcctgtgcctttgcacatgtttttatctcctttgacactcagttaaggagtcatgccctgaggagtattctccctcatcaccccggccctgcgttcctgtatagcgtcctctgcatgtcttcgttgtatgtcctttcatacattatagtcactgctgagatatttctgactgctatcacaatctctttgagttcagggactgcatattttatctctatccccagaatctagcataacccctagcaaagtaggaattcaaaaatcacagaatgaatagtacataggtgatttataaaaatagaaccatcccacatagtaccactttgtaacccacctctttttccctcaatatattagaaaataaagtcctgtaaatatttttagtggctgcatagtattccattatgaggctggatcatacccaatttttaatatgagcatacctcagagacactgcaggttcagttccagaccactgcaataaataaagcatatcacaatataggtagtcacataaattttttctcagtgcatataaaagttatatttacactatactgatagtctaatagatgtgcaatagtatatctttaaaaaatgtatgtaccttagttaaaatatgactggaaaatgctaacaatcatccgagccttcagtgggtcataatcttctcactatggagtgtcttgccttgatattgatggttgctgactgataaaggtgatgattgctgaaggctggggtggctgtggcaatttcttaaaac

SEQ ID NO: 116264 - DNA, 1019 bp, Homo sapiens
taaaggagatccactaaatgtcaggatgtccatcatatctatgcacatagataagtcctcaatgtcatctgtgagttcttggaaactgtgactttaagtgaaacaatgtagagcaaaaccaattttaccataggctactggatgtacacaagagttaagttcctagggcatattgctggtcacaaaaacatcaccaaacttctaaatgaaggccaaaaacacttctaatagaaaacactgaagtaaatatgagctatacatacatttaagaagaataatgtgcatgtctttgggatgtggaaggaaactggaatacctggagaaaccccatgcagacatgggaaaagcatgcagactccacacagacggtggccctggccaggaattgattatttttctcatcaacgttagaagaaaacgatgttattcaaggacatgttgtatataaatacatgaaaatatatgtatattcccaaaatatacttaggctttctttgtgattttataggtaaacagaatctggtgattatgggtaagaagacctggttctccattcctgagaagaatcgacctttaaagggtagaattaatttagttctcagcagagaactcaagtaagtaccttaacataaattcaccacaagaaaatcatgtctcatagtggagatcagtatatgataaaatgaaattgtataaaaggagctattgatgaagctgcttaatatcacaaaggtgattatagaaaattaataagcagttatttatactacatgacaataacttattctactacctgagtaattgatttcatcaccttgaaaagttacattaaacattaaatagctcactgtggtatcagatttgcaagttatcttgaaccatcattcagtaggcccaaatataaattatacagtgtaatcaataacctgtagtttcacataaagtcaaaacaactattttttgggacttgctaaaattaagtgatgatcccctttctggacccaaccctaaatgcaata

SEQ ID NO: 116265 - DNA, 1409 bp, Homo sapiens
cctcgcctgcacaaatggggacgaggggggcggggcggccacaatttcgcgccaaacttgaccgcgcgttctgctgtaacgagcgggctcggaggtcctcccgctgctgtcatggttggttcgctaaactgcatcgtcgctgtgtcccagaacatgggcatcggcaagaacggggacctgccctggccaccgctcaggtatctgccgggccggggcgatgggacccaaacgggcgcaggctgcccacggtcggggtggccgactcccggcgagaggatggggccagacttgcggtctgcgctggcaggaagggtgggcccgactggattccccttttctgctgcgcgggaggcccagttgctgatttctgcccggattctgctgcccggtgaggtctttgccctgcggcgccctcgcccagggcaaagtcccagccctggagaaaacacctcacccctacccacagcgctccgtttgtcaggtgccttagagctcgagcccaagggataatgtttcgagtaacgctgtttctctaacttgtaggaatgaattcagatatttccagagaatgaccacaacctcttcagtagaaggtaatgtgggattaagtagggtcttgcttgatgaagtttaccagtgcaaatgttagttaaatggaaagttttccgtgttaatctgggaccttttctcttattatggatctgtatgatctgtatgcagttcccaaggttcatttaccattattaaaaaatttttgtcttagaaattttatgtatgtcaacgcacgagcaaattatcaggcatggggcagaattggcagctgggtggaggcttcggtggaggtgagcactccgaaaggaaaacagagtaggcctttggaacagctgctggaagagataaggcctgaacaagggcagtggagaagagagggtaaaaattttttaaggttacatgaccctggattttggagatctcgaatttaaaggtgatgcaccagggatgaacgctcagattttcagtttgaaagctggcgtgacatgtaaaggagtggagaataatgtaccattgtaatgatgaggcgcctctaggacatctaggataatttcaggcgtggggatctaggtgaattgaactgttggagggaagggaataaccaaggaaaagaatgtgggggttgagagatgccccgtttaaaacctaagagacctggatatttatggttgtaagaggaggcatggcagaggaaatggaaacagtaagaaaggagcagatgctgcatctctttaatgggacagatacaaggcatttgggtttgacacttaggtcactggtagagatgatgacaagagcccgtagctaaagaattgataaaagccagtctcaaaaatcccaatatagtctggtaatgt

SEQ ID NO: 116266 - DNA, 1069 bp, Homo sapiens
caggaacaaatatgtagttgtcatcccctaggcgaaggagagaaactgtctaggttaaacggtaaattcagacctgaccacggtaaaggctgatgtttttctgcccttctgtgagggactaatagagttcagagaaggggtgaggttggggagcgagagtgttagaattagagttccatggcttcagtgggcaatatctaagccatggtgctttctagaggaaatcagggaatcacatggtgcttcatggttctatatttctatcagtcgtgcatcattaattagttagccagcctggggtttctctttttactttttcaatgatttctctgtccggatgggttcatcatttctgcatactctgtagtgtcttctaaatgtcagtcatttgcacatgccatgtagcaaattcttactcttttacagtctcatgatctctgtattggatagtctttgtgtagggaaagctctaaggatgtagaagacctgtcatatttttctgagtcttttatagatacagatgttgatactgaagttaggtcactggaactgcccaaaatacattaaaccataggcttctatacagggaacatttttttaaactttttattgacatagtacacatttagattaagtgtacaaatcctaaatgtataccttgattaatttttaataaagtgaaccaacatcacatagggaatcttaaaatataaatttattgatattttcttttttcattttttagattgcagcccgagagctcaatatttattgccatttagatcacaactttatgacagcaagtatacctactcacagactgtttgttcatgtacgccgcctggtggcaaaaggatataaggtcagctttggctttaacttgtggggaaaggaaattgggattctcctccagagagtgcaaacgtgttttgtaaggtggtaggtaggcttcaattggtttagaattttgcattttacagaactgaaagtgtttcataattattagtattatgtatttatgagtttttaacatattgttagatatttagggtaaatttttaaactctat

SEQ ID NO: 116267 - DNA, 1363 bp, Homo sapiens
ttgatagcaatatttcttatttttgttgaaggtgggagttgtgaagcaaactgaaactgcagcattaaaggccattggagacaacagaagttcactcttttcccggaaattgactgccctttatacaaaatctacacttattggagaagatatcctttttggacgggagtttttctcttaaatgatacaagggctttgttggcaggttttgtttgtttgtttgtttgttttttagttgctctttgggaactttttagatgagctgagaggcattaaggtgaacccttgattaggtgtgctattcaagagggaagtagtggctggaaacaagcatcttttcacatgtcatagtagaaggcaagttcatcatacttcaagagcaagaaaaaaagcaaccctaataaaagacgatgtcaggttagtatctgatttgaaattatatcttccttagcccatttgtgggaagtagttaggtgcttagggcctacaagctcctcagggtctttccaaagtgagacctaaaaagtaacttattgaagccaggcgctgtggctcatgcctttaatcccagcactttgggagactgaagtgggcagattgcttgagcccaggagtttgagaccagcctggacaacatggcaaaaccccatctccacaaaaatacaaaaaattagctgggcatgttggcacttgcccgtagtcccagctacttgggtggctgaggtgggacaatcacgtcagcctaggaagtagaggctgcagtgagccgtgatcatgccactgcattccagcctgggtgacaggagtgagaccctgtctcaaacaaacaaacaaacaaacaaaccaaaaattcaaaatgtgaaaagagaactggctgaagtcagaattaagacagagttaaatgcctataaaatatagtggtagcccgtcttcattaattgttaactttataaaaattttattacttttgaaaatgggctgtgggtgaagttttctcacttggtaagaattttcaatgtgcataatgattgcccctaaatttacggtcatttataaatgcagtgtgttatttgatgccaaataatttcaaaagcaaaattgtcagtttcaaaagccaaataattatatgtaaaattagaccagggtgcatttaaaaaaaattactatgggggtggaatcagttctctgataatggaagaatggagagataagaaggccttaaatgatactgtgtgaaagtattatttctgttatggtttattacagatctgcttatttctcagctcatctaattctaaggactgttttgttccatgaatactataaatagggaacagctatcactcaaaatgggctccaaact

SEQ ID NO: 116268 - DNA, 1875 bp, Homo sapiens
gtaagatactggttatctgtctttatgctctttatatcttaggaaagataaggcatgcaactatgatccaaataaatcagaagaatgaatactgggcagaagatttttgcaaagggcagaagtactgtgtgaaatgaaccatcattttattatttttttctttatttttatttttttattttgtagagacagcatcttgctttgttgcccagggtggtctctcaaactcctagccttaagtaatcctaccaccttggcctcctaaagtgctgggattacaggtgtgagccactgcgcctggctgtgaaccattattttaaaggagaaaatagttaatattattggaaatttagcatattaggatttagaatttagcatataattatttttctttaattattattaaatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtggtaagtactttgcaggtgaggaacaaatgttagatgttcatggtatctctaaatatgatctatcatgtatggtttataataaggatatctgatgaagtgtaccttcagataattatacaagaaaaacatttttctcacaatattatatgttaaatcgctagttacaattttctcatggctacttggtacttgtagcagtccattctcacgttgctataaagaaccacttgagactgggtaatttataaagaaaagaggtttaattggctcatggttccacaggctgtacaggaagcatggctgaggaggcctcaggaaacttacaatcatggcgaaaggcgaaggggaagcagtgacatcttcacaagcacaaggctagcaggagagagagtgaagggggaagtgctacacacttttaaacaaccagatattgtgagaactgtcatgagaacagcaaggaggaaatctggcctcacaatctaatcacctcccaccaggtctccccctcagcattggggattacaattcaacatgaggtttgggtggggacacagccaaaccatatcaatactctatgctatggagagatccagatggtcttggtccatgtgccctgagattttaaggttgaagatagacacaatggcagacatatgtgtggacaatgtacagatagcagaataaaacactaagccaacacaagcatggtggcaaagtgttctataaatttcctctagggatttgaaattaaacatgaatgactatggtattatatctagatttggaggaggggatagttaaagagaaatgataattggctgatataaaataccatactaaattaatattaggattatttacagtcagttttctagataaatgtaatttgtgaattatagttttatttatttatttctttgagacggagtttcacccttgtcacccaggctggagtgcaatggcgtgatcttggctcactgcaacctctgcctcctaggttcaagcaattctcctgcctcagcctcccgagtagctgggactacagtcacccaccatcataccaggctaatttttgtatttttagtagaaatggggtttcaccacgttggacaggctggtcttgaactcctgacctcaggtgatcagcccacctcggcctcccaaaatgttaggattacaggcgtgagccaccacgcctggccaactcatagttttattgattttctggcagtttatgaataaatttgctcatttacagacttacgtggactctgctaaaggtcttagactttttaaggcccttcagaacaatcagacacccct

SEQ ID NO: 116269 - DNA, 1104 bp, Homo sapiens
atctacagtttattcattcctgttgatggacatgtgcattctttctagtttacagttgtacagagaatgctgctgtaaatatttttgtatgtcttgtatcgtatacaaatgcctgagtttctccagagtatatccttgggggaggaattgctgaattatagggtgtggatacttcaacattcctagataatgccttgctgttgtcagaagtggctttccatcagtagtatatgaacatagggattggtgatttttcctctttttagctaatgcagcctgtaactagcccccatggctttcataagcatccgtagtggctaacagtgtggattggggagtagtcagatttcctgggtttgaatcttgactctactccattgtcactctgggaccttggctagaaacttcctatcacttctccaaaccatgatcttttccagtttatctttgctattattggcttaggatgttagggagcaggttcaagttggcatgattattctactggatagactgtctacttgggcttcattcagagtttgataaagtatacattttatgtgttactttgatgtatgaagtagtaatttactacagtactggtggtctggttactaggaccatgtcacttgttactttgagtgataactactatttgtacagtgctttatagtttacaaataattcctgtttattttataatttgatccttacaataaccttatgagagaagtaggctggtttggttccatttacagaggaagaaactgaggcctggcagtgtttggtaacttgccatagtcactccgttaggtatattaactccaggccttgtattcagggcggctctcggaaatctgatttatagtatcatttagatatctgtgagtctgactcttcgtgtaagagtcctgaaaagcagacaggtttctaacactttagaaatagagtacatacatactcctgagtgtatcatctttactttttccatgtttatgctgtgttatagccataactggggaaatacattttttctgtaacattatatttgtatttgtttttagggagtgcagcctgccacaggcgaggttgtgtttgatagtt

SEQ ID NO: 116270 - DNA, 1116 bp, Homo sapiens
tagttccaaaactgatacttattaaagttgctaaaaatagtttttacttacaaaaattatatttccactgtagtagtggaaatttaaaaaaaaaagtaaaacaacaaagctgggcatggtggcacatgcatgtaatctcagccacttgggaggctgaggaggaaggattgcttgagccccggaatctgagaccagcctgggcaactaaggtgagatctcatatctaaaaaacaaatagaagaaacaccacctacccctactatcaccttaatgtagaactttagaaggcagtctttttgaagaggtttctgatatttaatgatattatttgataattatggggtttatgatatttaattattggtaatcttcagtttctagagataatttagagttcacttcttacaaagtttatgtaactttggagatgctttgtctgtgctgcaagtttcaattcatggctgtgtccagtggttttgtttactggatctaagatcagaccacttacgtatgaagcagtgtgctaggcgctgtgcgtacagaggaagaagatgtggttatgatatatgtctggcagagtttacaacctcacatgagagtcagatgtgtgcatacctaactggacttaaaggcatgatgtattaagtgctaaacgtgaaggtgccttgttggaaagactccgtactgccacctggagtgtggtgggaaagagaccagaaaggtgtgctggggcttcagcgaagtagactgtatattgacgaatttggactttggactaggcagagaagcccatgaggattttcatgtagtaggtagacaaatcatttagaaaatcgaggccaggcacggtggctcacgcctgtaatcctagcactttgggaggctgaggcgggtggatcacctgaggtcagcagttcaagacagcttggccaaaaccccgtttctactaaaaaaaaaaaatacaaaaattagctgggtgtggtggcagacacctgtattcccagctaccccggaggctgaggcaggataatcgcttgaacttgggaagcagaggttgcaatgagccaagatcacaccacttcactccagcctgggcgaaagagcaagactcttatc

SEQ ID NO: 116271 - DNA, 1052 bp, Homo sapiens
ttagaacaaatattagagatgatagtaatctaaaattattactcctaaataatgatacactatcaatttttcttagattatttatttttatttatgtaaagtatgtttgtaagatttcagcctgtgtcttagggaatcagtcttactatcttgttacactttcttttgttgtaaaaatgtagagaaagaaacaaatggaaagcaatagtctcgagccctttatcaattgcagttaaggttgctttagcttagaaatgttgtatgtttatagaaatggttgagaggaaagctttagaaagcgataaacaaataatatttactagttctcaaggaaactgacttttcaggtgaatcaggtgaacatcacaaatgacactcaattttgcgttcaaagaaatgagagcttcctgagcactggcatagccaaggaaggctgtatgaaggaggtggggtaggctggtacatttgcagaatagaaggctttgagttggtaatggggaggggggaagggtatgttgtgtgtgtatggaaatgatatgaggtctgaggcacacaggctggaaatattagagaagtgtgaagacagaagggagatttctctgattagagggaactttcatgttgagaattgagaaagaaagggtgaaggcctatgaaatccagcaaactggtatggattcctgtagaaggcagtaaggtttctgggaaaaggaatggcatgatagaagggaagagatgagtgtactgcctagatgggacagttgaattttaaaaataaatatttccctaaaggaaaaagcggatacagagaaaagaatcagatcaaggagcttagagaatgccaatagttgggaataggagcaagaatacaaacagaaggggaggaattaaagagctaggtggagaaccaggacaaggtagggatgtgtagttataatttgtcacacgtggtataaccaatgatgtgagctaattttttacattattgactctgttatagtttactgaaactgtatgacattcagaaagatacttggttaaaaactagcctt

SEQ ID NO: 116272 - DNA, 1047 bp, Homo sapiens
atctaagcatacaaaaatttataggaaaattttgccagctctccatcagagtgctgtcatgatgattagttcatatttccttcttacgaagcttgccctttcttgtttatcacccacagaaaagcatcaaagttaaaaattaaaagtatttgaaggaacctccataccaagtggattcagagagcccagaggtcagaaatcgtgcagagtcttatgttgacagaggaatggccctgccataagaaaggtgcctgagttatacaaggtgttggcagctggagccaagttacacctggtttacttacctgatataattttaagtgcttcacaaataacgttttttaccttcatagttaaatatttacttaaggtatattaaaaacatataatcagtgaatcaaacctgtgatttcataaatgtgttgcaaagaaagattcttaagttggtatttgagttaaaaatgtgagttaacttaacaagaactatcaggttatagtagtgatgtccttacaaatatgtcagtattattgaaggtaaaggggaatgactgaagttaaggaaacatgttggagcaattgtaaaggcaatgtgtgtcacattttctgccacttgtcatttagattgtgtaagctaaatctagtataagtgggaccattgtttgaatgaaaaaaaatccaaacttgagatgtagagaaatatagatgaatttgaagcccagaaaggacatttaagctctcttaagatgagttactccattttttatagtagctcacctttttaaaggtattttatcctgctgtcaagtttattttattaaattggataccaggaaattctaattgatttttttatatcaaacaaatcgatgttatttatttatttttgagacggggtctcactcttcctcaggctggagtatggtggcaccatcgtggttcactgtagccttgaccccccaggctcaagcaatcctcccacctcaacctcctgagtagctgggactgcaggtgtgctcaaccacacccagctaattttttttgtagaga

SEQ ID NO: 116273 - DNA, 1079 bp, Homo sapiens
gagatctccccactgcactccagtctgggcgacagaacaaatcaattctggtagtagagatggtagtgactaaatggaagaaataaatctcatatgctgtaggaaaatgtttgccactgggaaaccatttaaagaggaagtgttattagtattaaaaaatctgtcattttgaaatttctttttaaaaattacattaatttcttccctggtggtaatgccattgtattttcagtaggttttttttttagtcctgatactttttgtatatctagctagcaattttaatggatgtgcttaactcatgaaaatccagattttaaaacatgataagttaataggtgatagttattttataagaacatttgccatgagtttatttaaagaatgagagcttctttgtgcattttcatcaagtgcattctcctcaggaatatatctccttgaaaagaaaaaatggggtgtatttgcagtaggtttattgatagtcgaataggaagaaacagcatttgagaagtgtggagaaaagatcttcctgattactacagagacctcctaaagtggggccagactgcttgaacagaaagtttggaagcaattgtgtgaggtgtgctgcatttgttttactaattcgacttgatttttgtaaatacacctgttcatttgggtttgaggatttaattgcataaagactctttatttagctaaagcgtcttgtcctcatggcttttcccagaagtttgtgttataaatgttaatatattaaaagtgcttttaaatgatttattattagcatcttaaaaaaatcctacactaaatattaaagtagtctttattatttcaggtgaaggcaaagggaaacagtacgagttgcaaggtagggggtaaatggaaaggaagaaaaaggaaagacaggagatgaagggaaagattgagtcccatcattcttgaagacacattgttcatggcttcaataaccctggcacagccctctgaagaaagtgtagttatcctcttctttctgcaaggaggcagagatgctgtgaacctctcttgaagttacaggatcacttaggtagtaa

SEQ ID NO: 116274 - DNA, 1028 bp, Homo sapiens
atcttttataatgggccaggaagcacgtgtctgtggtttctgcatagggcgtgttctgtggtgcccagccagctgtagtatgtcctgcgagatttggcctgcaggccacaatggtgggcttctgggaggaagaatcttccttagaagtcctgccctttgacactccttctgctgaagtgtcctgatctcagtggggctccctgattttctgttccggggtctatcagcactgggtctatcagtgctacccacgccgccgtgactgtgggtcactgagggtgacctgcgtgggtcccatgggctcagcctggccttcccaggtcctacaaggtcctccttactgtccgtccctgctcagtcaccaaagaatgacttttttgaaagtacaattccagagttaaatactggctaagtgtagaaaacaatactggaattcagtcttcacctccaccagtcctcatggtgagatgaagtgtttatgggtttctttgttgtaacctcaaaagtggaatgcatttcctggttggtgctgcttgccctccaggtgcttagtgagtgaagcttcatcttccagatttctctttgtggcttagggtatctgtatgattttcctgcttttgttttcagaggtgctaggctgtgctgatctctctggagtgattatggtgctttttgcctggtaagcccatccttatgtgtaaaaatcaggatttagatgtgaggcaaataaggtggtggtgattttgttttacagagagattttcactttgcaaacttttagaccttttcaaattctaatttgatttgatgtatttaaataacaagttatgtaaaaacattgaaatgacccattttacagaagtttggtttacaaacccattgtttgtgtaaggtaacatacctgaggccaggagcatgatacctttcctctagtcttgcccttgtccctcgctttgggctccagctacatcagagtaattgccatgctcacaaccccatacagtgagagcacagaataatggtctggg

SEQ ID NO: 116275 - DNA, 1869 bp, Homo sapiens
ttgtcagtcttttaaactttagctattatagttagtgtatggtgtcatgttttatttttaacttgctttttcttgatgactagtgatgttttcatgtgcctattggttattcatttatgtatctcttttgcccattttgagacttggattacttgtattttttagttataagaattctttatacattctgaataaaaatcctttgtcagttataggtattgtgaatatttactcccagtgtatggcctgccttttaattttcctgattatgaccttggaacaacagaaggttttaatttggtgaagtcagatgcattagtgtcttcttttatggttactagtgctttttgtatcttaagaaatctttgcctactccaacatcatgaacattttctcatattttattttagttctatagttttagcttttaattttaatatattaaatagttggatttaactttggggcatcatgatatgaggcagggattgaggttcctttttctttgtacgtttaccagttgtttccacactgtttatagaaaagacttttatatgcattgaattatgttgatgccaaaggcttcattttgtctttgtttttaattaatatttatttatttattttttttagagacagggtctcgctttttcgcccaggctggagtgcattggcacgatcatagctctctgcatccttgaactcctgggcccaagtgatcctctcagccctgcaagtagttggggtacagattttcttgtggagatggagtctcacttatgttgcccaagctggtctcaaactcctggacttgatcaaaggttttgttttgaatttgactttgaaaaatgacctagatttttatgttcttatattagatattttagactttgactttctaggatgtcatttaaaaatgtttttaggtctccctttttcttttttctttttttgagacacagtctctgtcacccaggctggagtgtggtggcaggatcttgattcacttcaacctccgcctcctgggttctagcgattttcctgcctcaccgtctcgaatagctgggattacaggcgcccactaccatgtctggctaatttttgtattttcagtagagacagggtttcaccatgttggccaggctggtctcaaactcctgacttcaactgatctaccctccttggcctcccaaagtgctgggattacaggtgtgagccatggcactggaccctctttttcttttttttcagaagttattgtatttatcacataatagaaataaagggtgggatgggagctctagaaatctaccatttcagcttcttccttagtagacccacattagcgatgaatataaaatagatatgtgtgtgtgtgtgtgtgtgtgtgtgtgtgtgtgtaccctgagctaatggaatttgtggaacatttggtaaagctcataaatattgcacaactggtacaatcttaagtaatcaattctaagtttttagggccgggtgcggtggtggcttacgcctgtaatcccagcactttgggaggccaaggtgggcggatcacgaggtcaggagatcgagaccatcctggctaacatggtgaaactccgtctctactaaaaatacaaaaaattagcctagcgcagtggcgggtgcctgtagtcccagctactccggaggctgaggcaggagaatggtgtgaacccgggaggcggagcttgcagtgagctgagatcacgtgagatcgcgccactgcactccagcctgggcgacagagtgaaactccgtctcaaaaaaagaaaaaaagagtttttaacaacttttgttaatttttcttatgtttaataataattatagataagcttttcttta

SEQ ID NO: 116276 - DNA, 1059 bp, Homo sapiens
gtcccagacctggaattagtcatttctccagtaatccttccctagtttcttttagtaggaaatggtatttttttttttttttctgagacggagtcttactctgtcgccaggctggagtacagtggtgcgatctcggctcagtgcaacccccgcctcccaggttcaagcgattctcctgcctcagccgcctgaatagctgggactacaggcgcgtgccaccacacccagctaatttttatatttttagtagagatggggtttcatcgtgttggccaggaaggtctcaatctcttgacctcgtgatccacccacctcggcctcccaaagtgctgggattacaggcatgagccactgtacccggccaggaaatggtatttctaaaccacattctgtgcaactagggaggctatttattggataggtcaaactatattaagaactcattaaaaaatacttctgattcaaattcagggctaaagagtttttatttaactttttcagtctgacatctatatctccttttccccaccatgtcgacaatcctggttcttatgtaagtactctgattttatcattcaaatatcaggtatttaatttgctttatcccacattactgaatctatgttattaaaattatatattataaaatgccattgcatttaaaggtcttacgtttcttccccatttatttcacagttgtaatatatctgcatcatcagagcatatagccattaggtactataccttctttcttatagcctccattgagagtcttagttctccaaacaaatatgtattacatgctcaccaccaattcttatatccatgtctttctagtcattttggttgtctgaaatttattctgtagtatggttgttcttacaccttagtgtgcatcagaattacctggcaggcttgttaaagcgccgagtactgggcctcactggcaggttctctggctcagtacatgtgggatggggcctgagaatctgtgtttctaacaagtccccaggtggtggtgatgctactggtctggtgaccatactttgggtatagctc

SEQ ID NO: 116277 - DNA, 1014 bp, Homo sapiens
ttactttctttcaatctttcaaatctcctctttcatttctttttgactttgaaaaaaatttccccctttcatttcctgcttcttatctttattatctgtagtattgattcagttgtgtgccttctagactatcgttcattctgagaagttttccttttgtctctaattcctgagttctgcccgttgatttctgagtttttctaaatccaatttgttttcttaataatttttttaacttgttagggttttcatgttttatggagatatctaacatgattctgttgtctgtagagatgttattatgttttttctttttttttcttatcataactttggacaggatttgagttgggtccttttctattactcatttttatgcaaattcattttcccaaacttttagaagaggcatgggttcaaaatagcttttctgacttcacagttctggtagtgttttttaactccaagtattatttataaacagttcatttttaagtgtacagtttacacaactgtaagtgtaagtggtagttttacacaattttgtaaccactatcacagtcgagatgtggaagaatacttttaccctaaaactttccatgtgcttttgcagttggtcccctcccttcacatctggccctaggcaattattaattttccaccagtatattttaccttttacagaatttcaaatacaggatatcttacaatatatattaaaattttttggcttgatttctttcacaaaatatgattttttgaggttcattttgctgcatattgtcaaagtatttgaaaatgtgacagctcattttctcctggctctgttctgtagtacttttgtctttttaacaattaccctgttatccttttctccccattttagattctgttcataggagtttttcctcagggtaagatttgtcctaaaaaagtgctttgcatcactggttttgtgaattcatagggcctagagttctcaagccccttcaggctttactgtggactccttgt

SEQ ID NO: 116278 - DNA, 1059 bp, Homo sapiens
gcccttgactggagtctgggaccttgaatttcgggagagttttcaccatttcgtgatgagagtggctcactgtgccttaactgtttgtgcacacagtgtggtttatgctgatcacctaccttcttggagctggaattttggtacatggtagggagatggtgcctatgggaccagtccggcatagaaaccatgggtgctgagtctctaatgagttccctggtggacagcatttcacacgtgttgttacaattcattgctggggaaatttaagtgcatcctgtgtgactccgcctggagaggattcttggatgcccggttccccctggactttgcctcaggcaccttttcctttgcctgattttgctttgcattctttcactgtagtaagtcatagctgttagtattactctatgtcgagtcctgtgtatataccatgagtcattgaacctggcagtggtcttgtagactcaacatacacctttcccattatttgcctttctaatgggcttattggcaggatttagaaatgcaaagttagtcatgttgtttaattacagatcaattataagtgaatctacaaccctgaagttttgtaatatagtacaatttatattttataaatcaaattaactgccaaaaagttagacaagtgatgaatttatgaactctgaaagctgtacacacagaaatgttttcagcaatagatttcatgtgttatatggtagtttttgtcattgtttccattttaaaatgatatttaaataagttctgtacccttgttgcctttgtctgtcttttttttaagcagggttagagtaatatggagttgatttctctgtccagcttttgacaaagatgtttccctcccactattgagggaaaaaaagcatctattgtatttttggtgtctgaaatattgataaaactattttcccatgttatatataagatttctatgcaggttcacaaagcatgaattctagccagatgttgttggtgagtttcatttcaaagcacatagaatttgtcttcttctacaatggtaaataatttagaatt

SEQ ID NO: 116279 - DNA, 2212 bp, Homo sapiens
agtcatgtaaactcttctctagctctatgaaattacaattctgtctttttggtattccgacagtaccttgtttcagtggttcacttgaggcatgtgcaacattataatagggacagttcacttttagttggagtcagggaacaaaccctgagataattggtagaacaggggatgctttcagaatccgaagcctaaaacaccatcccttagggtatggactgttggatttataggattattataccctgttcatatgagggaggaggcaactgggcagtatttctggacagcccacaaactgccataccaccgtgaaaaattatgtcttacacatctgttgttgacagaagataaaggcagtgagctgagatgcttttaggaaaggctgctagattgtggtttcttgattagtctcatgccaactgttatggcctggatgtttgtgcccttcaaaattcacatgttgaaacctaatgactactgtggatatattaagaaggggccttttactaagtgattaggttatgagggcagatcgtttgtaaatgggattaatgcccttatattaatagaaaagacttaaaggaactgtttgtccctcctccatgtgaagacacacagaaggtgccatctatggggactgagccctcactagacaccaaatctgctggcaccttgattttggacttgacagcctccagaactctgagcaataaacttctgtttacaaactgcccattctgaggtattctgttataacccaaataaacaaagatgccagctaagcaccgttctagagtcgacgtctgattagggcactaacatgttaactagtcacccctaggatggacttagttaaacctaattgtcagaacagcggaagtaaggactcatatctaaacacataggtaactggttagataccaactcagagcccaggctatcagccaaacttccaacttagatctttgaccatgaattcatgtgaactcttgtcagctacatagccaatcactgcctaattgtttcttcctgtaaataatgttttacattttataactgtctggctatttcacagacatttctggagctttgtgattcaaagggaaaaatataaacccaacctggttttccctaggaagatggcagatatttgtagaccctctactgtctgctaagctgtacaggtggtacaaaatgattgccttcagggagcttagatctattaaggagggtagaggcacaacataaattgctgtaattcaagacaaattaagttaactgctaccagagggagagaaagggctgaacacttgctatcctttcagttttggagttgcttcccgctgaaaatcattaacagattatcgttctttggaagctagatcaaacctgtcacagatacattacactaccaaaggacagcattgagttactaggcaacgttcctaatttgaggtaaagtatttctcttttccagggctttggggccttagtcaaaggagtcatctagaagtgaaggaatctctttttgggtactggtttttcgggctctgatattaggttctctaaagttctgggtgagggcttgttttcttaactcgggaaactggatgttacctaaatttcattatagctatgagaagggtggttaggtttatagcacaaacacttatgcctttcttttgttaaataatttagtgacctgctgttattttccttgcctttaaaaataagctctcaagcctgtaagggctgttgacagaaacatctaaggactggctgataaaggatattgaattactgcattagtactgcattgattagtacttcttaacacgaattggaattgtacatacatttattagtcatgctgtagctcattctcaaatctttttgaaatttattgaacttctaattttgttttggatagatactgagacaataaggagagtgtgaatgctttaactcagtttaaggaaataacagtgttttatacccactaaatttggccatggtaatgtgtgttttttttcttttctcttttttttttttttggagacggagtcacactctgtcacccgggctggagtgcagtggcacaatcttggctcactgcaacctccgcctcccgggttcaagcgattctcctgcctcagcctcctgagttgctgggactacaggcgtgcgccactacacccatctaattttt

SEQ ID NO: 116280 - DNA, 1237 bp, Homo sapiens
tccacccaccttggcctcccaaagtggtgggattacaggcgtgagccactgtgcctggccgcatgtgtgttgttaattacagagtaaataacacttgttgcatatgttagaatcttttttttttttttttgccgaggcgtagtctcactctgttgcccaggttggagtgcagtggcgtgatctcagctcactgcaatctccgcctccctggttcaagtgattcttgtgcttcagcctcccgagtacctgggactacaggttcgtgccaccatgcctggctaatttttatgttttttagtagagacgaggttttgccgtgttggccaggctggtttcgaactcctcacctcaggtgatccgcctgcctcagcctcccaaagtgctgggattacaggtgtgagccactgcacctggcctagaatcttgattaaaagtatttatcaagatgatctcatgctaaagaataaggaggacagttttaagtatcttgacatatttttctagctgattacacagcttttcatgaagatgtggctactgtgcttggctaatgataaaagaccatgtttggttctattcctagagcaaaaccaaaacaaaatgttgttaccattacttccctttcctgttcttgttttttttttgttagagtaactatctttgtcttgcatcaatctacttaacagcaccagcgttaatggactacaacagcctgatgaattttcattttgctccttttgtttgattttctatcagaatgctaatttttgccataatgtagctggcatgtttctagttcctgaattagttttttatttctttatgcacttacatctaggctaattatatttgattcttttacaggaattttaaacagctatcaagtaaaatggaatttatgacaattaatggaacaacattaaggaatctggaaatcctacagaatcaggtcaggcaaatacaagggctagttgattataaatcgttttgggaaaaacttctgagtaaggcagcagtctgtttttagaggtacaggtgaaaatatagtgtctttagctgactgcagtattaattgataactgtagctctttttggagaatgaactgtacataatatttctctgggttttttggggggaatgatggagctgccctttttaatgactgaggggcatgcttatcctgacaatttctgtaacatcatttctatatcatgtagttttttggaaaggcatcat

SEQ ID NO: 116281 - DNA, 1030 bp, Homo sapiens
aaggtgtgttactctgggaacatgtctttgtataggacaagcagaggacttaaagctctgagggatcaagggagtagaaagaaaatgtcagtctagtgaactaatctctaactgtgctttattttttatctgtatttttttcagctatctttagagatagttattctgttttagagataagaataactaagtctcagtttttccaaggtcatccagccaagcacataggggaccttttgaaagcatagttttggagttaatgatacttcagcttgagttctgattcccttttgtcactttggagaagttatgaatttgtatatacctcagtttcttcacctgtaaaatgggaattaactacctacctcattgtggtgttgtgaggaccaaatgagacagtatatgtaaaaggattagtgtggttcctcatagcaattttttggtcaagaaggtagccatggtctttagaataccaaaaaattggaagcagtgtaattattagtagggaaagggaaaataaattgtctggttatatattggaatattatacagcagttaaaatgaatgacttaagtctatgtgtatcaacatggataaatctcagaaaagcaatgttataaaagaacacataaatgatatcactaatttaaattttgtcacacacaatatcctgtttaggggttcaaacagaagtggtgttttcttgtcacataggcagtcaagacaataataacttctgggaaatgagaaaagggttagagatacaggtaggctggtgttttacatgtatttgcaatatttaatttttaaaaaattatacagaaaatacacacacatgaattttttataatgtactgctatttgaccttcactaccatcataatcaggtgaaaatgagacccatgcacatctgtctagaaagcccatgttgaacttgagagcatctgttttccagcacatcttgcattagaaagacagaagacagccatcagatgaccaaggcttccagggatggcagggggaaggctgg

SEQ ID NO: 116282 - DNA, 1069 bp, Homo sapiens
atatttctaatttgcttgtctttaattatatatgaagataatcgtatacatacttgctgttctctttctatgagctgcatattcagtttgtttagccattgttctttggattattcatctttttcttgtcaatttgtaagagcctattatgtttgggagaattttgccttgtgtctgttatgccttacagatattatccttcacattttttaacttgtttaacctatttttgctatatggtttatgttattttaaaaatgaaaaaatactaaacaagtattggctttgttttccttgcctaaaattatttcctttatacctttaaaatattacatagtatttaacctcatttagaaaatatcagtgatattttatttcaactaactagttaatagaaaatttaaactttcctcaattctgattctaacttttaaaagtcactaattaaacttcattttcatgtatcttatgctatttcataaaaaatatttctattttcagtgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaagtaagtaccagaccctgaattcttccttttcaccagtcagtataattcagtgcatttgccatttatttgtggattcttaatctttactagaataataatagaagttgcatgagtacatatataattagaaatgtgattggaccctaaaagtgttacattacagctggaatacttgctacctaaaatttaggcagtttaccatctaggacagatatagtactcccccacatatcagatgatggaaaggtaaaacacaggcaaagccaagcattagtagtttattaaccccaaaatgagtgtcagatatcttgtactcatttcctatatttccagagatgtctttatatttagaatctgtaaaagcaaagttatcctttaaa

SEQ ID NO: 116283 - DNA, 1030 bp, Homo sapiens
atggaactttttttttttttggaggggatgtagtcttgctctgtcacccaggctggagtgtagtggtatgatctcagctcactgcaacctccgcctccctgattcaagggattcttgtgcctcagcctcccgagtagctgggaccacaggagtacactacaacccccggctaatttttgtatttttagtagagacggggtttcaccctgttggccaggctggtctcaaactcctgacctcaggtgattcacccacttcagcctcccaaagtgctgggattacaggcatgagccactgtgccctgccctttcttatggaacttttaaccaaggagatcattacttttaactctttatcattgattttaaaacatttttcaaaaaggtatcttatttttacacatttattttcttgttttgtaaattattgctttatttttatagcacagggtacacatggaagaaaagttgaggaaccttcaattgtaagattaatttagttgcttttacttcatggtgaatgctatgcctgacatttcttttaagaagctgcaatttcattttctacctcactgagctccacatttctttattcttaatgccttccttggcacataattattataattctttacatctttttttttgtaacccagatcatgaattgatgaaaataaattaatcaaaaacaaatttagagaaccacattgggactctgccttttctccttggttagatactaatctccaggagaggactcatttaaagacaaggtattagggaagtatatacagctgtgaatagtatcttttgtggaatatttattagtactgttatcaataagttgcacaaacatgagatgaaaatggtacatttgcctcagatggtagaagagggaccgtagctggtaatagtgtacagacattctgttttaaggatgaagggaaattttgacataatgtgtgaatgattgttactttattacatatataatatatataatacatatatacaaaaaatataatacaaat

SEQ ID NO: 116284 - DNA, 1058 bp, Homo sapiens
acaacctgctttcaagaagcttccagtttagtgtgagagaaaggtgttgaaactgttattccggatttggaggatgctgtgaaggagaagcacaagggaagctgatccacatgaatatttcatgatgttattgaagcaaaatgaaaatgactgctatatttatgttatatcttaagttcaaatgtcagggtcagatgaaatctgtgatatattcttaatggttgatatctttacatagaagttgttttaaatttatatacaaaacagaagcctcaataatttagttattatattaaaaagtaaagctgtttggtgtaatctccatctctcttaactgttaggaatgcctgctgatcatctgtatgcttacactagctgataaagtgattgcttgttgtagagctattataggtttaagatatcagtttgctcacctttttgttgttgctgctgcttccgtaggaaattcagtgaacattatcactccttgtgtaaagcagtgcatcacctagcaactgttgactgcattttctccctggccaaggtcgctaagcaaggagattactgcaggtaagatatttttcattttcctctttatcagtgctttagataagatgacattattcaattaattatagtgtctttattataaaatattacagttactcaaatgtgttagactcttgggaaagctgaatgtcatacatatgtagcttgatttgaaaattaaattcatttcttgcttcctctgtcactgagtacaatgaaagcagatgttaaagtttatgtgggtgacatttttataaagtttcagcactcttttcatttgttagcttttacttgaacacttttataattataaaagtttgattaggcaagaaaagactgagaagatagggactgaggggcattttagtgatctgttccttttgttaagagcccatattcatcccactattctttattgacctctaaacatcccaacatggaatatttattctctttttcataaaggatgttagcacaaacaaatctaactttaaaattcagatggctgg

SEQ ID NO: 116285 - DNA, 1031 bp, Homo sapiens
cctctgcctcccaggttcaagggattctcctgcctcagccccctgagtagctgagattacaggcgtgtgccaccacgcctggctaattttcatatttttggtagagatggggttttaccatgttggccaggctggtcttgaactcctggcttcaagcaatccacctgccttggccttccaaagtgctggaattatagacgtgagccatagcgcctgtcctgtagtcactttctttgcaaaatgtgagagcatctgggattttattagccagatatatttaagaagaataatttaggaaagtagtatttattggtgttatgagtaagttcagaaatgtggttacacatgaaagttctgagtcaaagaactataggaggtcattggtaggatattatgcttttgaaaaaagaccaatgaatcaccaagaaactgatgaaaagatgttcaatcttagtaatcagtgagtgcaaattaaaacaatgggataacgctgtttacctgttatgttgacaaacattagaaagtttaataataccaactttaagtgagggtatgagaaaacaagttaactttcatatcctgcttgtaggaaagtagattggtatatctactcttgtctattaaaataaaaaataagcatactctgtgacttaggaatcccactttaaaaatttactctagctttgggaaacacttggacttgtacacgtggagatgtgtataggattgttcattgcatcatcgtttataagtaagaatttggatgcaatctaaatgtttaacagtggaaaatgtgtagcagctttgaaaatctgacaagaagtgatcttcagtatactctactgtaagggcctattgaacctaatttcagtttcttaaaggccatctaaagaacaaagacgaagtttactttttttcctttaaaaaggagagtaaaacttactctgtcttacacttaccatgtgggtttattggattgttttataaatgtaagatgcattttgggatctttagtgatcttattttttctg

SEQ ID NO: 116286 - DNA, 1040 bp, Homo sapiens
gactcttgttgtcctcctttactttcccccaaacaaacggagcctgtctctgctgagccacctagagctgagggaggggtgactcaagcacctctgtgaccaccaccactgggactgcactgggtctgacctgaagccagcagaatactgggtcttacccaaggcccgtggtaaccactgtctgactaccatctatgttcactcaaggtcctagggtctacagtcagcaggtggcaaatccagcctgaagggctatcattgtttataccaccatgcctggcaatagtgaatgatactctgggagggaagtaattaatttgaccttaatgatatgtatatgattaggcagccttgttctttgttagccttcaacaatagggatctttttggtcactgtcacaggagtgaagacagaatgacttaccttgtaatgtttgttttctgatacattgggccaaaagacccacaggaatccacccgtcatctccagaaagtgaagtttttatttgaagtttgttctagtgtaacaactttcatcacatttcatgtttcaatagatgccaaagcaaagcactgagtgtgttggtatttctgttgcctgcttcagcagtgtctggctctcaaagttgtagccttgctacctaacctgagaccaaaatagccaagagcgttaaaactggtatgtgggttgggaaacaaacatagtgatcaggcaagccattttagaaggggtggtggaaaaaacttctccatacacttaagtcttcttaatattattttttacttttcaagcatctaaatttcccctaatgcacacaattaaatactgaaatatacattagaatttattcattagaaaatttgagatactctacactttaaattgaacttgtaccgtagaacttttaaatgattaggaatgtatgttttatagttaaaagagattacttagagtaattttttgtcttcactttcaatatgatgccccccccccctacctttttttttttttttttttgagatggagtcttactctattg

SEQ ID NO: 116287 - DNA, 1034 bp, Homo sapiens
atcatttgaacctgggagacggaggttgcagtgagccgagatcacgccactgcactccagcctggtgacagcgagattctgtctcaaaaaacaaaaaagtatttagggtaaaaaacaaggatatactttttgctatgaaatatatcttatggccaggcgtggtggctcatgcctgtaatcccagcactttgggaggccgaggcgggtggatcacctgaggtcaggagttcgagaccagcctggccaacatggtgaaaccccgtctccactaaaagtacaaaaattagccaggtggtggtacacacctgtaatcccagctacttgggaggctgaggcaggagaatcacttgaacccaggaggcaaagttttcagtgagctgagattgggccactgcactccagcctgggtgatggagtaagactccgtctcaaaaaaaaaaaaaaaaaaaaaaaaaaaaatctatctatctatctatctatctatctatctatcttatggtttgaatcataatttgaatggaaatgtctgacccaaattcattcaattatgtgaactttaaaagaaatattaattttttaaaattttgagtacataattatatacaaatacaaattttgagtgacagtttttatagccactgtccatttcctatagaaaatgccatttttctactgcagacattccagttaataaaatgaatagtccatatttgctcaattcatttaagcaattgccgtctacaaagccacatatataacattgttcctgagatttatggatttattgattgaggttttcaaaagcaatgaaaccctctgatggaaaggatatctcgttgtttaggaacgtatgaaagcttttttctacaaatattgagatttcagaaaaatagcttaataagatgagaaatgttttaaatatgtttttgataacaagaattaataaagtcactggtatagttttgcagcgtgccaacctacgttttgttttcctaggtgtgtttccattgtagaaaacctggtcatggaattgc

SEQ ID NO: 116288 - DNA, 1082 bp, Homo sapiens
gtctagatcttgtcctgataatcccaaaggactctatgctgatggtaagtactgttaccctcatatagcagaaatggtgagtcatcgtgcagttgtgatttaatttacactcaatcacagttcttgaataaattcttgaataaattgcaaaaccttgagaattacattatttttatcaagtgctatcatatgtactaggctttttgtgcaatttgacttcagatgttaataaaacaaatcagaaaaaactaaggtgtatatttccaactgtgcttgcttcatcatttgtgagactatgtcatacatttctacttttagacataacagaagcagagagattatatctcaagctaatatgaggtttttaaaatcgtattatatattcagcctcagccagcatatcattttggtggaggggtgggtacagatgattcaatattgtagtaatgtttgcttctgaattttttttcttagttatttgtctggtatgggatcatgtagcttttttctctttaactcgggtaattaaggttcacacagtaaagtctatgcggtctaaagctttaaggcggaggttgttatctgttaatgtgatggctggtgccatcaggctctagacgtttcttgtgtcatgtcctgggtttccctcctggagaagtccagtgaaaaagcatagcttttggagttggtcagacttgggttacagcgccagcactgccactcactagctggggggctttggccaactaccaaactctgatctccgtttcctcacctatagagtggagatgataaaactatattttattgattctaagatgcacagtttttcaattttaatctcttggaaatcagaatgtatcttaccgttggtgggtcccatataattgacagctgtttttctttctgagaggtatgtgcaataatgatacatcttataatcagtggtgtcttagagttgatgaattatggtatttgcctaaagaatttttataaggattaaaatgtattattcaagtgcttctctttcactatggcatataaagaggccagggcctggaaaatgctcaggtgcatttcag

SEQ ID NO: 116289 - DNA, 1176 bp, Homo sapiens
aacacttattttagaaaccacatgtgttgtaattcacaatcctggaatgttgtttaaagtaggcaggtgggcatttttatagggttagggtgcctggccagtggaaggcactgaaacaaaaattaactttatttctttcataaatgcttacccccatctgatctgtacagtagaacagtagtttctaatctgtttttgggccattgactgtttgagaatctgacatgctattcaggaaagtgcatctgcttacatcttttgtttacaggtccaagggttcacagactcttgattgtctaagcattgttaagatccaggcttctgtgcaatagctcttgaacaagtgccttccatcatatctcatttctttttcctacttctcaaggccaggtgcaagaagcagtgggtgggtacaatttagtgctctgtgaggttaaaaggaatggagaatgaattaataggaatagtggcacctccctatgatcctggtctagctacctttacaactgacagggttgtgaggatccagtaagatgtgaaagtgctttgagatgttaaaaaccccttgcaagtatgagatggtattcagtggctttgctctttcaataggtggcggttgcaaactttgtggctctgtggaacatttaaagaaagattgccctgaaagtcagaattcaggtgagatctctgggcctctacttagaaggggtgagattagtattcctctgcgttttattctgcacttgttattaataactcaattgggatactaatgattttaagacaacctgttttcctactgtagcaatgacttaatctctgtcagcaatagacacacatagtattgagtaactgaatagttgggggaaaaaagtgaccagtaagccttaggggaccctgactttataagacacctgattcataagcatttatatttgctaactaatgaatttaatataatagagccaattctgttacttacagaaaaatatgaattcactgagaaaataaaaaatatgaaataactttcaatagccttaatattgagtgtccttatgtatgctttgctttgtatgtacctaaaagattcagagttgattgcagaaactaccaaaaatattaaaaatgtgttatctacacagtatctggcgattttcttcctgatgaaataccagc

SEQ ID NO: 116290 - DNA, 1023 bp, Homo sapiens
catcagttcgtgcattgcaaagtagttgctgcatttccctaattgggatgagaaattgcctgtggtactctgaaatcaagggttataatcaattacagaattgctcactttcctttagtgatggagtcttccctccttgtgattattcatatcaaaatgagttcctttcccaaaccaataacaatctgagtggatgcatttgattactgtttttctaacattctgatttttctattcctttacagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttgacataaaggattccaagttactgaa

SEQ ID NO: 116291 - DNA, 1312 bp, Homo sapiens
gagggaggcagagggactgggtaatgatgagcctctgggtgcagggagaggataggacttgatgctttccaggggaaatatttaaaatttcagtactaagttaagtctgtatcattttactttttttatagtttcttattttatgttgtatgagatgaaaagcttgcacataaaagatgataagaaattagaattcatcgtttctgttgtaccaagaagaaccttagtgatctctaaaagaattgttgttaaaatatggattcttctttccttctagtactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaattgcgtctgatgcaagttatcctgtgaatcacaaagtgtactgtctcaaaaaatagaagaaaatgtgtcttcgtctttatgttgaatcaaacaatttctcagttaccttcagtgaaaagtatttttttaatttttatttgagaaaaacacttcaaatcagtaaaagcttaactggggcctcacacagtatatttctgcaataactgctttaaacggagttcttgatttgtttgtcttagatgatacagaaatcattaaatagcccaaatcatttagaccatagcaataaagtgaccggggttgtcatatatttagcaacatcttttctctttaacatgatgaagcccaaaagtgataacaaaagcatttgcttgaatttgtcacttctcaccaggagtactagaggtaaatttttaataacatactaatgtga

SEQ ID NO: 116292 - DNA, 1178 bp, Homo sapiens
atcttgctaaccacttattttctttttatttattcttgcctctaaacttttaaataccaaagtatagttctgtttagccgcaggctctggatagttgaagcatgctgtcattgtttataatgtgagacgtggaatcacattatgtgcatggaatcaattgagtaaacatattaaatggtatcatgtttgtgatgatgaaatggtgggttgaaatgtgatgtgatgaaatggtactctgttcccctctgacacagggtcagggatcagttccatgtcatcagcatttgtctatgactggaggttttgctttgctttgcttttctgctgctatgatcaaggggagaggttgtctaaactgaatctcctttcttgtttctggcagtttccctctatttttttttctcctatgacctgtctaaaagtctccccttcttatcaccatatactcactataatcctacatacaggatcagttcaagtatgtaatttcactttcctgtactgaaactctgtaggctgtgaagtgattaacaagtattaatagattttccttgatgtaatgcatgtttataggattaaacaatcctcttcctatggtccagtgacccttttccaggcctaatcacccacctttcctcaggaacagtgcatgtttttggtttgagccctaatgacatctggcccagacatgtgccagctgagccattgcccctctgtgctcttccctggggagtcctgctttcacactataatccatccatacatcagtacacacctatatgtctttctgatttctgcagccggtctcagcttgtctataattcacttcattttattctctttctgccaactttctgaaaagttcgtgctcgcctacccaggattatcacagcttctggttaggttcctggaacctgggaccaatccctttgactttatctgcctttttctaggaggcacaattgttattagcatgttgaaaggaattgccttttaccctggtcctcataggtttccaataaaacgtttaaaaaatttcagggtccacatttacattttaatttagaaactgtcttcatccaaagagtaaattaccatgtgggattagatgcttctccccacagctcagatagtctagagctgtgctgttcaaaatggtaaccactagctacatgtgg

SEQ ID NO: 116293 - DNA, 1074 bp, Homo sapiens
ctaacttggtgttcgattagattgctaataacagtcattttatcttccaaggaaagttccaaagtaaatctactcttaaactaatgataggaaaatattctaaagcagttttcttttgagcctccttttcctctaagagtacataataaattctcaagtcctaaggtgtctcttgttcttaagtacagttgttagctatctttcttttttccttaaagttcatgtaaaaatggttgaaatagtgttatctgtatactgcatgtagaattaaaaggaaatgtttattaaaacagtgacctttcaaagtttggttagtgaaatgactaagggagttattgttccatcttgccttatcagtgggtaggatctcttcatcatgcccctgctgggaatgttttaaactctccagtgttttaggaactctataagctgagggtgggaaattgaataaatattgattctgaagctaagaaaatagttgtggtaggttattgggggtttttttatttttttttaaattttcatttgggaaggcattagtacttgtcaaagtgcaaagaatgaaatagaatacatggtagaagtctaagattaaaattagaagtatgctttgtccttagggatgctgtttcaatattcgaaacagtacagtgcaagagggaaattaaaattttcaacaatgccttgttttctaaatcttgtttacagaattctcccaataatatgagcctgagtaatcaaccgggcactccaagggatgatggcgaaatggggggaaatttcttaaatccttttcagagtgagagtgtaagtattcccttgactatattatactcaaattttatttctgaagctcttctgctagaataaatgcataaagccacttttactgctgtttatctagagttcaacaggtttatcttttagataagagaaactttaagtggaatatctttgaaaataatttttaaaacaaactttttcttttttattctgtgtacatagttagaaaaaccataataatagttttctcattgagaacctccactgtaaaggaacaaactggaaacaggt

SEQ ID NO: 116294 - DNA, 1060 bp, Homo sapiens
tttggttttcaatagaaaatttgtcagtatcatagaggaaaatgcttatcttctaatttgcactggaatgtatatactttctgagtatatctgaagaagaaaaatttggagataaatgatgattaagctaaacatctatatgtggaacatagagaaaacaatatgagagaggtgaacagtccagttagagaatccacaaggctgaaaaacatcaagtaaaagatctccatagcttgaaagtaaaaataagttgtggcagtgtcttgtaatgttaaatatattgtaaaattgagataagccattgttttcagtatgattacagtgattttcttcatttttaaaatagtttccaatgggtcctgggtcagatggtcccatgggtggattaggaggaatggagtcacatcacatgaatggctctttaggtaaggcttttcaatttgatgtttagaataaattcataacaaaaccttaattctacctagtgcatattacagtttccaaagttcttccatagccagctactcatttttaaatacttcaacttttacctcatacagatagtttaattgacattttattggttataactgtagatcacttgaagatcagaagtgtgagaattgttctagttcatattcacagttatttactttaacctatagaaatctcatgtcttaccataaaaggagacattgctgctgtgggcacgtgtcatgcttgcccaacccagaaggctgcagtattcttgcagctgtttgttgttgttgttattgttgttgttgttgttttgtctctagagttctgtggacacagtctcagaagaatctcagttctctccaagaatttcttaattttgtttttggatttttatgtttgcctcctttttaacataaaattgttaatcatattctggataatttgaatgattctcttttaagagaacactgcctacattgtcttcgtgataaagaccatttcaagtgactgatggttgaaaacatactttataggccaggcgccatggctcacatttgtaatcccagcactttgggaggcc

SEQ ID NO: 116295 - DNA, 1044 bp, Homo sapiens
tctgttttttcttatgcaatgccttatttttactgaaattttgtataattatttagggtcctccaggaggtggagggccaccaggaacacccatcatgcctagtccagcaggtattgtaatcaaactagccacatgggcatttgattattagaataaaatcacagaatatagaaattgttcatgaaataaagttagtagtattcatgttctcacgatagttaaaggagtagaggcagcatggtaggaagaaatatagtgttcttaaataagtattatccagttaagcatttagaaaattcctatggtgtgggtgtcagatttaattaggatgaacactgttgatctatatgaattgcccaaaaatgtgtctaacttaaagatttattgagactgataaaactaaccaaatcttctacaatttagaaaatttctgaataaataaaacattaaatacatggattcattaggtttaaaatgccaaatcagactcaccacatctattatcttactaagatgaatgaaggatgaagaagtacttacagtattatttaccctacatgtctataagtatttattagtcagcttataaattcactatgtaataataaaagttttttatcttctaaactaaaacatacttcaatgttttcataatccttttatataattactttaaatagttttatcatttatttttgagactttcacacagactattaaatgtgtcttggggttgttaacagtggaagactaaattggcgcacccttcttagaaaatgctatgataaaatgtgtcaagagccatgaaaaggttcataccatgtgactctatacttctaatactagaaatgacagagatacaacccaagatttatgtagaaggatgctcatttgttatactcaagagtaaaacagtagacacaaactcatgcctaattcaattttagtggaattagtaaattaatgtttaaggtgtaggttagaatataatagagccattataattattatcaaagaatttgtaatgacatggaaaaataaaa

SEQ ID NO: 116296 - DNA, 1577 bp, Homo sapiens
agaaaagagcttggtgaagagcttgatttgaagagaaaaagggagtttgttacccatatctgatcctcacaaattaatagtctttggagactcgtattaacaaactttttttgcatagcttagaaattgtatgtgtaaatactactaatttgaaaaattctggtttcccatttttagatacacaaatatatatatttctacttacagaataagtaattagtatcatgcaatatgcacaacttacctgaaaccaatatatcttaaagcagttattctgtctaaaatcctcttgactaaaatctgccttcttttgtgtaaatccaagttattattattcagttttccagtacttaaacagatacaaatttttttatcctttactatactttgtgatacattttaaaacttgacaaaaaatcatgaaataaattcattttaggtcagtgtccatattgctacatgaatcaaaaatttttttgtcctattcgtgttccagataccatactcctcagcatctcctgggaattatgtagtaagtacatttgggtttgtttgcttataagaattgatgttacattttatttgggcaatgaaacagttgtccagatgttaagaagagcccctgtgtattggccaagaagtgaacatcttgagttgtttcatctgccaacctcagtacatatgttgatgttcattagtgaaacagttatcaatctggccagaattgccctgagtactgtgttttacttcagcatatgtttctgaaaaccagtacaatacactctgtccaatcatgaagagagtaatccccagttacacagtaatatgcttgaatttgcggttctccaggagaataatctacaccccagtccaaccctatgcaccacacatagcgtctaagaagacattaaactttctcccaatcacaaatgaattagatggcagaataatgactaataatttagaggaatcatttcattttttggttgttctttgaaattgagaacacttatttttatcattattactatttagtacacattagaattttccaaaaattcatgtcaatgtgaagtcaaattaataagttttatatgacctcctgagcttacaagtgaccttttaatcatcatcatcacattatgatcctagctacatctcaaagtcaacacagaggaaaatacgttacaccatttagagggaaacacctaacagagaaacaaggataaaatggtaacaagggaaatctttcccacagaaatgttcagaggtggtggctagctggaggggaaaaaaagaacgcataagaagaaaatcagtgagcatttcactctccatggaaatagtattttattaacatagtgaaaagcacacactgctttggacctgtgaacttagtgttcagtgttcatgtaagctataaaactaagcaagtctttctttgcattttctatgaaataaaaatgaaagtaagaaaatttatataaaacctattttttcttaaagccactaatgaataaggctgatatatcattttatgaaattatagacatttatttaaaataaattttaagttg

SEQ ID NO: 116297 - DNA, 1126 bp, Homo sapiens
gcaagttccaaatatctaaaggctaattagattgtatcttaaagttgcttaagaatgatgataggcaatatagagtgacagaagaacatgagccaagtgctaaagacagagagagatgaaattggtcctaggagccgatagataaattggtggtttggaaagggcagactcacatttaaataaagagaagtaggcccagcacagcagctcacgcctataatcctgacactttgggaggtcaagacagatggatcgcttggctcaggagtttgagaccagcgtgggcaacatagaaaaactccatctctacaaaaaattaaaaattagccagtggagcacaccttagtcccagctacttgtggggccaaggtaggaggattgcttgagcccaggaggtcgagactgcagtgagccttgtttgtcccattgcactccagcctgggtgacaaaaaaagaccttgtcccctccaagaaaatgagaagcggaggatggatggtaggtagatcatgaactgaaagggacccaagagagcaaagttgtattcattcactaaatgaagtaaatgtttgctgccataaaaaaatctcagtactcagcagaattaattctaatccctagtgatgctgggcactctagcagtggccatctgcagtgctgaattactcataggcagaccaagcagagccttgggacatgtgttgtgtgcgtaaggcaaagcaagaacaccaaataaggagaaaagcttttcaaataacttaatattaaatatttccaaaaaaacaaatatttatcaagaggaaatcataacttggttgtacttccttatacttactttatggtttcatattatttttgtgtttaattatatagcaggtattgggatagatggtttagaatagtacaagcacttatcttttcactactgtaaaggtcctattctggccctggctgtctgacttcgagtagagagtaatctattggtgttcttcagaataagacaaaaatatctcttatggatgtacagcatcttaatacaagttagctagtaagcttgtgtgaaaaaagaaaatatttggatttaactttccctattaatatacatactcgagggcttacttttaaaca

SEQ ID NO: 116298 - DNA, 1050 bp, Homo sapiens
ggcttgcagatggccataatgctcacatggcagaaggaaagagatcatctctcttgtgcctctttttataggcgtactaatcccattcatgaaggctccaccctcatgacttaattacttctcaaaggtcccacctccaaataccatcacattggagattaggatttcaatatatgaattttatgcagacataaacattcagtccgtagcatacacagatcactagaacatgtagaaatgagaatttatacctataaatgtagtttccgtatgtcagagtactaactatgctacccagtttctcttataaagtaaataagcttaccttatgagtttttcctaattttgaaacttttttaaaagcatagccttgatcttcagtattcatagcactacatgttctatcaaatagggatgatgtaatatgacttttgaggaaagacaacagattgaaatattattttccctgggttttcattgatactcgccatttggtgaagagaacattctatttgtctcagattagtggactgatgtagaaaagaatttttatagaaattgtttctcctattaattacaagactgtgaaccttgaaaaatcctaatcagcgggtagtcatttttatcttccttgttcactgatatatctagccacttagaacagtgcctttgtgggtgtttaataaatatttgatgagcaggacatgatggttcatacctgtaattccagcactttgggaagtcaaggcaggataatcacttgagcccaggagtttgagaccagcctgggcagcagagcgagcacccatctctacaattttattttatttttttttttgagatggagtctcaccctgccacccaggctggaatgcaatggcatggtcttggctcactgcaaccccggcctcccaggttcaagcaattctcctgcctcagcctcccaagtagctgggactacaggcacatgccaccacatctggctaattttttgtattttttactagagatagggtttcactatgttggccaggatggccttgaactgct

SEQ ID NO: 116299 - DNA, 1254 bp, Homo sapiens
aggttacagtgagccaagacagcaccactgcactccagcctgggcaacagagtgagactccatctcaaaaaaaaaaaaagaggggggaaaatagctactaatttaattaagatgtttgaaaataaataaaacctttaaaaggctggagaatgcaaataatttgttaaaaagaagtaaacatgttaatgaaacagaaaaaaagtaaattaatagaccaattcctggcaaagatgatgagaatgctaattcagtttaagagggagaaaataaatcatcatctctgggggcctacaattcagaaagacagtccagggcaggcgggcagactctgctccacgaagtcatccagagattgaaactagcaggtgctctgccattgtataaggcatcctttttttttggtctgcatggcagaaattaaatctctgaaacatttgtgttccagacaataggaggagaaagaaaggagggagcattacaaacaagatcttaagaccaatgttctggaagtgacatgtgtctcttctgctcatattccatcagtaagaacctgatttttggtgagaacacaggggactgagaaatgtaatatagctgggatgccatgtgcctggctggtagaagaaaggaaaaacatatttttgtggtctacttagcagtgtctctcacacctgctacagtggacctttataaattatgtaaaagtagtgtatatatggataaaactaaatatttcagtgacatgaagtgttctgagaaaatgtaaatgaaccaaattgaagaaaagagaagtagaaaatatgaaaagataataattctttccaacattgcctttgtctaaggcagttttactgctttactgctgtgtcttttaactttcaataagtagataaataccatattatagaaacttcttcagagcattataaaaaacaatttgccatcaattccttttgaaaaggtagaataatcctgatgctcaagcttgaaaaatataatacatcaaaggacattctagacccatctcattgagaatagagatgtaaaactcctacataaaatattaccaaatataattcagtagcctattaaatgcatcatgcatgatgatcaagcatgacttatctcagaaatacaatgaagatttaagaaaactatcaatatgtgattacttatatcatgcttcccaaaagaaacactaaataatactactccaaaaatgaaaaggcaaaaagcatattttcttattcctga

SEQ ID NO: 116300 - DNA, 1047 bp, Homo sapiens
tgtcctcaaaattcttttttgaatacctactttttgcaagtttttggcaccataaaattatgattctgtatgtttatacagctttcagtgaatgcatttataacagctactgtgcacctaggtgcaagagattccagtagtaataaggcacagctctttcacttgagaacttcattgactcaaaggagagaaaaacactcaaaagattataatatgtacactatactattctgaatagtttgtgttttctcctataggaaatgaggtatcttcatttgttttaaagttttcacttgaagaagtgatttgaatacatttatgcttatgaaaagataactgttggcagcctaaaagatggatctgagggagaagaaacagaaaaaaaaaacaaatggggttgtgtaacaatcatcaacaagatgatgaaaaaacttgattttgacagtggcagtgggcaaggatggcaaaaataccaaagatatttatccagccttgtcttttcatctgtgtttcagttgtatgtttctcactggtctctaaaatacctctaattgtgtatcaactcaaattcaactaagtaatgaaaataatagccaatatttattgataccttactttgtggtagacattgttctaattgcttcatctatattaactcgtttaatcccccagcaactctataaggcaggtgctattaatatacacattatctgaaggaggaaccattgtagagtttcagtaactgaccagtgtcacacaggatccttattcttcctctgtttttttgaaaaccataatgttacattgtctgaaacccggcttgatcatttctcttaccttctgttctatttgccttcatttctctgtatcgctatctctgtctacttttcttcctaacctggcagtctgcatcattttaaatgctggtttctctgccttcaattttcccttattcctcttctttttactgccagagaaatatcactatcatcatgttattgagttgattaatgtcttggaaagatgtaataattctctatcactcat

SEQ ID NO: 116301 - DNA, 1100 bp, Homo sapiens
gtgacaacatagaagcccaagctaattagaatgtgaagacaatgtggcagggtcaggcaaagatgaggcatcctggaagatgtataaggaaaatgctcaagttgccaaagaagttggagaaatatttttgataatgccactaaggacacatttggtgtctttaatttcttatatttaaccacaatttacatgggctaatatatgagtagtccctgaaaatgactttccataaaaaacaaccaaaatgagttatataaattataaatcacatttaggaacatttgtaaatgttccttatttcctaagatacagatttttattagtttatacagatgttcttagttttgtgacttactgataatgttttatattagtgatttatttttaattagaaaaattaaatttattttgctataaataaagtctgtactttattatagaagtggaggaccttgttttgtaagaaatcacaattatttctttaaacaaggcaaagaaattttatttggtcaaaaataatcagaaattacagaaagcaatattgagtgaagtactgttattaaccagatgaaacttaaagtagttttactgtggtattctactgcaacatctgcacggtggcactacccagatgctcactataaagttcaatggctcctgacaagcattaagttcctttcagtggctgtactatgttaggagtcattgaaacagaagagaaatcagattttaccaaagtttatctcttaagtcaacacatttttatttaaattatcatcatgaatggtatttattatctctataatgaccaaatcagttgttgagagctatcttagtataaaagcttaggatacaaattactggcttgcccataaactgtcatgcaaaacaaacaaaccaaagcaaataacaattctaaacctctttttctatttgtcctttaaatataagtcaaaaaggctagtggtttattagctataactaaaatataatttgtaggaggaatttttatgtaaccattgttaaaaacaaattaattcaatagagaatgagcctcagagcaagaatatatgtggatatacatagtgtttttatgtgaa

SEQ ID NO: 116302 - DNA, 1043 bp, Homo sapiens
aagaataggaaaatttaccttcaggactttctgccagataatattgttgaatattttagtttatttactcttagaatctttattctgggaattaaaaaggtaagcgaatctttcatgtacctcatcaattttatgtatctgaatgttataatctactttagccagttacataaataaaatcaattctatatttaagctaaaaaataaaacatacaaatctggagacctgcctaaacagtggcactttagggaaaatataacggggagttttaggtcattataagttgaacatattgtactacacagtactgtaagaaggaatagttccatggtaatatgtttctgtttgttttgatttcctcttgaacattaccttttaaggagaatgttgactagcttagatgctattagaaggctgcaaaatgcatttttgcccactgcactctcacctcccaatgtcttgctaaagccttcaaaaaataaagaaaagaaagagaaaatgaaaagaaaaaactaaaagagaaaatcagcaaagcacatattcaaaacctacaagctattgtgtcagagtttgatttatggatttatggcagaatctaagtaaatgttgtaatttgaataattggacaactattagggagacaaaaatagtgtcatctaaaagctaagtagaaactgtatgtttgctccacaaaagaaaccaagataattcctctaacctgtcatatataggaattctgaagtatctactgtctagaaatatgtcatgtgataatgaacttatttgccatggagaagaggacaaaaaacagatgtgatagttgtcttcaaaaatcttttagagctataatgtggaagagcagtaggagtaaaagacagaagtttcaggcaggaataattggacttgctacaaagaactgcctatattagaaggactcaaatacagattggaaggttgtattatggacttcactaggggcatgtggaggggtaatgacctaagattaattctgatcttgagaccgagatttccctctggtaat

SEQ ID NO: 116303 - DNA, 1916 bp, Homo sapiens
ggcttgtcctggagatatatgaaacagtgtaaacttgtaagctcttggtgagggaaatggaaggagttggaagaacattttctgggtcttttcaaaatgctaaaggtcccctatgtttccttttatttaatatgaagccagagccgaaaggaatacattaggaagcaactgttttctggatgattacaaggaaatggtgttccacagcaaagtaaaatgccaactaagaatgaatgtaggatatatagtaaactgcaaatagaataaggaaagcagaagcacaaaattagaacgaaagcaaggtcatttgtcctgaaaatcaataaaactcatttctattttcccatataaaaattataatttccacataacttggtaagcaaaaaaaaaagtatagtaaccctatattacataaattattacatctttttttctacatcttttgccctatgtcaagattaaccttcacaatgtgatacaagaacttattgaaaatagtggaagcattcgttattaatagcaatagtagacatagcggctaacattattaagtgcttatgatataccagattgtactaaacacattacatgaatcatcatatttaattctactaaaacctctattggatacacattattactagccacattttatagaataaaaaagctttagaggaattaagtgacttgcccaagatcaggagcttataaatggttcagctgggatttaaaccgaggtagatagagcaaaagcacactcacaaactttaaaaaaaatcataggagcacattataattccataattattcacatagattcatattttcctttaatcagcaattacacatgtggattaactatcaagtcaacaatatcatgttagtgactatttccaaataagaatcagagtatacttaaattacagagccactgaagtcccacactgacagcacttctataaagtaccctcttctccttgttccttcttgccattccaaaatcccagagaacgtcagtgcttggaaaggatagaatggcattacaaaaaccagactgacctattacgttaattaggaaaaatttttacttataaaaagtcatcatataattgaatttaaattgtttctggatttcaaaaaatgtatataatttaacaagaacagggaaaagggccaaagatttttaaaaagtatcaaaggaacaaaaagcagtaaaagggaaagaaaaatgagtaagagggaatgcagaaaaggaaaaaagaagaaaattgataaaaaagatagtgattaagagtgagaaagattaacagaagtaaattataaaagtaagttataaatttataaaagtaatttacaccagtaaaggtaaatcacaaaaagtagactgacagcaaaaatgagaaaaaaagcaattatcaactttctatagatctcttcattttttttttctagacttctgttctttagtagctattcagacatagtgcttgctattttgtacgatgggaaaatactaacaaaatgccacactccctaagtaacaatctatccttctctgttaacaattttttttctttttggagtacatagactaaaattaaagaacctaaattgtatacgaaatatgccaggtaaagaaatctggatttcttcctgaaagtactaggaaatcattaggcatttttgagtagagcttgataaaagcagagtttagggaatattattctggcaacagggaaggtagcaagaggcaaaagatagtttggaagatgctggcagatgaagagggggttgagtcaaacatcaaagtttcaagtcatagaagaataaaaggaaaatgatatcaggaatagaattatgaaacccacatggagaaaacaagtttcttattgttttttttcataaagtttttcttt

SEQ ID NO: 116304 - DNA, 1916 bp, Homo sapiens; identical to SEQ ID NO: 116303

SEQ ID NO: 116305 - DNA, 1017 bp, Homo sapiens
aaaaactgaggatttctcttaattattagtctacctcactttcacacgagacgtcaaactgaaaacgaactattatcaccaagaagacacattatttctagactttggagataagtgtatgtgattttcagaactattcttcactatctaggctgccaaactctgaatggtgctgtaaaaatgcattatcaatacctaaataaccaatgtaggggaatggctaaattaattgagctgtaagtttttaataatgtaaaataataagttagattaatttggacttatgtagatagacttccaaaacattgtctagtaagagaagaaagccaaagtatgccatgtatctggaaaccctagtacataaagtaatactatatatttttgtgggtacatatttatgaatataaagtatagtatgaatataaagtatagtaaaagttctgaaagaacttacatgccagactagttgttttgggagtggggacattaaagggttcaaagggattttatccttagtcacagaattcttttaaacaaggaatacatatattatttgtacagttatttaaaaacaaaactaaagaagagaaaatatattctcgtaaattatctgaacttaaaagatggaagcctggagatagatttgtgataagccattgctgagtacatcctagagttcttgataatttcagttggttaaattacaatagtttgctatttcctccctcacattttatgttctacagtatctagctgcttgggttttcctgtataccatggggcttctgtcatctgggctttactcagtggcatattccctctgcctaaaactctcctcccctctccaccttagaagtagcttttcctagaacggttttcccagggtttcacctaaggtgatagtacaatctacagggacctgcacatgaagacctttgcatacatgccaggaagttggactttatctttggaaaaagggagcctttgaaggttttaaagtaaaaaaaaaaaaaaaaa

SEQ ID NO: 116306 - DNA, 1770 bp, Homo sapiens
ccaattttatgaaatagggactcttattttcctccctttacaggtgaggaaaccgaggcacagaaagattatgtagttttccatagtcaacatggctaaactaggaagtggaggagtaagaatataaatctctgtagtctggctccagaacccacactgttaaccattatgctaatctacctccatatactgttgggattattttggatgagataaaggttttatttttttttttatcatgtagagtgatcaattttgtctactacaatttattatctctttaggctttatttatcataaatagtatgcagacttactgttggtgatatatctgaagataagttgttaccttagacttttctggcatgtcctaaaaggctcaacttctttccctcttatacaatggatatatttctgataattctctcctattgaactgtcattgattcacatttttctaagattgcctcctgcttttttatgcttttatttaagcatatggtaaatttctggcaaagcgatgagctgtaggaaaatgtttcttttttagataaaatcaaatactaattattttgaaggtgaattgttatattttggtatatttggaatagatatttcattgataacttattgagcagaatcaactagctgagtttagtctttaaaaacataaaagcctattgtttcttttgttttagttctaagaaagatgctcttaaagacaagcacctaattatttaattcccttcctgcatcaagatatgaataaactactaatattatagaattaaacttgccctactttaggcttttataccctcttaactatttaagtttatgcctgaaagggaagaatcagatttgttatttttattgttattaaatgaactttaagagcattagatacggtagttatattccaatctagacacaaacatacagttccttgcctggctcttcaggatttatttatggtgatatgttaaaggtgctaaaaataattacgtatttatattaacaaatcttggaaaaagatttactttttaaacttgatttgcagatttctttttattcgtgctcccatgactgtaatgttctttccttcctgccaatttttgcctattccttatattaaaacatattatctcacttctttttagaattcatctgtgccttattccagttcactcttgtaagggtgatgcttgtgatcccctcagccctcatgtattcattcgtattatattggaggtaatgttttgtttctatggaaatgtgctttttagtttcctatttgtaggtttgtgcttgtcagttaagaataagttgttttcagttgaagtcccctctagttatttctacctatcagcccctcatattatactttggcttctaaaagaccagtatatattggacacagtaattccatagaaaaatgtgactaaatgttgtaactgtataggtccttatcatgacatttaaaaattcatcatcttcccatttctaaccaagaggaacactagcaaagctactctttatcacaagattctttctttgggattcatttggaaggtaaaactgatacaagatacaaaagcatatttatattaggatagaacatcagaaaacactgcctttgcgaggaagccacatttttcttccaaggtatctaattagacaatcctcgtctgtctactaccattacttaatttaccctttacacccattataattggaccatggttaccattgtgtcctataagcttgcca

SEQ ID NO: 116307 - DNA, 1105 bp, Homo sapiens
ctgtgatctcataatctgttagagagttctgttgttttagagaatttagttcaggttttgaatttgctacaggatagtaaggttttgattgccaatttttgaaaaggcttcatggctgcctagtttttgtttttgtttttgtttttgttttcagtttccatgttgattagttagtcactggatactgaactgctaaagaattagatttctgttacagattttggcattataaaactctttggtttgtgtataggacttggttggaacgtaaccttagtcggtttttggttctttgtattttgcttagtgtgtgaactggttcatgagctttttcatttgggtgcttcactgggacatcagtctgaagtagctacctgtaagatttttgtttgtttttgtttttgcttgttgtctgtgttggaagagttgtatagaagttaggaaagatattcggggacatttttaggtcgtgtgattctcaagcctgatctagaaggattaactagatgccttagtatgaagcatacagattggattgccatattcagatgctgtaactaaacatctcatcaagcagtagtaggtttatattttttatggtatccatccagacttgattaacagttgacagattttaggtttcctactattgtggctctttataaaaatccctgaaaatctgtatatctttggctttatttccatttagttttgtttttaaaccagtcttctacctaatattttgtttcatgttgattgtattacctagcaagcatgtctgtgattataaaaacaatatagtaaaaagaaaaccccaggttattgatgtgctatatatgtgtgtatactttaaacagacctagttttacttttatgtggaataatcaggaaaatgtgtgtaacagttcaacagtaaaatgaatcttaccagttagaaaatcaatacagagattcaagcttttcctctgcttaaatatctactgttccgtatgatgtcaaaccaaactgtgattcctaaaaatgcataactgatgacatttttaaagtagagcaaaaattttgttcagaagcttagaggcagagaggggggaagtgccttgatatt

SEQ ID NO: 116308 - DNA, 1049 bp, Homo sapiens
atcatatagtatttgtctttctgtggctggctacttttgatagcttaatccctatagcaacttcgtaaagtagatataatccccattttacatatggggaaactgagtctcagaggttttatattttgtccagggccacagagtaaattgtatagtctggattcaaactcaggtttctgactgcactgcccattttaactattttgactcagtgtgtttcatcgcttaacatggcggaaaaattgtaatggaagttgtgggaggtggcatgaggatgggaggggaatgtgcatattcatcatttttagttggggtgggaggcaatagaggttaagaagttaagggaagagtagaagcattttatagctgctaaaaaggtggatagtattataggtaccaaaagtgccccacagatagctacaaattctttagctggtatctgagatttaacaacatggatgtaggtgctcaccagagaggaagatgccaattaagaactcaggttataatttcagatagagctgtttctcattctgtaaccagaggcagagtaatccggcataagttactttaaactttggagtcaggaatatgtgatatttaggaaaaaaggatcctgtaattatgagtctcttttgttgtctcttccaagcagcgtatggcctattgggctttttttggacaagggcacctgagaagctccgtgtgatacaggagcagtagtacaatcatattggttctattacctagtcatttctgtaatactggctattagaaaaaatagaaataatttctttgttttatttttttcacatcattatgtgctatttgtcatttataattggattgaaattatttgatgattatacattatcagtatatttaagcgctagctatcctgggaagctattaaggtgttttggtacattcttttttttttttttaccctggattaaacttagtgactgatactgtattccttcacttagaaatattgtaatggaaaaacttgagtgagctttcttgctatcagatatattacacataca

SEQ ID NO: 116309 - DNA, 1046 bp, Homo sapiens
aagcattcccccatcattaaggtaccccctgcaaagaaaaatgacaaacctttctttctttctgaaggaataaggcaagaaaagtaatagagatctcttcagaaacttacttgacagcaattcgcacaattcaggatttccaaaactaatgaaggagtatcttatggaagtgaaattttgtgtaaaatattaaattgcccctccccctttcagtctccaggatgttcccccaaaatacaagttgtttaacttgtatccgaaatgtcatgttagcttttgattgatctttttctgttatttcagaagtatcaaaaaaacccctatttttaaggaacatatctaaagaaagaatctgtgtaagatgttcagagttaagttttggtattgtttatccagagattaattgtgactcttagaagtagtagtaatattgtaattttttttcagagctgtgagagaaaaaagttgaaagttttcagtttcacgctttcaaagccagtttgccacataaaaccaatttaggatgcagacaaaatcactacattttagttgttctgcagtaatagaccaaatatgcctttcatctttaatcacttctagaattattttgttttaagattagagcatactctgtggggcaggggctggaatacccaggttgcagtttattaatgtttattaatacttcacctcagtagttgagagttagaagtaaaatttgggggaaaaaacaattcaaatttagaatcttctttcttccatagaaatcacaaccattgcattaatcctgggacataggacaaaagtactgagtttgaaagacatggaactactaggaatatataatttaaaaataggatttcaaaattattttggaacacatgaggttattctctattattgtgtgtatgttattgctttgccattggtgtgggaattacagattatatatttgcatgctagtgacatgtgagcctctgtaagcgtatgctaaaatattaattttattaagaacttactgtttctgaaagggtggacttaaaata

SEQ ID NO: 116310 - DNA, 1049 bp, Homo sapiens
attgctattcttgatgcctgcttcatcagtacgtttctcttcctggctcacagaatgagtgctgccccccttattcaaggctcacccctgttcctttgtacacatttcacattcattggtgccttccagattttatctcataattcatatctctcttctatcttcaactgttccctttctactggtcctttacttttagtctaaaatgtgctcattttcctttttacccaaactactcagcattagcttacatcattctcttcacttccttaccttctattcttctctgtgtttactgctttcaccttcccccgcttgtgggtcaccagtgatttcatactggcagatgtgatggcatttttagactggagctaatgggacctctcttttacattggacaatgtcagtcactttacttcttagagctctctatcttgttcctaggttccaagacactgctctctcctagccccctgaaaaccttcctagtctctctctctgtctcccttaaaggtttccctgctgtccactgctcttctcatgctacatattctctttgggcgatctaactactccacagttttattttttcccttatactgatgacagtcagatctatatgtatccactcccatgctctacttggaatttcaaatattttctgtatgtttacaccttgatgttccaaaggtatctcaaattcaacataataaaaacatgacttattatcttaataaaaacataactcccaagtctgctttctctgctatattctctatctcagtttacagtatcacaatttcagccatgcaagccaagttcctaagtgtcatttttgtcttctgatcttcactctcaaagcattgttgaccttccaaaatatttagtgagttgatttctcttcttgtagcagatgctgatggccatctacccaactaacattctccttgccttctcgctctaatatccgcatgactagtaaagctatgtgcttgagggaaagctggcattagtctcagtcccagctccaaagaacgagtcttgatttg

SEQ ID NO: 116311 - DNA, 1028 bp, Homo sapiens
acggagtgtcgctctgtcgcccaggctgtagtgcagtggcgcgatctcggctcactgcaagctccgcctcccgggttcccgccattctcctgcctcagcctctcgagtagctgggactacaggcgcccgccaccacgcctggctaattttttgtattttttagtagcgacggggtttcactgtgttagccaggttggtctccatctcctgaccttgtgatccgcctgcctcggcctccccaaagtgctgggattacaggcgtgagccaccgcgcctggccacgcctgcctaattttttgtatttttagtagagatggggtttcaccgtgttagccaggatggtctggatctcctgacctcgtaatccgcccgcctcagcctcccaaagtgctgggtgagccaccgcgcccagccctcttttttactttgatgtttggtttgtttaacgtttaattacagtatatatttatgataggagaataaggtttgtgaacacacagttaactgatgggagcagaggcgcttcgtgatcagcatgctgtagacatgagtcagtgtcgattaatctggcaagttggttagatggaggttggataagagagtttctactgtaattatttgtgttttttatctccctttgttagaatatgagctcttacaaggcaaggactatatattttttcatttttgtatacctaacctttacttatgcacagtgcctgctacttaatagatattcactatgtatttgttggatgaatgaacaaactcttacatagattatactgaatttgaataatcagaaatgacactggtttaggaattatctagtatagacagatcattggccttgaagccaaacaggggtttaaaatccttgcagtttatatgattttaattcaattgaacaaaggcatctagagtgtttactatgctaagcaccaaagatatagaaacgggaataaaaaaacaaaaacaagctgggcactgtggctcatgcctgtaatctcagcactctgggaagctga

SEQ ID NO: 116312 - DNA, 1079 bp, Homo sapiens
caagcgtgagccactgtgccaagcctgtttcaatttttattcatcttattttttctatgattattgctgagttgaaacaactgtaattttgtatattaattttgtaaccattcagtcaccttattgaatttccgtatttgttttcatggcttttcagtggtttctcttgggtcttctaggaatgaggtcatctgcaaactaagaggtttattttttattgttttttaaattgacttctttgtgatagttctctctattattttatgcattgactagaaaaatgttaggtgatgatgataaatcttgccttgaacctgatttaatattaatgcttttgttataaaatgattaaataaaatattggttgtttattcattgaatgagtataggtttctgaccccttttgacctgtaataatttgtgtgattattccttggggactttgccttttcaccagttttttttctttaagaaatttttctttatcttaagctggaggcaagatgataaaaattcctgttaaccattccattacctggcagaatgtgggaggggaaggctagggaaggagctgggactgtgtatgcatttgtgtttgaagggtgaggaggctggtgctgagaaggatctttagtagggaaattctgtctgtcagaagcttctccactgaagttgtaaactaatgccccagaaccagttttcaggatttgtttctattattgacctttctctaaaaagggatgtgtaagtctagccttctgttggctgccactggttgcttaggtaggaaagttccttaccctttggagtgggagttacacccactgcaatgatgagcactgagatggtattgaaacattacaataaatgggtcaggcttccagggacagatcaataggaagactgagtctggaaatctgtggctgaccagagtgcatggcctattgctaggctggaaacaggagtccaagtgttaccagatcttttgatattttgagaaaggttaagcattcagatttgggtggagagatctctggatttttagatgttggcaactaattaaaaaagattatttttcc

SEQ ID NO: 116313 - DNA, 1022 bp, Homo sapiens
cttctcacctgaaccatttcaatggcctgacaactcttctccaattcattcaacacatttctgtcatggttaatcctttaagaagtatctttgtagaagtcccattttctatatgattttttttctttgtttcagtttgggctctctcttgtcacagaataatatagaaactccatcacagagtattccaggccccgcattgtggcttcctgctacctttctagcttcattgtctactctaattcatttcctttcacgctgtctccagagtcctaaaaatgaaggaaaagctattttgaagaataagtaagtaaacttttatcagcactagaaaacaaaaaaatgtatcatcaagggattataaagcttgatgaatttctgaaaggtagaaagaaggaaaaattggactgaagaaagaaaccagatcccaaagcagggtttagagaggactgtggtgaaaaagtggagggtaggggagcagaagggagggctccaagtgcagagattgtggatccaaatgcaattctgagttccttactctctgcttatataagttgtttagaagtaagcatattaagctaataagctttaattaaagcctcttttttacttaattttgggtaatcagttttacccttgatatctttatagtcactgcagtttttaagattctgtcttactctagccttcttagtttgcagaggtggttctttttatattaggaaaaatgtcaggagcaaatatgtgaattattaatgttctcctagagtcacactataatcacatggtcagtgcatgtttgtcatggtgaatcataaaaatacatctagaagccaaggtgttagagttgttttagttcatcaagactgacattgcataaatgagtccctaacattctttggacagaaagaatcccaggtggttctcctgcttttgtgccttcatggattcctagatctgctttctgttctagagagctgaaaaacattgtataatctcgaatttcaccttgtttttgagat

SEQ ID NO: 116314 - DNA, 1081 bp, Homo sapiens
attactgattaattgctcttttggttgccattgagttccagttaaatcttgcaggctagggaaccattttttttctcgttaaggtaatttgcctatatcctctgatctatgatgagttaatttcatctttaactcagaaagagttttcttatatatatatattttttgttatttagtttttatttcataatcataaacttaactctgcaatccagctaggcatgggagggaacaaggaaaacatggaacccaaagggaactgcagcgagagcacaaagattctaggatactgcgagcaaatgggatggaggggtgctctcctgagctacagaaggaatggtctggtggttaagataaaacacaagtcaaacttattcgagttgtccacagtcagcaatggtgatcttcttgctggtcttgccattcctggacccaaagcactccatgacctccacaatattcatgccttctttcactttgccacagatcacatgcatgccatccaaccactcagtcttggcagtgcagatgaaaaactgggagccatttgtgttgggtccagcatttgccatggacaagatgccaggacctgtatgctttaggatgaagttctcatcttcaaatttctccccatagatggacttgccactagtgccattatggcgtgtgaagtcaccaccctgacacataaaccctggaataattctgtgaaagcaggaacccttataaccaaatcctttctctccagtgctcagagcatgaaaattttctgctgtctttgggaccttgtcagctaacagctcaaaggagacgcggcccaagggctcgccatcgacggcaatgtcgaagaacacggtggggttgaccatggctaatagtacacagttttcctcggcggcgtcatctgcaaagccgctttcttatatttcttgtcctcaaggtcttggagaatgtttccaagtacagacaaaattctgattatgaatatctgtaaaaatggaggggaaaaataaccaattatttcacttccttaatacaattgtgattattttggctaattcccctcatatgtggggaattt

SEQ ID NO: 116315 - DNA, 1036 bp, Homo sapiens
attttatgtagttgaaaaagcctatagtccccattagttccttacacttaaaaaatacttatttttttacagatattgttcttacttttcaatcttattgaataacttttcattaaagctacaaagccagcatattcacaaaacaaacacagtatcaaaaaagttagtcactagttaggtaatgaaatgacaatcgtctcaaatttggatgtatgtgctcagtagctctttttttttcctcagcctaaatgccttactggcaaggaaaagttacgagttgaagacaaggtgccaagcaaactgcactggcacctcactacaaaaactcagcaggaaaagatttgaacattttaaggttctgcaaagcaacaagaaaaaccaaagctctttttgagattggttccaacaatgttagattaagctaaataaaccagttacaaggtcacaccattaaaagctaaagccaaactgtctcaaacaaggatagaagccctcattttaccacctagtgtgaaaattgtttgaggccaataaagaaaaggaagaagtggtactctcaatactagtgaatgtattgacgttatattggatgggataaagatagcattaatccagattattatcaaatgagtcaggttttatttcagattgatgaatctatacacattagaaaatgctgaattgctgtatgagttatgattcctaaagagaaattcttggaaaaatatcagttctttgtaaagaagtaccaaaacaaattactggggatgaaatattgaaggtggtaaattcatactttgaaacaaataaagtatggaaccaggcttgagtttgtacactgatgggtgactgcaaaaaaaggcataatggcttcacatcaagggtattgtgaagacattgaataggattcaaataattcaatgttttattgacagagaaactcttgtgtaatatacttttcctgtgtaagagttccacactctgatgtgtctaaatggagaatctactgcaactgaggctgcttcacttatgtctg

SEQ ID NO: 116316 - DNA, 1250 bp, Homo sapiens
ttacacataaaagggttaagttgagtctgcataaagcacactcttgcatttgtgtcctgctgatgatacctgttgtttctccagcagaatgtagtcagtcagaagtcatgctacttgtacctccaaattgtgctaactattctacctgttggcaacactgtatggaaagaatctgagctgtattttggcttagatttggagcaactatagcagcctgctgcttggaatgctctctttgcctacgctggcagggctgggcctgcccagacaaggtagtgggaccagagtatgtagccaaaagtctgtcttggtgaagaaagagaagacttaattctatgttgcttcagatgagacaagtaggaccaatgagagactctggttagtataaggtgtaactgacaaatatatgctgtttgcccctggaaacgtgtaaggagatgatggttgactgcctgtctcaggtgtgatagatatggtttttgatttgcctgaatggttagactcagagtttatatatctgtgctcagtttcattcttccctttctttcattttattcaggctcttttctgtcttttctatttttattgttatatatctgtgtgtttttcttgaaattgctagaaaatgttatattgcctgcttcacaatattccaattctttgattgatctttttggtgtcagttgaactataggtcattgactaaaaattgccatgaatagccattcaaatccataaacttttactgttctttttcctctctcaattaaaaaaaggttaaaaatttcataaggaaagcacatatgcttttacaaaaatttgcattcatatattattaaaaattcaagcaatatagaaatatatatgataaactgtttaagtatctttctgtcacctttcaccctgtctgctaactcccaatctcaaactcctcctcagagattaccagtgttaacagtttgggatttgacttcaaaacttcttcctatgcctttatatatattgttattatatattataatatatactattaagacattattaatggctaatacttatttagtgattgctatgtgccagacattgttcacacctttttaatatattaattcatctaatccctttgagggattttgagaaaggaaggccaagaggagtttagaaacttgtccaaagtggcacgcgaaatttatatgccaggaaatctgtttgggatggagctcatgcattttctaaccatactatcctgc

SEQ ID NO: 116317 - DNA, 1049 bp, Homo sapiens
taagattggaatctactctggcaatgtggtggcctggaggcatatgtgcaaagggcaattaattatttgtttaaaatgaagtgccatgtatttataggcacaaaagaggttttacattaaaaagttaagtctcctttctaacccttctactttccttactcaaacctttagaggttgccagtgataccatggtcttgggtatctttccggatatattcagtgtacacatagcctgtacagttacatttaaacatatggtagcatgcatatattcatactgttctgcgctttaaaaaataacttaatggtcagccttggtcattactcaatatttacagaactcattcattatttttgtggttacatactatcccattatttggacataaaataatttatttagccaatcttcactgatggaaatttaggttgtttccaaccttatactattaaaataatatgttaataatcatttgtatgaattttatttactacatatgtgactatatccataaggtaaattattagaagtaacatttctggatccaaggtgtgtgcattttaaattttgatagtttttgccaacctgctcttcagggatcttatgctaattttaactcccctgccccagcaatgtatgagagtgcctgcttgttttatccatgtctttgtctatacattccctttcatactttttgatctttgccaatctgataggtaaaaaatgttatcacagtttttaatttgcatttttcttatggctaacattgaacatatttttatctacatgtatttcctctttagtaaactatctgtgtatcctttgctcattttcttattgggctattggaccccttcctgttgatttggtggaactatttatattttgaggaaattaaagctattttatattgaaaaaattagttcttttctatgatatgagctacaaatgctttttcacattttgatatgtcttttgactttatggtgttaagaattcgttgcatgccgtagaatttaccagtcttttatgacttctgggtttttat

SEQ ID NO: 116318 - DNA, 1063 bp, Homo sapiens
gtgttaccttaaaaaaatggaactggccacaattagatgaacatcattcattagtgtatttaagagcaagtacaagaaacaggagacaaatactggtaaagggctcagaaaccatattttgtaaggagtatttgcaaatggtggtcatttcttcagcgcttggaagaacagctgtgtggaaaagggattagacttcagagggcagaactaagtaagttaaaggatgtgaaatacaggacaaaactttcttaatgtacaatgcactaaaatggaaatgaccgctgtgtaagggagtaacaagggccagttcctggaggtactcaggcagttgctgagatgcataagtacctttctgggacattttcatagagatcttgccttgagaaagaaattgaaatggaagctttcttgcagcttcaagatctatttcaagtcctaaaattgttctctatgtgtatgccatgaaaatcaatattaattatgtgacaagctatttctataagcttaagttttgttctgtgatcttggtgctatggactagtcaggaaaaaagggaaaggtttaatctaggagggtggaaacatcattaataaataagagaggtaggagaataaaacttgcatttattgagtacttactacgtacagggtgttggactagtctctttatccatatagtctcatttagtacatttagtttttcactgatcagtttggaacttatgggaagtggttcttaaaatgatgaattcttaaaataattggcattttcttatatattttttggtgatgaaacacaggactgttctgatggctacatgtgcaaaatacactttcaaattaagaatgggtctgtgatgtcacatctaggagcatctacccatggacagacatgtcttcccatggaggtgagtagtttaatgcatcatgttcttttcagtctccgtaaagtatacatttaaaaatgtatactttaatgactccatcgcattccatcctatggaagcaccacaattatatggcactcatattgaaataaaatactttaattctgttaagtaaat

SEQ ID NO: 116319 - DNA, 1514 bp, Homo sapiens
agatgcagtttttgaacaagatattttctttaccagtgaccaacagaagtatgttgcatcaatttaaaatcctctaaatatagggccgggcgcagtgactcacgcctgtaatcccagcactttgggaggccgagtcggggcggatcacttgaggctgtgagtttgagaccagcctggccaacatggtgaaacaccatctctactaaaaaaatacaaaaattagctgggcgtggtggcaggtgcctgtaatcctagggaggctgaggcaggagaattgcttgaacccaggaggcggaggttgtagtgagccgagattgcaccactgcactccagcctgggcgagagagcaagacattgtctcaaaaaaaaaaaaaatcctaaaaatataaatgaataatttcaacagaagcaaacataatcgatgctggcttgggatatcttattttatgtgacacttattttcataaatgggtattgatactaccatatcactttatcaatttatgattttttttgtatttaattgaagacttttcttagagaaattgagatatcatttaatagtagtgaaaaacgtgatttaacaattgatctactttaataaacaggagcatattgtccttattgaagccttatttctatacatgaaacgataatttacaaatagaagtgggaaccaagccctatacttcaattagacaatttttgacgaaaattaaccattattaactcttaaaatttttgtggatatattattgcaaaatagctgctaaacttaagttttttttttaaggttctaaattaacttactggctaatgaagactagagagactagagttgagaaataaggtgtaagttttttttaaaaaaatcgtgtccagcactcatccactcagtaaaaggaaacagtatctagttaacttagatactgatttttaataataagtagtaaaaattattaatgaatgctcagaaaggggaaatatctgaaagtatttcctatgtaactcgtgttctagccaacattgctttgtatttttttgtctctaatgtcttcatttatgaagttttgagtcattttccatagaatagagataacctagattttgtcttttgattcacacaattcagctacctatacacactgactttaagttggtcagtaatttttatattattgaagtttgtgttctgcttgaagttcgattactgtagttcctcatccttttgcagaggtatcagaggtgggtaccaagcatattttatttatccatttactatccttattacttcagagcctcaggttgcaccttcagattacatttttaaaaactatgaaaatgatagagtcataaaaatggcaataatatactagtggaagaaaagatttttgtcttagggccttgtagttcactaactgggattttccttagaccagggcaggtagaatattatagaaagtgaggccctcgacaaaaaacaacctatcataaatttcctgaagcataaaact

SEQ ID NO: 116320 - DNA, 1081 bp, Homo sapiens
gatatgctgtctcactaaaaatacaaaaattagccaggtgtggtggtgtgcaccagtaatttcagctactcgggaggctgaggcaggagaatcacttgaacctgggaagcagacattgcagtgagctgagatcacaccactggactccagcctggacgacagagcaagactccatgtccaacaataacaacaacaacaacaacaaaacaacagcaacaacaaaaagtctttatagattgtctattcatatatgctaggctctctgattatacttaagtagtttgtaaagttagtatttccacatactgaatgatactccattaaccctaggagttagtgccgatacttatattttgcttaatttcatttttttccttactgattccttcaacaaacatgtttttggctatcttttgagcatcgggtaccgtgctgaaggatacaggcataaaacactaggaaatagtgacacacttctcaggagagtttggaaaatacaagtatttttactggtattttctgatttgtaataagtttcttaggtcttcttcattatgggtattgaatgttattatttgtactgaatcttatttaaaattttaatggcaattttaattgtaaaatcttttcaacagtattattatttttgtggacatatacttaaagagaagactagaatttcttgactcctcctaaaaccttggaatgtcataggagaatacagaaatcctccttggtaacttttcttcaatttaccttaggtttcatggccatgtagttcttgtgttgtgagtgtagcaggaggatctcagacaaaaagcaaatgtggtaatacttttgagggcctctgattatagtaatattctcaggaaagctagtttaacatggaattatttaagtgtagccagagagcttagtaaatgtaatgatggtcatcagtgatatactagaagtcagataatattatcaagtaaaaaaattcatagaatagtagactaaattggactccctcaattgtatagtagtaggataatatgttaaatatgtgaagagtactcagtggtcctttttccttataaat

SEQ ID NO: 116321 - DNA, 1030 bp, Homo sapiens
cttgtttagtcacgggatcatagcagcttgctcatctctagtggtatgaagccgtatttgagaggttgggcaatagagccctacagtgttatgtgatttgctcagtaacagaggtagctccagcatgcacacctctgaactgcatgaatccactgccttttccacttgcctgtggtttaccattgttctttgtttcatttaccagggtgagatctcatttaacatgttttagattacagaggttttatagtagagctaaaagcatataaaacaagaatttattagaaaggacaccaatctttaacagcctctgctggtctcaggttaatcttactatggtatcattttcttaacaatggactatcataagctatatcatagctcttatacacatttatgcaaaacaattaaactatagtgtatgaataaacattccctgacccccacctgattttcctacccccttctatgagcaagcagatggccattttaaagtaagataagtggagaaaaatagagaagtaataaggggcaatttgagcagtcagtgtactgtggtatccgtgggacccttctccaacttcatgtgatagcatgcagtatagaaaaggttctttcagcaagtgtttaggaaaatatgttccaaaagatctgcataacattagtgtaaccaagtgttcctctctctggcttcctgttttggaattaaatgccttcagggtactcagaataactctgtttaggaacacaagaagaatttaacctcttatgttcctaatcaattttaaaaatatatatatagattaaatagaaagcaaaaagatcttattctactttgcttctcaacagtttcagctaaaaattaaaactgtttatacataaagtcggtggtttagttagaaaacaaaggtataaacaagaattctgacaggattattatcagcaaaattttaagatcagttttgtccctgtaaacaaatttcatagacaaacctttttacatgtaggattatttccaaaagaactcagt

SEQ ID NO: 116322 - DNA, 1162 bp, Homo sapiens
gaaatccgtgctaagtgcttttgagtttattctgttgtcagaggagagcaaactgcacaccatttcgaggaaacaaataatgttttgattaaataatacttgtttcagtgtgaaagcttgcctggagaactgagagattaaagattagacatttttatactaggtaaggtcagacattatatcatcgtggataataataagagtaatggttgtagtaatacctttcatttgtatttgcgagtatacatatatatacacatgcatacatatttgtgtatctacagagaaccctagacacctatatatatgtgcatatatatacacacagtatatgcaataatactgctcttatataatatttatgtacatatcatatatgtatatatgtgtatatatgtatgtataacatgtgtatatatctcatgtatatgtgtgtgtatatatccctcaagataatcctatgatttgaagatatatattgaaaatgtcaagtaatatgtatatgaggtctcatagcatagtcagagctgaggtggtactcaaattctaggttgtttgagtctaagcctgatattctttttatcatgttatgctgtttttgcattatatgatgtcagtgttgataggaaggatggaatgtgcatcagagacattacaaaggtataaaatatttaaacacaaggcagaaaaaggagttgaagatagctctcaaattttcagtctatgtgactatgtgaccaggaagcaggaatggtgttgccattgcctccatagatgtaagggaaggaacagctaggggagtgggatgggaaacaggcataggggggaagataattccattttggcatgtcagatttgagatcctgaaggcaatcttatagaaatatgtagcacatactttaaattttggatttggagccgaagaaaagtcagagctacaacttgagaatcgatgatatatttcagagaaagtgtatagactaagaagagaaatgaaatgagagcctaaccttggtggaagactacatataggaggctaaggtaagaaataagagacagaaggagcctgcacaaactctgacagagatgagagtggtcaggggaatgccttgttcctcaatcagcaaatatttgcattcttgctgtgtgcaaggcctttgcc

SEQ ID NO: 116323 - DNA, 1032 bp, Homo sapiens
agcagctagtgaaggcaaaccggtttatggcataattctgggtcttggtgaatgagtttcctgactttataattccatagactacaaaagtaaagaatcacaaagtagaccctccatgtgtatgtgaggcaagacctgcatagcatcaccaggaacactgcttataaggtgaagtcttaaaacccatcccagaactcctggattagaattttgggggtggaggccaggaatacgtctgtttaacatttctcaccaccaagaatctgatggtctttgcaggctagaaagaaccctggacttggagcctgaaggcttagttttgtgccctggctcagtttcttacttgctggagaccttgggccttcctcctagagcagaggaacaaattacatgatgtacatcaataggcttagaaaaactgtaaactgttagagttgatgctggcctttcttatgtcacatgtaaagggtaacactgaagagaaacacacttgaccgacttctgaagcttgataatttttcaagaggtcaaaattttcccctcttcctctagtttgtcatgttttacataaagaatttctgattttcaaatccattattctgctaattcttttacttttagatgtatagaaataagtgataagtgcgattaagcattattactatttcctcctgccaaagaacctgtgttttgtagcatggactctaagagatagcctcttccacagttccaccttttacttggcgtgtttgctggcttcccagctccaggcactagctgtcttgctgtttcctatgcagtcttaaaagaaacagggtctaggaagcacagtggagccagctgtaaacatccagaaaactgccagatgtgctgtggcgggtttctgcatcccctccctcctgcctcgcccttgagcatgcctgcctggagaagaggttttaatcctgcacaggaaacagattcttcctctcagtgggaacccacgttggccatgctgttgctaattcactttggttgatgtagcagggagag

SEQ ID NO: 116324 - DNA, 1032 bp, Homo sapiens
tgcctacaaagtgagaagctttatttatggctttgtgtgtatacatgtataagatatatgtatgtatatatatggcttattcagctgtggcacagcatcaagtatttgttaagtgaaacgataaagaagaatttctagtcatttaaaaaatacagcccaagaatggaaacattgtgatggtgcctacttcaactgctatgccaggttttgaaagaggaagtaattctgttgtctccaggagacctaagacccaaaccatctatgtatctttactctttagtctgatacttttcagagactataggagtagtggacttagaaaaatagaacatcctgaggactcaaaagtgggtatccaaactagctgaagcagctgttccacttctataaacacgtatttttatttaattcttgaaggcagacagccaagttgagacagcattctgcttctgcctctcatttctactactttggtgtacaggagctcagttaccaagtgggcaacgtggatttaagagaagaaataagcccttccatcccaatgttctgtttttctctaactacttttgtcattgtaggtttgggagaggtggtgggacacagttaataccctttgtcactcaggagagggtgagacataattgcacgtctgttgagtaataataaatagcctacattggaatagtgccttatagtttagtaaatccactcccacaaagcattgacatcttcaagtgcatgctgttttttttttctttttttcccactgtttttgaagcataccatattaaagaattttttgtatcatgccaaagccttctatccattccctaccattcttattccctgacctttttatgtctcattttcccttttgagggctcagctttgatcaaaagctagtggcaaatgttacaaaggtggtaaaacccttaggcacatacataatggccttttgccttaccagaggcctaggcttaaatattttctccttacatttagctagagatttctatatttatttcatcttga

SEQ ID NO: 116325 - DNA, 1047 bp, Homo sapiens
ttcatggaggtcacgactgtctaagccatctcaaccagttgcatcattgtggatgtataacagacttgcactgttatattaccaatttttccattggtttcctcatttgaagagtctacttttcaaacaaagctctggttacaacaatcaaaagcaagcaagttggtttagaaagttggggtgagaagaaaatagtgcttattctgaagaaaaagaaataaagctttgccaggcctcattgggattgcagctaaaggactccactgaggtaaatactttcctggcctcttgtctctgcccttccctatatagccacatttttgtaaagatggagtctcactttgttgcccaggctggtctcaaactcctggcttcaaataatcctcccacctgggtctcccaaagtgctgagattacaggcgtgagccactgtgcccagctgttgttgttgtttaaggtgatgaaaatgttctaaaattgattgaggtgatgattgcacaactctacgaatataactgaattgtacacttcacatgggtgaattgtatgtacgtgaattatatcttgataaagttatgtgtgtttttttttagtcattggctttaagtgacgaatgttagtgatatgcatgtagtgctagtgatcccctacccagccctggtggtctttccactggttggcacctctccctggaacgctgtgcctcccagtgtttgcacacaagttactttctcactaaagtctaaaattgcaaacccacctctggctggcacttcttagcctgctttacttttcgttttcaccatagtatgtatcacctcctaagataatatacagtttacttgtttattgtgtttattgtttattttcacacacacacacgcacacacacacacacacacaccccaaggcataatgtaacctccatgaaaacaaggatgattgttttgctcactgatgtatcacaaaggcttggaacagatgcctggcatatagtaggtgcccaattatataaaacatctacttctaaaattaacttctatccaa

SEQ ID NO: 116326 - DNA, 1044 bp, Homo sapiens
tggatttgggtcttattacttctttaagttgaagtttatttcactacataataaaaacaagaggctggttaatgttctttgttatgtgtacatctggttgagcagaatattgcttagctttttaccatcaaagttacacttttgactcagcacatgctttgaatgtatacaaaggccttcttttaaagaatctcccagcatttcattgatccctggaattactatttcttgaaaaggaacagcttatcaatacaaaaataaaataccatttaaaatattgaataattaattttaatattattcatcttagcacgtttcattttgataattacctaccatcaattattattttttaataaacatcttagtccccaaacttcaagtctgaggaatatttatattcttatttccagtttttgagaaagaggttaatggcgggtacacaataaagcaacagcttggagcaggtggagaagcctgggggctgggggtgaggaccagaggcaggcagaggacctggaggggaaatggaacacaggctctgctgctacacttacccgtgtatgttttgagtccttagtaaggagtatatgctacctcagaaagatgctatttgttttatcttttttttttgtacaatagttgctgtatacacataattccaccatgcagttattgcacattattttcttcccactttctactcccttcaacttctcttctcacttgtcattttctctggttctctcccatgtcagctgcaaaattctccatattacatttgcagcctgtattttttagttaaaaagttggtcaataaatagagataataccaaagtatataaagtagttgtgccagttacatttttttgtaagctgatgttatttttttcagtatattaatgcagtgttacttcccttagtccaatctgaattccaaaactatttcaagtggtttgtatacatacattctcatatgctaataatacatacatatactataaccatcaaagcaagtgaataataactaaatggtggatggga

SEQ ID NO: 116327 - DNA, 1035 bp, Homo sapiens
ttcacactgatacattatatagctaattttctcctagtttttcctgaaaatgttccagttaaaagcaggcagcttcttctgatcatttatctcagccacagggaatcttcaatgcaaaatgctcatatttatttctttttaaagagaaacctggtgaaaattttgaaattttagtaagagtaatgaaggatttctgctgttattaaaagaaaacaaggtaaggaatcttcaaattaaaacagtatcaccagtattaattgagtaaacattttcctggatacatatttactgatttttggtcgatttttctcaaaacatgaaaactacatttatttcttggtagaatttgtgtgcttgtgagagattgtctcaaattttctttttaataaatttcccaagtcttgacagctaactagacttgcgagtctttagagattgtctcaaattttctttttaataaatttcccaagtcttgacagctaactagacttgcgagtctttaagatgtattgaaaggagcatagactttacagcaagaaagaggcaggattcaaagctggttctccccttgctatgtcttggggtaaattacctaaaaactattttacctgatatcaatataagcatattagctttcttttggcatttgtctggtaaatctttctctaccttttaactattaaacttgctccggtttattcatttccttgcatacagaacattattttaaaaaatttacatacagtaaagtttaccttttttggcagacagttccataagttttagaaaaatgcagagatgtgtaactgaccaaaatcaagatacagagcatttccatccttcctccacccaaattcccttgtgcagccccttgtagccaaccttttctcccaccccaaacccttgttctctgtccctattgttttacgtttttcggaatgtcatatatggatttctaggcttttgagtctggcttctttcacttagcacatatatttgaggttcatttatgtttcagtatatatcaatagttta

SEQ ID NO: 116328 - DNA, 2513 bp, Homo sapiens
gttttcaaaggagagaccccagcctcgggtcaggcgcggcgcagacagcggcgcggggtccttggctgggcggggcttgctcgcggtggcttgtggctccttcctgcggtgcttctctctttcgctcaggcccgtggcgccgacaggatgggtgagctgttgtggccggtttaagggcgctgcaagcgggacttggggtcttggggacgggcgggcggatgcgaatagagtagggcgggggatgccatggagaggctccatgggggagggccggggaagcgccgctccaggaggcacgtggtccggcgcggaaggggcccatgaggcgtggaggccgccgaggtcggggtaccgagggacgcagggaggccagcgcttcctcccgggcattcgagcggggcctcgtccttcgggagaacacattctccggagccctcttcgaacgtttattagtcggttcagggcaacttgaaggccaaatgtttggcccacaggccaataaatagtacgagagccaatcggcttaagggtttattccaggtgaggcgagtgtcttagaagatgggaaacacgtagatggcgtgtttttacggaagaactaaaatatttaatttttaggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtgtaagtccattgctcccgtcaagttttagtttattataggaattcgagacatgaacttacgaattcttgttttgaaagtaattgcaggtttttgtgtagtagtattcatttgggcattgtggggtaaaattgcaaagcgtttgttctatttaaaagttggtaaaattagtttttgggaattaggtagttaaggttttaatttaacgttggcctggaaggaattggagaagatactagcaatgatgaagtaaaggacacaaacacctttactgtgggagttgttataagtaaatggcacgtgtcagctattgaactttatcgacttgataaaactaaggtgaagagaagtgacttgcatcagaattaattgaggtcatacacctaagattgagacatgaaactgccagtatttgactggttttgactttttaaaataataatttcatatagttctatcatatttgatggtagagccattttaacccagactttttttttttttttttttttttttgagacagtctagctctgtcacccaggctggtgtgcagtagcgcaagactccctgcaaccttagcctcccaggttcaagcatttctcctgcctcagcctcccaggtagctgggattacaggcgcccactaccacaccagctaatattttgtattttcagtagtgatggggtttcaccatgttgaccaggctagtctcaaactcctgacctcaggtgataatgcctgcttcggcctccgaaagtgctggaattacaggcgtgagccactgtgtccggcccagactttctaattcttacctcagataccttttttcttttttctttttttttttttgagatagggtcccttgtcacacaggctggccatcttgacgttctaggcatagatcctcccacgtcagcctcgcaagtagttgggactacaggcccacgctgccactccagtctacttttataactgtaaaaggtctagaaatttcccccattgtgctaatgaaattaagactggcagaaaactaggttgacatcacaggacttcagctcagccatttgaggttagattgaaaagatagaaacagtttctcattagttctctagttaatatgaaaagataatctttttcagaaagccagctcacagtgctgtgccttttgtatttcagaggagttgaagccaaacagccaaattctgccattaggaagtgtgtaagggtccagctgatcaagaatggcaagaaaatcacagcctttgtacccaatgacggttgcttgaactttattgaggtgagtatttcaactctatcgtaccttctgttcttggggtggcctccctcacatttttatctgatgcaagggagtttcctcacatgaaagtatttttgtgatcgccaccaacaccagaaataaacttcttattttattccaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccacgaagatcatgttcattaccaccaccacccccccttattttttttatcctaaaccagcaaacgcaggacc

SEQ ID NO: 116329 - DNA, 1052 bp, Homo sapiens
taaataagtcaatgaaaaataagtcaatgggagcaaagagaatgccattaaagtatagaaggaatgaaggtattagaaaatcatcagcagagagtaaaagtggtaggttaaagttttacaaccaacaggctgttgatgtagtctcaaagtatcccactgttcataattcttagatataaagggaataatagtaactttacagtgaagaaagctggctaacactaccttaaccaagtgatcaaagataacaggtgagacatgagagaagtaccaacagagatttggaaggcatggagactccttggagcagatggcttttgagatgtgcttggagagttgaatggtatttcaccaggcaaaggaggcacaagaggcttccaggccgaaggtgtaccaaatgcaaagaagtgggaagtataaggataccctgcgtttaaagacatgcaagcagttagttgtgaatgatagggtaggtgtgaagggaaaagagatgaagtatgaacctagaagaaggccagtgtcaaattgtgagaattcacagtgccatttgttaaaggtttttcactatatcttgaatgtgatgtatttgaagatagtcaagtagagatgttttctcaaggcagaagagtctgtggctcaggaggaagttctgggcttgaaattagatgtttggaagtcgttaaagtacagttgttagtgaagccagtggggtagatgggctccacaggaaagagggaggcagagcaagaatagaaaaaaatacacatgcccctaacatcagcatttataggacactagaagggaggaagcaaactcagaaaataaggccaaggagttggaggaaaaccaggagagaataggatgtcagaaaccaaccaaagttaacaattttatcccccagattaaaattctatatataatgtataaactaaatatccattttttgtcatctgcacattccttgcatgtaatttgctgagctatatagataagtagaccagttaccatgcctctttgtcagtggatctttagcaggaaaaatgaggaactat

SEQ ID NO: 116330 - DNA, 1047 bp, Homo sapiens
tagtgtatctggatttcattaaggtattttataaaaataactcataatgtcccattggaaaattggggaattttgggaaatatgatttaaaatcatggagaatttgatggattcataactgaacaaatgtactaagaaggggttgattgatgaatatatattattgctagaggaatgcttcattctgagagttagcattatgtatcaaatattattctgattagcatttttgttaatgacttggtacatgatagaccatggaagagaaccacttgtacaataccaggagcaaaatgctaaatatcattgaaaaaagatctcaatatgttggctaataattctttagatgcacctagtgaaagaagcaaaatgaaatgaaaggcaaaaattatttcctgtgattaaagttttgcagcttatcatgtatttatatgttccaaataactataaacagttaaacttcagaaaaacaggatctcacattatttagttctgtatttcccagtgtgatcccaaatttcaatcctgaattgagtaatcgaagcccctggaagttacatatatatggagcaacactgttagttttggccaggcacaggcccccatggactggagctgtgcacgggccatgactaaattgggctttatttccagacagaaatcacttcctaagcaagaagagggtaagagagtcttggggagttaacatcctaaaagaacctatcaagtcaaccttctcctcatccagccagtttgaagcaaaattgatggttccatgcatatgttttctttcccctggattgcaggctggctgctctgtgatatttattaaaagtaaaacagccaaggacagcatgttttggaaagtaaatacctggtgttctgacacactttctggatgagccttgagttggtggcttcctcaaaaatactggtctgtttattcaaagttttttggaaactatgttttctctcgctttctctctctttctgattttttgttgttagaatatattttttgtttggagctttgaatgaagttagaag

SEQ ID NO: 116331 - DNA, 1073 bp, Homo sapiens
acctggtgattttggggattcaagttcctatgagaagttgaattcagacacggcccccacccctccaaccagggcaaggtccatctagattgttgctggagacagttctagggtcattcactggaaaaccctgcaaggcttagagatgggccagttattttattaatactgttacggcgaaagggactcataagagggctcaaatttgtaaataagaagctgttcctattgctattgatgaacatttgttatactcacttctccagataagaaacaggttccaggggactctttcaagagagcatctaccattaacttcacccagtccctaaggaacatctaatacagcttccatattcctagcagttcaatgtaaatgaactattaaatacagaggccatgaaacatctgctatggcctggccatcaaaatgcaggtgtaagcgccgtactgagtttttctttagtaaataaaaacattttagtctgattaaattcaacaacaacaatggcaaaaaaatggacatcttccttttgtagaagttaagtctctgccctcatctctggcactttcatggagatcacatgtacttcagtgatgtgtagttggcacatgttttctgtactggaccctcttgaggcaccaatccagcttcatcttcctgcttctctgagaactgccgcacatggggccaattcttctaggtgtgggtgacacctagcccacctaggcactcagattctttctgccaggtatttgaaacctggcttggagtaagtggatttaaggtgtgttaatggcaacactctgatcagataatcatgaaaaccctcaaaggttttaacttttctattgcttttcatttatttatttattttgcttgaattagctgattttctgcccgttgtttgaaactaaaaacactataccaaacacactccctttggggagtagacacgagttcaaggacatgagggcactccagaaactctcacaattacacagtattatacccaccagagattctaggaagggctcattgtcaagtgcccctcctaataacatcctctaga

SEQ ID NO: 116332 - DNA, 2276 bp, Homo sapiens
tgtggtccacactaaccagaagtttacaaggaaggcagtcctaggaaatgagcagcctaaccaagttgacacattacaaagtcatcatgctctctaagacccttcaacctggatttcctgccagcaactcaatatatcccaaacagaattcttcaaaacctgcttctccttctgggtcaccctattttgttttttaacagtgccactttccttctatgcttaaaattttctaatcttgttaactcccccttttcctttctcatatacctctcatgctaccaccaatctataacagttctatcatttttacctctgcagtgcccaccccaggtggatgagttcaaactcaacaggtgattatacaatcccacacattgatttcatatttagtttgatataagccccccttctggaaccccaaaagaaggaaaaggccattttcctctccaaaagcacatacaggggagtgagttataacgaggagctagtatgctgctatcattatttaaaccaagaaaacccactgtagacaagatgaaggatctaataaaaatgtgttcttattcctgattctaaaactttaacagctgggctttcccatgtggaataatgttacataaataactcagccaggaaacagaggggctgtgaagaagtccaacaaaatgatagatgatcttggacagtcttagtatcacacccaatggagttagaaggaaataagtgcattgaaggtacgggtgagctatgttgttatgtgtgagcagcaaactttacagaacctgacagttatctgagtcatgtatcactaattctacagaagttttctttctacttaagtatattaacactccctaatctattccatagggaccttttctgctccatccaaatttgtcatcttttaattagtcatggaagtctagataaagcgggtttcagaaaataaacatgttgagttttaaaactaagctctcaattgttatgttttattttaaaggggacaaatatcactgagtccatgctatttcgtattcttgtccacatagtctagtcaaagctcatgttgcaattcctactaccacatcttcatttcactgaagtcgctatagtcgcagttatagcacaaatgccaaaaggcattatgagaaaataggagtgagggataaaacttcagcctaagcaactgtgcagttctccttttccatttacatgatgggaaagtagtgggagggagctgcaatccttacgggagatacagaacttaggggcaagtgtcatctccctcaggtttgggttagaagaccttcaaaagccttcccagctgtgaacaccaatgactgtcctgtattggcagtacaagttgttcttcactggtcctcagcagttgcttaaacatagacaaagaactcttaaagaatgaagacacatttggttttttccagccatgatcttggaaatcccattgtagctggaagttctacatttgtgaaatgtatccaggaatttaccttcctagaaattacgccagggctcattttgggctttttgaagagttacaggagacattctgtgattataacagtggttacttcgctaggaaacattcatggaacatgtacttgttactcttttctttatgtaattcttagatcaaccttgtttcctatgaataccggcaaaaccaactcgtccattgtctacactatgccaagggaaatatccacatcaacttgaaataagataaggagaaaaaaatagaaagaaaattacttctaggcctttcattgcttattatttgcccctattctgccctccgtgtttttacttgctgtgatccaaggcaacacactcatgtagcagctcctaactgtgatcatcctagcacagtatgagtcactaagcaggagaagcttcttattttcctttgaattacaagccctgtgcttgagagatggttcaataagccccctacagaatcacatggaagacaaacttccatgacaccattagtctcatacctgaaagtaatttaaattttttcccttacaaaactaaattgtagaaaattcagaaaatgcaaatacacaaagaaaaaaaaaaggcttccagtaatcttaccagtccaaaataaccactataatggatcatataaagatgtccatgtacagataaaaatattttttatgggatagaatagttcatgctattttgtagccttcttttctcccccttttgtgaatgtcttttcacaagttacagatttttgctattat

SEQ ID NO: 116333 - DNA, 5741 bp, Homo sapiens
agaaaataaacaatatttctttggcctcaattgagttgagatcgtttctcttggatctctgtcctacattctgcattgtattttttagtgtctgagtttacacagtgacaaagaaatgatgctttcgaggttttctaaatatatgaaaagaagatcctcttagaaataaattgatatattaatagtttagcccattctgtattgtacttgttttttatgttgcatctagtttttgtcactgccccacccccaatgtgcgggcctcctagggaagaatgttatcttgattcttatggtagtataaccttgtcatagccaggttagccactcagttaatcaagatgaacatctcctttttttcaacaggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaaaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaagagcctcctacttttgtcttattgtcagatatgtgaaagcagtttttagaggttagaaaatggaaatttccacctttctagtaggatgagaatagagaaatgttctattttttttttcctacctgcatttgcattcatggatggccaggattcgttttggggtattatttttattgttgttttgcatcctactagctattggatctactatattgctgttatcattgagtatgctttgaagagccttaaatgactccagcagtttgctttgggtgtgaagtctttaattttcccagagatggtggaaatccgattctgagtgaaagtgacagttatcaattactgagttattttcaaccttgtcctcaactgggagccttcagatgcccaaacattctggcaagtaactattattttctgtctaaaatctgtttgtgagcattgtccatcagtcagattattcagccaatttatactattattagtatttactgagaaatatgaaaaggcttttgtcttgctttgaggaatgtggtcttcctgctgttagcttcccaaaactgaataaacacagaccaacctttgtcagacctgtaactagaaggaatttacctaaccaaatgaattgtagcaattgtatttttagttagatttagatctaagaaaatacttcagatataaattgaaaggcagtatcttagttgtttctttcagtaaatattgtaaacgtaccccactgccccattaaaccaccagttgataaaagacattataggaaaatcactaaatttccaatttatattaataagtcaaaagaattcaaaatggctgtgcttaagaccaccaaatttaatataaccaggaaagcaagatctgtttttaattcagagggtttacattaatgtccttactgataacagattcatctaggggtggaagggagggcaagggcaagggagaaaacataaatattggaaacaagggtaagttacttcacacacactttgtggaggatgagaacactcattcagaaactgcgtgatacccagacactactgtttgagct

SEQ ID NO: 116334 - DNA, 2220 bp, Homo sapiens
aggaaacttccttaaaaaggtgatgctagagctgaattttgaatagaataagtccacctccatttactttaactggaaacctatgattttgtttgactgtggaaacttatgaaacttatggtttcttatgactcttgtgttaaattttaactttggaataagactcaaactattaaatacaagctaagtatcttttttccaaaatgcttggagccaggagtgttttggatttcaaatttttggtgggattttggaataattgcattatacttactcgttgagcatctctaatcagaaatccaaaatgctccaatgaacattttttttttagcatcattttggcactcaaaaaattttgattttggaacattttggattttggattagagatgttcaacctgtaatgaataacttttaaaaatccaacagtgaaagtacaggtgcttgctttctttctccaaaatctattagcctagtatttgtcaactcatggaaaattatagcttaaatttaaaggatgtttatccttaaaaaaattcagaattaaaagaaacttagctagcatttaagtctgtctgcccattctccgcccagccaaagacttagaaaagctagtaattctgctaaggccataaaaccagctattggcagagcttgaagactgtagaagacctcaagattctggttttaagtgttgccagacttgtcattctgcttgccttcttgaagaaataaaaacatgactctaaatgtggaattgtcaaacattttttacctatgcagtttttcttgatattaatttttcttttttttttttctttttagtctgccattttcaattttcagagtctattgactgtaatcttgctgcttatatgtacctgtgcttatattcgatccttggcacccagcctcctggacagaaataaaactgggtatgttactaatgatgtctaatcacccaaattagttcttacaaatgttcaatgtaagttaacatataaattattagataatttaattcctacatgtaatttggttttataataacttttttcattttcttcctgttaaaaattcaaaaactttatattcacaatatcttactaaattaaaaggtaaatttcagaagtgacctaaaatgtgttaagagtaaaaaatcgcatgagggatttaacctactgaaggtgaaaatagatgttagttgtccatcagtttttatgataatactccatctccttgtagacactgtcttctcttcattccacctttttcagtaaagtcctgttgaatttattcttcagtattcacccatttgttgaaattacgttatttgttgcttggctgtgcatgaagtctttctatccaagtagacagtttcattgtatctttcccttctgtacccgccaactgtaaacttagaattaaagcatatggtagactctagtaaacacttattcctattgatgactttattggaattctaatataatgcataatgtccatctaagatatttaagtgtttatctcattaaagaataattacatagtagtagaatactttccctatgctatcacgaaaattcttcttcaaaagcaagtaggttgcatgtggaaatgtctgcttctcattccttgggagcaggaatatgttcataacatgctacattaacaaaggagttctcagggctgccaaccttctagtaaaggttgagtggtagtatatttctccaacataaaagaccaaaaagagcatgcctatttttacattttaaaatatgtactaatacagtcaactgtttgaaagctttttttaaaacctttatttctacttatatacgtgttaagcaccattttatgttgatttataactaagaattattttgtatagaaaattttataggcctagtctctttctgttaaaattacatgtttttatgagactcgtaatcttttattatactgagaatatataccatgcttaggtggagatatctagacagattggataaagcaagttcttgatgacttcactgtttaaaataacttcagtttttgctacttcaaataatatagaactaagcagcagaaaaaaagattactacatggtctttatcctggtttcatagacctgatagcattatcagcaaatatacttattggtatttagccataataactaagcaacgtaattacattttttaaatcaactaacagggt

SEQ ID NO: 116335 - DNA, 1772 bp, Homo sapiens
aattaactcagttcaataacactagttgtttcaagcatatcaaaagatcttattgattatgagttgtcagataagtctacaatgcagagggttagtaaaagagcccttgatgacaaatcgtttggaggcctccattgccatgttttagaagaatgacatagctctcagagtaatggtcaagataacctgcgtactcagtcttacagaacctgcgtactcagtcgtacagatcttttgaaagtgtatatctcttaagaattaaaagaagtcagaagaacacacactttccagtgtgcaagcaccttcaaagcttgctgcttgatagaatagaaaatctgaattccaggaggtgatagaagatgtggatactgaatggaaattacctcaggtctttattttaccctacagcctaggtccttaacataaatataaggaaatttgcatctttctacttgattttccaaaatattcttgagaagtaagcatatatgcaaagccatacatggaggtttctcttgaagagttaacaaaatactgtattcagcaatctgatctacactggtttttgaatgtgtattttttctttggaatccaagtatgctcttggatttgttaaaatgttcattattgccagttgcgttcaagttcctgttcatttgacacttttcagtgacttctctgtgtactatattttaatagtcacaggggattgatgaaaacctcaatagaatagacaatcacagtacagtatgatgtgttctataacatacacattgttatgtgtatgtattatgcacatacaaaaatcctgactctgcttggtatagtgagtgggaacaggaaagacatcagaggaggtgaatcttgagttgagattggacgcatgagtcagttcaccaagcaggcaagaacagatagcatgtgcaaaactcaatagagtaccttggaaaaggtttcatgacttaaaggccctgaaaaaaattaaacaaggtaaatgaatttgacttaccaccttttaatcatcttttcctctgttttgtgattaaatatgcttaccttttcttagattcctcctttcccttttaataacatttttctgttgaaaattgcaattattttttcactgaagaggaacatctgtttcctttaaccctgagactaaaattttatgtcaccagacaacagatgctaagcattaaggggaatgctataggtggcaggctaatgtccgtaagttagaaacacacttttgaccagagtctgagtacatctaaaagacttaccacctaagattatttgttttaaactttagaggctttaaacccccagaacaaagttgtatatatcatatatttcatacttgtaaatggttttcttttgtaaatggcttcacacacaaacgtatatacacactctactttcctaataggcatgtttttaagtgcctttttatcttctattatgaaaacattcaaacataaagaggtagaagcctataatgaaccctcatattctcagcattttatcatcaaccctacccctctcccaccacacatgcactggattatttagaaaccaatcctgaacattatatcatttaagcatgttttctttaaaaacacatttggagaaggaaagagaacacattacaaagtcatgaatttagatactgcattaggaaaatgataaacctactttgaagatttgttttccaaccattttactgtaggaatcttttgcttaaaatacagtaagattctcattattccctg

SEQ ID NO: 116336 - DNA, 1014 bp, Homo sapiens
aattcgcctatggtaaattttttttgttatatatcttttggcttaaagttgcattttccaaggacctgtggatgacgttaagtgagggcttactgttttcgttaagcacctactctgacaggtgttttattttacatacaaggttttattaaagtcgtattattggccacatttttcatatgaagaaacagatgcggagagccaagtgtcttgcccaacatcacactgcttataaatagcagagctaagatttaaacggaaccaatttgtcacgaaatgctgtgccctttcaactatgcaacaataccattaattgcacaaaaatattaagaaaagcaaattttttatgtcaggagtgggtgaggaggtagcagttcagataattctgttgctaatattgcttttgcatcatccatgaaaatggcatcacagttaaaaggcaagtatcttagtattataaaaatagttctgatcttatgaacccatgaaagggttccatgaaccacacctttgataaccacttcattaggctaataggaatctgatgtgggtgctgatcttctctagcaaagcttttgaatactgattgcaaagaaaaacttccaggaggctgaggcaggcattcgagactagcctgaccaacatggtgaaaccccatttctactaaaaatacaaaaaaaactagccgggcttggtggcgtgcacctgtagtcccagctgctcgggaggctgaggcaggataattgcttgaacccaaggggtggaggttgcaatgagccgagatcatgccactgcactccagtctgggcaacagagtgagactccatctcaaaaaaaagctttcagggaattttaagaaactgtaggtgcccagaccagttaaatccaaatttctgggcaatgatggctttttaagctccaagtggttctaataagcagttagatttcataccatatgataggacattttatcagtttttgtttttttcttgattgcaaggtcagaggacttta

SEQ ID NO: 116337 - DNA, 1292 bp, Homo sapiens
ggatcctacctctccgtgactctacttccggtatcttccaaaacgcccgctttcacagatcaaggttttgcaaccaatgagagtatcagctacttccgccggcctgcgggacgtgatctaaatcccgccttttccggtggagaggagcctatcctagtgtcttaaccgcccgtcttggtaggcggtgccgtgacaagcccaaccggacggctggagagggcgagaagggcagacgggacatgcagcctcttccgcctgagccccggaagggtgatgtggctgcggcatcgccggcctcgctatggtaagaagtggggctcccaggtcgcggttgatcttcgagaaggggttgtggatctagactagggctggagtttgtgcggcagcccggggtgtgtgggcccggagctgagaggccttggagccatgtggtccctccacggccaaccagagagaatcaggacggactgtccgaggaagactgctgggtcggcagcccgcccctcatgcaaagtccgctttcctactttgtttaggaaaaaaaaatgcgttggtgtgttttaacacgttggctacgtagattatgtgtggtcattgaccctttgaagcattagcgcttctcgagtttccgcttgttttgttgcaactccttatctcgccctaggggctttactctggtgttattgtttgatttttggggggagtttcttttggcaccaaactccataccttcattttcatctgtttagtcagtagcctctcaagacccttccaccttcttctcttaactttgaaaatgctgctttacaagctataggttttaatagttaagagttctctgcaaaggtggattgcccttctaggagcttaatgtacttattggagtggtgtctagcctcaggccttcctcctcttttacctccaggtccatgtgccaaatgttatgtatatttctggacaaaggatgcatgcctgcaaatagacccaaaaacaactatgactccaaaaagcttgagtctccatggtgaaaaattatgagcctatgttcacagaagttgctgcagaatcccatatagcaataattcattttcttctctggacgaatttaccacctggtgggaagatggcagttgagactaggaagactgccactcttaattcttatacatctttctagaaactgaagttgaattcttctactcgtagtgcaagtcaaagataactctttttattatctcactgtcagactagctaaaaataagatgcatatactgtgcttaagatcaacagta

SEQ ID NO: 116338 - DNA, 1035 bp, Homo sapiens
ctacctctgcatcttcattggtatatttaaaagatatcttgaactcagatgtcccagaccgaactcctttcctcccaaacctttcccattctttctcatctgaattgatggcaactttatacagccagttgctcagttaaatctttggagtcatccttgactccttcctttctcttgtattccaacaaatctgttggctttttctatgaaatatatctagaattcaacagttttctactatttctgctattagtatactgatcatctcttgctcagatttttgttattacccactatcatttcttgcctggattatagtaattgtgttctgttctctctgcttttttcagtccttgcctccctacagtctattctcatatgtcagccagagtgatacttttaaaatataaataaaaaattgtgtatttacatgtaagattctaaatgcaatatgttatgctagattggatcctgaaacagaaagaggttattaatggaaaaactggtgaaatccaaataaagtctatggtttagttgatagaaatgtatcagtgttggtttcctggttttgataaatgcaccgtggtagtataagatgttaatattagaagaaattgggtgaggggtatatgagaactttctattatctttgtaacccttctgtaaattcagaattatttcaaaataatatacagaagaataaaacattacttttttgcttaaaaacctttcgtgaatcatttgattcatagtagaagctaacagccttacgttggcctacaatagtctacatcagtcttgtccaacttacagctcacaggctgcctgtggcctatgatggctttgaatgcggcccaccacaaatttgtaaactttcttaaaacattatgagatttttttttttttgagccctttaggtatcattagtgttagtgtattttatgtgtggcccaagacaattcttcctccagtgtggcctaaggaagtcaaaagattggacacctctgctctacatgatctggtctcccattacct

SEQ ID NO: 116339 - DNA, 1943 bp, Homo sapiens
agtagagacggggtttcaccatgttggccagactggtcttgaactcctgacctcaggcaatctgcccgtcttggcctcccaaagtgctgggattaccggtgtgagacaccgcgcccagctgagatgataatttttatcttcattacttggacaaatcattttccatttatgggcctctgcttttctcatctgtaaaaattgtgaattaatattgaagaaaactgtgaatttactgaatgtattatttactgaatttaatggttgaatctaatggttgaacctattatacagtttttttgttttgcttattttcttatttccttggtgtttgtgtagctgagaggccagtacagaaaacattatttgagttacagtttcttttaaaaatattaattgtattctcccattacaggtattaagaaatggagagaaaaataagcagaatccaccttgtttctgaacccagtataactcattttctacaagtatcttgggagaaaacactggaatctggttttgttattacacttactgatggtcattcagcatggactgggacaggtaatactaaaaacaaagtttttataagtaaaatttaagtgtgctattcttcagtcctcagggatacttttccattagatattgggtaaaactgatattaattttacttgctattgctgtcaaatttatacacaggtttgtaatatttaatgccactttctatatttaatagtaatagaaaaacaaacgtgtcctagaaaattccggttaccatttgaatcttagtaacttggatttgttcagaggtttaaaatgacctctttatagaaaatataaatagtactttctaaatacatcttttctcaggaccccagggaagaagtctggggcagaggaaggagattggttaggtaaatgggtatgtgtgttgccttggggcaatggggtagtggtgggttatttatttatttattttccccagtgaacatatattacatttgtaacaaaacaggaccagagtctaaaaatttgtaatgcaaggttcacacccacatttaggatcttggctgtgattttaggaaatagatttttttaactctttggtaataatattttaaaaatgctaatgaccctcaaatcatgtatggaacatggtggatataaagtaaaaatatgtagccttatattttccttatatacgaagttttaatactcttctaaagtatcttattgaaagatttaaagaactatttttataattatgcaaaagtcttttctagagttatgttgtgaataatgttttctgtaagataatttttacatgttaatttacatactatttatatcttctattaactttagaaatatttctctagaatttgttaccatgattattatatcgtctttaaaattacaatacattgtaaaattttgtttctttcttgagcgttatgaattatgttatacaacacagtcaaattgaatttatacttacagagtttcaaaaaaattgtcttttttgacacagaacaggtaatgttgatgtagggattcctgtaaaataaagaattttcaggggtaatatttgcagtacttattatgatatctatttaagctacacatttatctgtaagagaaagcagaaatcagattggttgttgcagttcaagagtagaagatttgtcagcttggttttatgtatgccagagagattatatccagaagacaatatttcttgttttagggtgaagagtgtataaggctaaagacaagggcaatagattaatgctggtcatctgggtaagaagagcagttctaacaacacagcttggaagcaagtcctaggggaagtggttgcttgtatgtaaggaatactgtatttataactttaggtatttctaattggcaaatggcgtattctgtatacttagttgttgtcagac

SEQ ID NO: 116340 - DNA, 1045 bp, Homo sapiens
ccatattttctgttgttggcacatgatatgagaatagtgagctccacttttgcttttgttttactctgcccatatgagtgagaaacacagtataggctattgaatctttgatgcaaggaagaaagatgttataaaatactgaacttattattcattgtaggaaattatctggctttgacctaagagcagttacacaaagtgggagtttctgtaataatttacaatgcgtttcatctgaagacagagaaagaatgtcaagggtttaatgtattttacgagatgtgagtctaaattaatgcatttctcaaaaattgctagttcagtaaaaaggaataatttgatttaaaaatgtgtagtatagggattgattttacttgtttgaatttctgttacatgtgataaattagtactaacagataaactaatattttctcatgtgtagtcatttacttttcattttaaaacttttgttaatatttcccatagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcagtaagtaaaactttccaaaatgttacatagtaaaatgtcagagcatttattgaggaattatatttaaatttaagtgactactatattattcccagaacacctcagaagcaaaagcttgaaaagtacttggtttccaaattagaagaatacttcaaagctaaagtcattaaatatattaatgaatcatgaaaaataaatattggaaaatgtgtttagtttttaatgcttgaaaaattttaaagtattacagagttaattatacaaaagaataatcttgaaaaaggtgagatcagaagttttaggccatcgtgacaggtcttattgaaaaaagttttgtgaaatattgattttaagaaataaaatcaatcaaaatatatctttga

SEQ ID NO: 116341 - DNA, 1033 bp, Homo sapiens
ctggagtgcaatggtgcaatctcagctcactgcaacctctgcctcccaggttcaagtgattctcctgcctcagtctcctgagtagctgggattacaggtgcatgtcaccatgcccagctgatttttgtatttttagtagagacggggttgtgccatatgggccaggctggtctcgaactcctgacctcaagtgatctgcctgcctcggcctcccaaagtgctgggattataggcatgagtcactgtgcccagccagaattaccaatttctaatgtagtgaaatatttaaaatttttagcttgtttgtcaatatttatactcatgttttgggagcagtgggtcagcaattttcatgagattgcttttgagcttatcctcccaaaacttcccttaggctttaattggcttttctttatagataacatagatccttttattttaacttcattctcatttgaataaatgttgggcgaacagctacacactaatttcttttctccatagagtgcgaacccatgtgacccttcctgccttagtgctcttcatttaacagtagattgttctggttgaaagcatactatagtgccagcatttggaactcctcatctcttcagcacaaggactgtcactcacacaagagatcatttgtgtgctttgggccactgttttccctctacctttaacaatttatcctgattttgccatacagactttgtcatgctaacaatgcatcttaatgaataatgtattcatcttccttttttgctttcatatctcactctgtttctttagaaaaatattcatttatgagtcaaagaaaaacaattatttttgataagaataaccttgggctagtcatttaaccctaatttcctcatgattctgttttttcatctgtgcaatttttaagtgatttcttagattaattccagcttagctaacatattgtagagctacatatatatgtgtgtgtgtgtgtgtgtgtgtgtgtgtgtgtgtgtgtgtgtatgtatgtatatgtatgtatatataa

SEQ ID NO: 116342 - DNA, 1069 bp, Homo sapiens
ctgaatgacattgaagtgtgttgcattatcttctggtctacaatatttaggttttttttttgagatacaggatatatatgtaatggatatttcattatgtgttatacttttgtaatatgctatactttaataggataataattaaaggcagctttaaagcaaaatgaataactcattcaatacaacaaaaactccaaattttctagtgttgttaattataattattgcttttctttttgtcttttgaagcagtgatcaaagaagttgcatttctgtgtgattcaatattttgaaatatttagttcaactcaatgtagtatttcatcaaaataagatggtggtgttaacactgatttataaatgtaccaatatgctaacctgctaagctgctatctggcaggttgtaaatattctatatgatagcaattttttagggttttgggtagtgatagcagaacatgttgtttctccctattaagataacaatttggttggtatactctgttacaacccagctgcaaaaccaaagtggaccacccacagagagtccagttagagattactgaggtttggctggctaaactactaccacctaaacaaatatcatcaccagttctgtgactcagtgcttgatctaagtaagtgattacttagaagagaatttttccaagtgcccaagcttctgagattctgtatttaaaaaataatagaataataaaagcaggaagaacatcctttgaaacaaattttaaaacctgataattaaatttaatcttctattcgtggctaaattataatactttcctaacttttggtatagcaagcctcttattattttaaatgtgactaaatagcttcatgtgtaataccagcactcttcataaaatattttttgtattgtctgtgttttgccattacaatgagatttttgagaatataagaaatgcacttgttactctgatatcattttattggatatccttgaattgcacacattcgtagcagtgtctcataatgaagtcagtgtattccttttttgggggaagcttcttaatgttaaaagcttcct

SEQ ID NO: 116343 - DNA, 1043 bp, Homo sapiens
tattcatccacatataatatgaggctttgttttgtacttgtcattacaataaactttgaagtgtttaacacattgtgtctttgtggagaaatggtcatcaagtaagacaattttagggaatactgaaaatgctcttagcttgagatgtagcaaattgtatcagaaacatgtcccttgagagcagtgtggctttgaaaatgctaggagttgggagaaagatttgtttttattaatgtggagaattgcaaaagttttagaaaatccacccaccatgtcaaagatcttgtgtgtagaatttttaaagaactgctatagtagagggcattaagatttttaagtaaaataaaacaaaaacctattggatgttaacttgaaagataattttaaaaacttaccctaagttcttagaaagtcttctctaccctcatgacctctgctatctatataagaaattagtgaactgaataaatctttagcctctcactatcttaaattaccatagaattaaaaactctagaatataatgaatttattctatcagtacagcccatgagtgaatttcaaacgtttaagttgtgcctcagaggaatttttgttatgcatcttttaaataataatattttcaataaatcattccttataaaagtccccaaattgttgctctttagacattactaaaatcaaaaacaacaaatttaaacatttacagtttgggacctaatttaagcatgtatcacagtttattaaagttatcttctgttagaaatagctcccttagttctggagatctgttgtgcagcatggtgactataataatagtgtattgtgtacatgacatttcctaagagagatcttaaatgttctcactacacacaaatgagaatgtgaggtaattgatatgttagtagcttgattgtggtaattatttcacaatgtgtatatgtatctcaaacatgttgtacaacttaaatgtatacaatttttatttcccaattataccttaataaatctagaagaaaataaaaatggtaagttaaccaaat

SEQ ID NO: 116344 - DNA, 1082 bp, Homo sapiens
agtaagataattttattatcgtaccaataatacacttgaaggaaataagtgctaagaataggggagaccaaatgagtagaaatacaaaataatctggagaatgtgtattcaccttacaatgtaacctcaaaatacataaagcaacaatggactcaattacaaattgaaattcagaaatacaaaatcacgttgaaagttttaaaaacgcctctctcaaaaaccaatatattaagcatatgagaaaatagatttgtacagtgtattttaacaaggttactactataatggaaggaaggatggatggacagagatctcttctagcaattagagaatgtacatttttttcatgcatactaaaacatgacaaaatttaagtatgtactaggccataaaggaattctcaaccagagaccaacatatggtccaaatttctgtagtaacttaattacaaaaaaattgtcttcctcacaaatatcaagcacacaaaaacacaaacacaagaaaattaatgggccaaagaagacattaaaagaaagattatgaaacttttagaattgaacatcagccaaaatactgcttgtcagaacttgccgctaatgaattagcataactttaaatgcatattttagcaaagattgaagattgatgaaccaggttttcaactcatgacatatgatctaagaaagagggtgtataacaaagagaatccccggaatgatgctgatgggagctcctagatgaccaaaatacaattgactcttgcagcaggggttggtcagagggcctggagggatgaattcaagggagctgtgggtggggttaagtgggtgattatctgatgtgctcaatcattttcaattagagttaaaatttgccaaatctgaattgtttgtaatattttccccattcttattttccatctattttgtgcttccatttttaaagaaatatactttgtatttattttctaatttcttagaaaatagtcatttttccaaagtttaaatattatatttccttttgaaattatagattcttttatttcttactaaatttaaaggaagtactcttgttctatttaa

SEQ ID NO: 116345 - DNA, 1128 bp, Homo sapiens
ctcagtctttctgtgattttctttttcttgtgtgtttatccaatttagcaatacctgggtgtcaaatttatttatccaaaacctggacttctaaaaacttaccatgaacttgtacatgtttactcggtttaaaaattaaatgaacctgtgggagctaccgtgctaagaaggggctttgactgtgacaggcacaccaggcatcatggtgtcatcttcaacttatagccaaacactgatttataaaattatactaatttttaagaatgcatattctgtagttttgtgaactggtttattaaggggaatgccttttcctagttaatttatttttaaccatggctataagtgccaaagcatttctcataattgaacataaatctttgatctggccttttgagtgatacaatcaaagaaaaatctttaaaaattttttttgaagagtcgttttgtatctgatactgtttctctatggatatcacttctcatataactatgtatcttaatatagactatattgtcagagtaatcctttcccttccactgcttctttagttttaggaatttatactttagcactccattgaatgaaatgtggttactaaattgtcaaaatacagtaactgctgtactatttgaacattttttggccatggataagtgttctcatttgagattgctttttgaaaaacaattcgctgaagtggaactggagtaatgcacaacagttgatttcttttggacttaactgaaactatgtttctggttttaaaatttgctaacaccaaggcactgttctatgtaacatgacttatttacatagttaccacacaacagttggtatttcatacagtaacataatttcattgcaaacagtaattttagtactgcaatagttcaacagttttgtctggctacatatgtagttagagcttttaaaagttaaaaattcatggtgtggtattataatcatagtttgtattaatttttatgaaaatcaatatattagcattgtaggccttatactactactctcttttcatttatataaagcagatagtctgattaatcgttctataatgtagactgccttgttcacatacatggtaggaactaaagaaagaatgttca

SEQ ID NO: 116346 - DNA, 1059 bp, Homo sapiens
atctgcccgcctcagccttccaaagtgctaggattacagacatcagccaccacacccagctgggaaatgattcttggtaccagttaatgaagttgcatcataatctatttttagataaaattattaaaatatttgtttcttaatattataaataaagcagtaatattagcatatatgatagacatgagacacgttttaaatcagcaaattacccccttatcaattttctatttgtaattgcctttaaatattatttctgtaaaaggacttaaatgctaaatatgctgttttttctacattacctataaattgatttttgttcctttattttgaaacagcctttaaggtaggtttcagtaaaagcagaccaaatgtgtgcaaatgcattgactttaaaacaagaatggggacaagaaataaggaagaggaaaccttctgactcagaaaagctttagttttagcataagccttaatttttagtacttaacggaaggagaattgattacgttgctcccaagctctgttaggtagtaaagcagtaacactatcagtttgttcatcagaatagctttaatacctttttttttttttttttggttttgattctttaaaaacatatcgagcttgggtcttattatatgaagggcattgagaaacgtgatgaacaatattttatacagcaattatgaagccatttctgcatgtagcttttctttatattgagactcaattcattgaaattccaggataaaagtaattctaatagggtcagagtgatgtgatttaattatgtagcaaatagatttgttcagtggtgtacagaaacaagaaaagagaacgtgaagattcaggttggaatggagggctacaaatgtttcagaaaagtggatcatgggctttgaaatgggtagttgtgagagataaagcttgagaggtaaggttctgaccaagaagccttgtgggccaggaaggctttagaatcttaagccaggattgacataatcagatttacatcttaaaatatcactctgataaatgtagagaaagaaacaagtcact

SEQ ID NO: 116347 - DNA, 1065 bp, Homo sapiens
aactgataaataaagaacagctgtgacagtaaccttatatgtcaaactagaaactggagtaaaaatttaaaaattgacacaacagtacgatatagcttttgtgctaattttctggcgttaaaatgatacttaaattgctgcttttgttgtgagacagaataaagatggactgggtgtagaggtagaacacagaaatattttatacttctcaactcattaagcctgatgaggccctttttgaagtccagtgcatctaggcacgtggccccttgcatctgtagtaatgtgcacagcctagaacagcagcagtgaaggtgaaagagtgcctcctgctcctggctatgcaccgtgtgtatacgggccaaatacttttgagaattaaaaaaaaaaattaatctgagtatttcaagtaaaatccttttctttgattaaatttatagatacttttagtttatttttattctgtagaataacagatgtccttatctattgaaggactagaaactggtgacaataattagaaaatagatataaaaaaagttgtatacttttaagaagaaatgacatttcatgtttattttacactgattagctgcaaaaagatctaagagggttttggaatttttcatcagtgtgtttgagtgatattttgaaagaagttgttattagtgatttaaaattagtcctttctttgtcatctgagatagaagtgtagagggctggacttgtttatctcttcatttgtattttactgattattttatttcaggatcaaagtgtgggatgaattctttatccttttggcattttgaaacttttcaaatgttaaaaaaaactttttatttctaaaaatgtccacttctctcaaagctacctgacaattgttaaaataaaagaatacaaaaccactttgtgggtttatgttttgctattgtaacctattgtctaaaataaagtaagcttatttttttctcctgctttgtatcaactcaaaacaataatattctgtaggtgactttttttttcctttttttgtttttgttgttgttgttgttttcgagactg

SEQ ID NO: 116348 - DNA, 1529 bp, Homo sapiens
tctcttagctataacaaaattttgagctttcttcaacaaaaggtcagttattccattttagcatttacatgaacagaaattagagttaaaattatcatatataattccttttcttattctgagcagagagacttaaaattaggctttagcaaacagatggtagtaagcttatacagtatttatgttgctttcttttctgctaggagatggaagagtgacttaccacttacaaaaattattcttgggctatatgttgatttatatgatcaagtaagaaactttaggtagaagcccagtttttttgctcactgtttgtatatcttgtaaatgcattgtatttaaatccttcttacacttttttattctcagaagaaattgtgtatgcttaaaaccaggcttctcaatcttgatattttccccaaattaaccatgtttttctttcattttagttcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacggtgtgtacacagtttgcttgtggtataaaaatacggagccctctttatgttgttatagctttaagttaatgattggtaaatttccaatatatgtggattagcacatatatatttaccttaactgaatatgattaaacgaaattattcatcactattgtatattataggaatacattaatacattatgtcattagtatgtggtggcaccagcaaatttataaacaataaggattaattgggcattgaagatcaaaacccattaatactaataaaagatttaggtagtaaatatttattaagattaattcagctcaaattataggattaataatgaatgaaaaagagacatgaaataaaataagcataattgatttctcatttgggctcagtgagtggcatctatttcaaattacagtgttttggctcctaatagacttatttctctggatttattgaaaattcatactataccatttttaaaggatgagctaattgtggctactggataagacatttggaagccttttatttttatggctttgcctctttttaaatgaggaagaaaaaaataatttttttttaaattatgaactttctcaactaaatcctaatctaggctggcccaatgtgtaacctttattattctattagtataagatatttgaaggaaataaaatgcatgttgtgaacacttgtatcctcacttataatatatatatgtgtgtgtgtatgcacacacatatatatacagtgagaaagaaaatgatgtctgaaaaattatgtggaatatatatataataatgataataattattagtacatccagtagattttttaaatcttttgcttaaataactctaaagcatgggaacagtttatccaacatatttagggtctttttagcgcaaccatt

SEQ ID NO: 116349 - DNA, 1110 bp, Homo sapiens
taaaaacaagaaaaagagaatctgatggggattaatacatttattcagactttcagaaagctgtctttaagtggctgaatatataatttggtagttattttgttatagtaaatggatttttatcattaattattaaaatgcccaaatttcatctggagttgttcacattattacccaatttcttgatgataaaatagaggtttagtgagatcaggatcatttagtaatacgaagatgaatatgttaatctgaatctgagtatggtaaatttgaattggattacacaataggcatacaatcatacttttgtaaatgggaatgaaatttcttttcatttggtagttatgcttgtttttaccttactgtcccatttaaatgaaattattctttaataatcaaatgtagaaatattcacaaagatggtatggtaattcattcacaaatatgaaatggcaaattcatatttaccgtattcactctagggaaaagtctggttacttttatgcatatatccagaagtagagtaggggtattacaatttgaaggaaattgttaagttacatttttatgaatacgcaatcaatttatggctttttttcctctaaattttcatattttcccactgccattaggattactgaggaaataactaatgataatgtagatcagtctaataaaccacatcatgctcatatgtactgtatgatgtagcatgaaaaacctcaaaaaatactcattttcttggctaaaaggaaatccccaaagtattctgaaacttgaatatcacagtcaatatcaccgcatactacattttatatttttccatagcaagatttacttttactatgtcttggattttagaatttccagatagatagtgattgtattactgactttatttcttaagctatggctgcatactaaggccctggattttataggtatttcactttgttttatattaagattatgataaatataatagttgctgtagtctctatttgtagctcaagctttggactagaaaagtagggatcactttcacccctatctagttggtattaagtacttgtggccttaaagatttcctgcttagtctggactcctcct

SEQ ID NO: 116350 - DNA, 2091 bp, Homo sapiens
aaagtacataactgagtgacttgaacaacagaaatatatttactcacattctggaggctaggatcctgaaattgagatgttggcagggttaatttcttctgagggctttgagggaatgatttattaaccaggcctctctccttggcttataggcaaccagcttctccctgttacatcaaattttcttccttctatacctatctctgttcaaattaccctttttataagggtaccagtcatattggattagggctcaccctaatgacctcattttaactttattacctctgtaaataccctacatccaaataaggttgcattcttaggtcctgggagttcagactgcaaaatatctttttttgggtgtgttggggggtgagggggatttccacccataacaatgccaataggtctatatctttctgaagcaaggatccaaatcaagatgttggctgggttgctgttttcaaaagggaccatattccaaaaatgattccaaaccattgatctaagagactgatatttaaactagaaagaatggagtaagacttgttaaaagggaactgaagtctacaatagacgagatgatgagataagaagagaaagtaacagcattcaaacagatagctaaatcactgtctgtctgtgcattagattggaggtttgtttagagctgcagtgttcagtaaggttgccactagctacatgaggccattgaagatagaaatgtggctagtccaaattgagatgtgctgtaaatgtatactacacactggatttcgaaaacctgctatgactaagtatgaaaaaaggaatgtagtatgtctcattaataaatgtttatattatacgttgaaattgtattttgagtatatttagttaaacacgtattaatatcaacatattctttttctttttcctttttaaatgtggctaaataggaaatttaaaattttatatgaaatatatatattcaacatagtcatcttgaggttctcaagttttatctcatgctgattttgtggttctagaatagatttatattactttgaagaggaaatcaaattgtactaacaagtctttatggagcacttaatatgagggtctttaggtcatgagatctaacgacccatgtatgactaggattgtgggtataattgagtatttttacctaagaaaggcaaaaggtattgtactttactacaattaatcaatttttttgattaattatagtaaaactgacttaagaatgcgtggatcatttatttgtttgtcccaggaacgtgaagctagacgtgttcattgtccctgttaaacagcaaaccatgactgagttcagacaaaaggtgatgtgaatgcagcaacaatttctaaatcagttaaatgtctataatataatatgtaggattcttgtctttctgggattgtgactggaatctctaccacaaacagcacatctggtcccctgagccaattcatcagcatcgcctgtaagccatatttaagatcaaaaggatagacaaggttaccaatgatgaggttctggaatgttgccagcgcatcagcactaacatgatacttgccacgacttaactctgagggcctggggatgtgtgaaggatggatatcagcaggctctctaagcagattctgaatgcatggtgtggtgaaacagaacagttacaagtatggtggccagaagaaaagctcaatgtgagacccttagtggcaaattcaagccttgtggtaaaactcaggaatgctgagaaatagtaaacctagttaacacccaggattttttgaggagagagagaaaggatataatttggggagtgacaaaataaaaaagatcttaggtactgatggtcacattgcttttcgagctatattatcttttaatttaaatgaataatttggacaaaatcagaagttgtaaattgttgatcctttctgcgaactaagctacatattttctttctttttcggtgacatcagtgttttaaataattgatacaaatgcatttaaacagggcattggtttcctgattttctgtaatctgcaaccctccttattgtcttagatctggctca

SEQ ID NO: 116351 - DNA, 1066 bp, Homo sapiens
ttttctgggtttcccatatttcatatttttgttttctgtgttctaaaaggcagttgagtttatttagcgttaattctgcatcaccaagcccagtgctgtgcacacagtaggatttttaatgtttgtttatcaagtggtgaatgaatgctttgcagtacaactgaataattgagacaaatacagtaaatggagtttaagttgaatgattctttttaaatcattttatctgccatgtttaaataccattagtaaaatgttgacacatttggactcttatcgttattatctggcataacatcaggactacctaagagtttattttagcactgtcacattgctaaacaaagctcatcagttattactttaatttggcacaatttcctacctatttcagaaggataaagtatggtttatgctagttgtttgtctccaaccttcataacacttatttaaacattgcgttatatccaaattagcctaaaaagactccattcattcactgttctttggctggtgtgccccttactcactgattcattgactgtggttgattataaactgccagtgagatccatttctatggatttgtcatttgttacagtttaaatgcatcacaattccctctgctattggactttataatgtgtaatacggtgtttttaatgaccttccctgcaaaatacactcccttgatctcaggtcagcctagtttaaatctgttttgttggacattacccccaagaaaatttgtgtccctcgttattcttctctttccatgaaaccatatcctgcaatattttgaaagccagagtgcaaaataattgtgtctctataaaatattttcagaaagataaacagccacaatattttacattagcctcttcaccaaaatcaccttttacaaaaattttcttcattcctaataaatcgtgtaaagttccacaaagccacccttttagttagttgtgtactggcctgtttgtgaaccccttaagaaaaaggataaaaccacttttgcttcccaccatcatcacagttctttatacttaacaactttaaagagcag

SEQ ID NO: 116352 - DNA, 1130 bp, Homo sapiens
gactttggaatagcgaagccctcctgacagaagtgatatcttcattgagacaagggttggtgagagttactactctcaccaactcaactctcagttgagcaactcaagagttgagcagaatactctttctggcataagattgatcatatgtgcaaacccaggagtagagtgagagaatggtacatctaacaaaattcagtataattgtagaagtaagctgaccaggaaaagaatgacattttaaaaaatactttagggagttttatttttgtcttgaaggcaatagaaaaggatctgacttgatcagacttgcatttttagaaaaattctcctagatgttttaatgagaattaattttatctgcttggccatgtataaactatagcagtaatctaagtaagaaactgtggaagtattggagatgcggataattattagacagatctaagaactgtttatgtggtactgattagattttcaagatgaagttttgaaaggcatcaagactgattccatctttggggcgtgacaagttttgtggacggtaacattaagaaagctttgacctgaacacattactgagacagcatgctcataataaggagttcacacattgctaataatcattgctaactgtaatttgaagatagctaaacagtcttcataaatacaagatttcattaaaaaatacatttataataaaccatgataaattgaccagttactattcttgtcaaattgatgctcaaagtaactttagcttttaattgtctgattttgagtataaataaccaaaggatatacaaattagtcatttaaaaaataaaaaccttacgagatttttgttgaaaattttgaaaaatcataagtaacatgaagtggtacaacataaagaaaacatgtggatgtttggaaatgaaaattcttaagtaaaactttctaatttgggcaatactttttgacccaatactaacttaaaagtgcttcaaaatggtctgaaagtgcattagtctatcttaccaaatctggataatataatcatttttaaaaagcataataaggtaagttacagaatcagggatttttttataccagaagtaaccatgtagtctaatttttccccacctaat

SEQ ID NO: 116353 - DNA, 1040 bp, Homo sapiens
aacttactcttttttatgctgcagatacttctggggtctgtggtttatccttaatagcccactctgcctctgacattgagagtattagatttccaaagatgacctcctgagttaccccagtgtcagcaggtatttgtcattaagtctgacttatagctgtactggctaagagaggaggctgacatttgggaaagttatgtaaacagatgcagacacatacattcttaagtgtttggtgctatgttaataatcagtttatttggtgattggtaattaatagattacaccattgacctgtcttgtaagatggtcgtcagttattcaggttaggttgtgaaaactgagtagcaactgatttacagaattgaaaatgggcatttgataaatggcatggaaaaataatgtttgcttgtttggtcagattagaaatttactacctcaagataggtaactttgagatactgcctattgaagtatggtgtgctagaccttatctcagcctcttttcttgattatctttatacttgtcagtaagacatactacagaggcacaaggtagcctgaggcattggttggttgttttctcttgggaaagaaggaatatgtgttttgaagtttcagactcatttagggttgtattttaaggtttgcgttttgtgcttttttctcttaatattttatatcttttgaaatgaaacaaggacttatttattctaaatattttataaacacttgtgaaatgaataaataaataaaacagccaaaagcagtcatagtagactgagtactctgtgttcataatagatggtggttctgtgacaattggaatattttgaataggaaaactagtatttatcttactttttttttttgtctgtgagaagatatagaagatagcctaaatgaatattaatttggtctttcgttgacaacatactgttttaaaaataataccttaatgatgatattggatatttctgatacttttttatttaaaaatatttgtaaatatgtacattgatttataatcaatttacatt

SEQ ID NO: 116354 - DNA, 1044 bp, Homo sapiens
aatgagttgaaattgaattatgtgccaggcataatgttgatcatgctgaggatcccagaaagtagaaaatagacacagctcctgtcctcatggaactttcagtccaattgttttgtctgataatgacttaatggtttgcgggaagaaggaaatattggttttatgttggagagctgcatcttaggtcttttcactctatgtgtgaaccaaaggtaaggttttaggttgctaacattttctgagtacactgtgttgcttaagcaggtttctgatatgcatgatacagagatgaaagaagtttagctctgaatcaagactaaatatttttatttagctttttaataaagataatgtgtttgtttctccaaacatacagacaattaatattatgttccttttcttttccatgtttaggtaatcatgtcaatgtttatgttatatattttcaccattttaaaagttgacaaagttgatgtaaaccatatcagctttggtaacggtctgctaattatatcattgtaggccctttaggcagactgcccctaagtagaaatgaaaacacctgttagatgtcagtgagcattttaaatattaagagaaatttagcatgtatcagtcagatgttgagtggttgataccctactgtataatgcctcctcttttgctcaaataaaacaaaatgttaaattatgtatttttttcttatttttttatactataggattttttttgcattttgaatacaggagactgaaattttatggctcttaaaaattttaaatactagttgtactttcccaatatttttaatgaaaaaaagaagcttctataaaacaaaagcaaaaataagccttagctcttaaaaaacctcagagtaagacgttctcaattactaatggctagcccttattttaagttttaaaattaaaactgctacctattttcctcccttcctgaagcatgatttttttctctgacagcttgtcatcaaaaacataaacatcaattaggtcatgtaccctatctgtagactcacaaataaac

SEQ ID NO: 116355 - DNA, 1036 bp, Homo sapiens
catctcaaaaaataaaataaaataaaataaaaatttgaaaaccactggactctgtaaattctagtaacttatacgacaatatatatttggaaacatgtatgttaacagctcagttatctttgggtagtgacttttttgtttgtttgtttttgcttggatttttctgtgttttccatattgtctacagcgaacatggtacttactatagccagaccaaaaaaaaaaaaaaaaggtttttgcaaaaaaacaaaaaaggaattgacaacaaatagtccacaagccactgaaaattcttcagcttaccatttttggcattcaaataataggtttgtaaacctgctgtagctatgaaatgtttcctactaagtataggttataaagaacgttgaagatacagttcaacaccctcattttacatttgaagaaactatgtccaaaatgtttcactttgtcgaagctagagctgggacctcatggtcttctgattccattgccttttctgctatccacctaatttataaaatgtatattcataattctcatttcttccatttatgtctacctagttggagcattcatcattgtgttactactttttcctttgagtgaaaactattatttttgaggtgccagtgatcaaatttctctgtttaaaaaactttgtcacaaacctagaacattaaaacaggtccaaaagctctcatataactaattgttctgatatacacaattggaattttataattgactttattccactaattcattaaatgtgcatgtttagtcaaatttataatttggaattgaactaaattgactccaaatattcttactgttttcattctctcttggcatctacaaggaagacattagaacatgttccatgtgccccaccttccttctcagacatgaatgtacttgtgaagcactctgtcttgtattttagggtcttaactcatctcggagttatcttactatgatcacattgatctaacccccaaagtaatggatctgtgtaatattttctacatatgta

SEQ ID NO: 116356 - DNA, 1074 bp, Homo sapiens
gttttgggaaatattccacaaagataaactggccatggtgccatattgtgcaactaattaatatcggtcaagggggggttgtttgtttcattgacaatagcactggtaaattaaaagtaataaattcagttgaaaaccacgtgtaattctgagtcgtatatgttctgatcccattggtaactcctttgggctttgttcagcggggcggaggcatggttcatgattccctccactgtcacttcaccctcctggaatgtagcaactgattttcaaaagctgaaaccatgacttttcacaggagcttgttattccttttttcaaagtttatttgaatcagagtgggattagtctaagatatcccctgtgcttggcatgtgttcctttagaaaagctagctgatccagcccttaattcctggttagtaagataatagacatagctgggtgaggttctaaagatggaataatttggcacaacacatctctgactgaaatctaaatgtgactcttgagaccaatggactgaattggtctgtctgcgtgaatttcactttcctttctcaattaatcaacttcgtgtctgaagtgtctaaaagaagctcttctctaacttttctggctcacacatttacttttctgtctgacagcttgtcacctttattctaggcccaaagcatccaacaagtagtttttgcccttgcttagtggctctctgatacaattttccaaaatgtacactttataatccaggaaatcctctacattcatgatagccataacagtgatggcaataataagagcagctaacatttatttagccccatgtgattatgggggctggcaagtctgaaatatgtatggcaagcaggctggctggaaactcaaataggagttaatgctgcagtcttgaggcagaatttcttctcttggaaacctcagtttttgcccttaaggcctttccactgattggatgaagcccacccatattttctaaggtaatatcccttactgaaagtcaactgattgaatatattaacgacatcaacaaaatagcttcatagcaacacctagaata

SEQ ID NO: 116357 - DNA, 1081 bp, Homo sapiens
gtttctcactctcatgctagtctacattaagtctccagcagttcattaaaattcccctttgagtgttcctatcaatttttggctccagtggcctctaccccaggtaaccacatctcagttgtgactctctcgatttgtctttctccagatttttggatggttgtttgccctgcaacctcagttatctaattggtataaaaaaagtaattgactttcagtttgttcagctttttcttgttagggtaggagaaaagattatctttacgtattgaatatctccttcatataataaatttatttaatccataaataaatggaaaaccacaatattcttattttgacttatatatacattgtatagaattatatataaagtggatgcccttttattaattctatttaagaaaatagaaacttaaatatctatattttattcattttataaatatttataacattattactattatatatcttaagtattctgatcatattctgcactatgtgatttgtaaagattatctgctaaaaatcaatctttagtagttggacactgtaaaacatactagtaaggcccaacctggtgttgcttgtctgaaaaataatttaaaagaatctgtttcactttatctgttactcacttaaagggaaaattttcattctgacttcttgtttaagagttcatgcagcaatttggagagtttagggattttctaaattagtatgaaggagttcaagttctccacaattttttccctaattaaataaattgaatttttatccttttgtcaatgcccactatgcagagatctgtaaagtgctgtgctacaaaattaccaccctttatgaatattggcaggtaaagacttactcttccttaggcattataatgtgcctttattgcaggggaaatgtagtatacccacaaaatcattactttgttgttttgttgggttttatatttttattcagcttacatagattattcatgtgttttcaaaactttaaaatcaacagatgaatgtgaatacattctggtagaaaataaagtgaactttgctggtatcttgtaatctctcta

SEQ ID NO: 116358 - DNA, 1019 bp, Homo sapiens
ttactatgtatgccattaaaaacattacaattagcctgtttaagcctcaatgtatctcagcgctgaactctatcaaatgctatgaactcacaattttccatgactttatatgcaattaaagacctcaatgaaattatttatgtttttatcccccaattatatagtacctactctgtgccaggcaatatgctgtggactgaaggtaccaacatgaataagataactttccctcactgggtgtgataggctgaataaccactccctccatctcccccaaccgccgcatgcgcatgtcctaatttgtggaacatgcgaatgttatcatatggcaaagactttgtgggtgtgatcaagttaatgattttgattatcctaggattatcctggattaccaaagtaagcccaaatacaattacatagatctttataagagggaggcatagagagatttggcacagacagagaagaaggcaaagtgacattggaggcagagattggagagatgtggctcccagccaaggaatgctacaaccacaaaaagctggaagaggaaggaacagattctcacctaatggccttggaggcaatgcagccctgatgataccttgattttattctggtgttactgatttcagacttctggactccagaactataagagaataaatgtgtgttgttttaaacaaccaagtttgggtaatttgtcacagcagtcataggaaataaatgcactgaggaactcaaagtttaatgaaagagacaaacacaaaaaataattgttatagtacagcaagagccctattcgaagtatgtgggagcggatggggagcatgggtggagtattgactctgatggatctagttctttaaagctacttagaagatctgaactgaagcttgaaataaaatagtgttttccaagcagggaagggagtacaaaaatgcagaaaccaaaaaaatatggtgagttttataatgcaaaatggtattttgaaatgcacagtttaaatcaggaaataa

SEQ ID NO: 116359 - DNA, 1051 bp, Homo sapiens
agaagagttgatatctgaacatctccaagtacccgtttttgtattttccactacttcaggatggatagtaccaaatgacttcaacagaagtggagtgaacctgttactaataaacctgggactgatgtgtaattacgttttcagtgattcatctgtgaaacaccctgggttattttacatggaagcatctggttcacatgtgtccagtggttattctgtggtgactgacatctgtattcttctaataaagtcccagttgcacagatgtgagctgttgccttcttataaagacagaacttacaattgaaaaatcctaagcttaaactcttcttgaatatgaacatttcaatcttctacacacacacacacacacacacacacacacacacacacacagaaagagagagagagagagaaatggaccacttgcactgtgtctggaacgtaatataaatatttcatgcagtgtctttcaatcattggacatatgtatgtaggcacctttatctctttttatgtttgtttatagcatagcatctgttttagattgtaagctcaaagaaggcagtccatgtcaatttaatattatacagacagtgtctagaaaagcataattcacttttgagtgcttgctaagtatttgtcaatcaagatggtgatgttaatgactttcaggaaaaatggagtttataatctgactgtaaacaccttttgcactataagaggtaaatgctgtacatggacttgcttcttatttcactcattatcattagacaggtaacgcctaaaactttgttgttttgagaaaaatttatttatgttagaataatcctctagtgatgtgtgatatatgagattttaaagtggcagacttcaaggcatgtttcatgagggaagtagcattttagctcagccttcgagggtaaatagaatttggacacataataatgaagggaaaagaaggagaggccattggtgaagagcatggaggagacaggcaggcatgggttcaagtccttccttggccagtaagttatgagacctcagtgaa

SEQ ID NO: 116360 - DNA, 1054 bp, Homo sapiens
aagtgatagatgatagtggtcgcgagcctgtctcaatgattctagttcagttatctctagataagacccaatgtctgtttctttgagctatagataatattacactaaccttgcagatccctcttccaaccagcttgggggatttcttttaactctggaccttacatgtcttgctcttgctcaacttctttctctattcagttttcctgaaatctatttaattcagcatattggaataataattgggccctaataacaaagttaagactagagtggtagaatagtaaaccacccaccctcttcccccagagatgtctacgtcttaattcctggaacctgagaatatgttagaccacgtagcaatgggaaattaaggctgcagatggaaataaggttgaaaatcagcagaccttaaaaacagtgaaattatcctggattatccagttaggtccaatataatcacaaaggtccttaagtagaaaagagaggcagaagaagaaagtcagaggaagagataagactaagcaagcaacatcagaatgatgtgcagtgagaaggagtccgcctgccattgctggctttgaagttttgaagacaggaagggagtggcctctacaagctaaaaaaaaaaaacaacaaaacagaaacagcttctccactagtgcctccagagaagtatacagctctgccaacttcttgacttttgatcactgagatctgtcagacttctgacctccagaactgtaagatgataaattggcattgttctaaggcattatgttatggtaatttgttgcatcagccataggaaacaaaaacagctcatcccacgctatggtgaaactatcccccttggtcccagtttagaaatcactaacctccatggctagtattattgtctacccatgtgtttgccacttctcttgatagctaaaagtagagttctgttttcttttttgtgtatttctgttttccttaactggaccactaagtttatggtttcagactaatggatgttgttttctcagcgaagaaggtaatacagcctattcca

SEQ ID NO: 116361 - DNA, 1829 bp, Homo sapiens
aattttagtgtataatatgtatatgaaagactaagagaacttagtggatggaaataaagattttctgaacatttgggaccatagatttttttagaaaatatcttacagaactaccttttgagacacactgcacacaaccaagctgccttcctcagaagaaaaaaacatcctctggagtagaagtaagagttagtgatgacccccccactcccattagaatggcctagtgtaaagggtatggattttggattttaacctaggctaaaatcctggctccattaccgacttgactgcctgctcacctatgcttactggctgtgtggtttcaggtacattgcttaactttactgagccttcttattaatacactctcatatattcaattatttgttatttggttaatacatgcaatcagtggaacttttatgtgctaaatattgttccaagtcaaataaagcagagtccccccaactggagaggcttctaggctagtgagggaagtttcgtttgtagcacagcaagcggcagtcagctcacagatcacctggcctgtcttaaaggaataactttccaccaacgtgacagttttccactttcataggcatagatcaacagtagcaaatgtcacctatgtgacttcaaaacttggaatgtatgcaggacatttcaggtattgattttttaagtatctgtgtactttggtattgattaatgaattaccataacaattttgtttatctgaataaagtacagctagagtaacaaaatctttagtcattatgaaattataacatttctgtgtaagtggccagcatccttgtagattctggatatgtttaccttagtggttgactttaaaatttgaattctccagaacagataatcttatttttaaatctgtaatatatgtatattttacaggaaaattttagatttctcatcctttcccaatgtctataaagcatgtcaattcattttaacattaagtgtattcactctttattattctgctgattttatttccatcttcttcctgctcttgatgaatttaaacagcaaagtcatattcattagaaaaagatatctttaggaatttaactgaaaataacaaatgcaatttcttttatttgccattttgtctgccagaaagtttcagcttctctttttattttctaggccaacgaaatgacgtgtaggcctagtgaattccaggcaatgttcagcactggttttactgaatctggatgacttcagtctgttaatttatttaggagatggttttggtttttataaggtcaactagaaatttgtaggctacttttcccacttattctaagatcaaattttttttaatactaacatttaaaatttgaaaatacagtggtaactttggtgatgtcaagtctttaagcacattatttaaaacttttccatttaagaagtgtttccataattgagtttatttcataatgggaattctgttaaggtcaatctgatagctgcttagttacttaatatcagcaagtacctgatattttgatttggctgttttttaaggtcatttcgattaaggtttgatttgatatgtcctaaaaacaaaccgtaaaatatttgacttttttttttttaaccaaatgatgtgtgccccagccagtgcttaggatggattctcaatttgtacagtgcccttaccttacccctcatcttcatcccttgccccatatctgagctttaccctcgtcgtcatcggtgatgaggaggatgaatgccagggaagtttgtgataaaacaaagatgtatatacttttgttattttaacatgagtaaaa

SEQ ID NO: 116362 - DNA, 2066 bp, Homo sapiens
atttttagatatttaattccatgttacaataattatgcctgtatttattgttaattttaacatcgcaaatcccagagggtagtacttgtcatcttgaatgcattaatgcctagcaccttggcactcctgtgatgatgttgtctgaaattggcttgctcagaataagacagaacatgtcccaggtctagtggcagccaactgtagttaattgtctctaatcaagatgccaaggagaactcatttctaataatctgtgcaactaggtaagggtgcaggcttttaaaaatactcatcacctaaacacacttgatatttgggggttttcattggttattcttctctgctgttaacgaaactcttacatagtttatggggtattagcaggtaataataatagtttccaaattctttgtgggaatttacaagcatttacatttacatcaactcatttcatctttagaccacctctagacaaatactaatatctcagttttacagtggacagaatagaagcccacttagtttaaatgacttgcctaaagttacatagctaacatgaaatagacctgggttcaaacttgtgtttcctgacttcaagtcccatgctttctcagctataccaaggtgttgtgactctacccccgcctttgaacttggaaatagaggggtattaccaagtattactgggttagctcaacctaatcataattgccccagaggccacctctaattgataatattaagcatactttattaaggttccatagagaaccactgacaaggtttctacaaggatattaacacacactccacagctttacttctgattgagctctgttattctctggcacagtcttcctaagaccaattaatagtgatcatggcagtcagcctgttatcttaggattcaaagaaaatatctacataaatatagcagtcaatccattgaagtagtgactacaatactgaacctgaataaaatttagtttactaaatgaagatatgcagattcaataaatgattatggaccaacatttcatcagcaactgctataaatgtgaaaaatcattatttttcatatatacacatgatcatcagacccactaaaggtaattcatgtgaccaaaactttctgctgctaagagattaaaatgcatgttaatcagtagaatttaagaaagccagagtaaaatgtaaattgtgatgaaatcattaaaggagtaacttgaaaaaccttctatatcctggcataaaagtgattatagcacagaggacagaatattttatttcttgaccttgattatgagtattgttataggttcttgaattttccttaggtcagaatagagacattaattctaaagcagttagagaaattagtctctttatctctttccttatagttaatagcatagagaaataaatctctaaaccaatttgaaacaggatttaactgtcatttcacttatgtgtctcttcattttcttttactctataacagaagtttttaaaaataaaactattttgattttcttttcagttctaggcctgattcttcactacctgagacgtctaaaaaggagcacatctcagctgaaaacatgtctttagaaactctgagaaacagcagcccagaagacctctttgatgagatttaacagtctcaaaaaatactttgatgttcactagactatgttttctattcatttctttaaaatgaaaaaggagaatttcaagtcagcagccgctattaccgtatcttacaatttaattacatacacagtgaattgaaaccattgtgcaaaatggattacacatgtatacaaagatacgatttgatgatgacactggcacattattctaaactattcattcagcatgcctataattacataaattgtatgagactttttgttgcaaaggacacatttatcatattcattcacacatattatatgtgatagctgtccaacatcctgtctgggaagattttgaaaacaggacaaagaaaacatcattttaaaatgtcttcagctttttttgaatagacgtattcaaacatattc

SEQ ID NO: 116363 - DNA, 1037 bp, Homo sapiens
agcctgggaccttgcgcggacctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcagggaaggagcagaggatggggggtggggttgttggagccccgcggaggtctgggaggcccctgggcgggaaaagcctgttctgaatcggcagggatgtgcaacaatttttctcaccctgaagagtgaaatagggtctgtcgctcccatctcaacaagcaaaccggcacccagagcgcactgcagacaaaggtggctcggggacccgaatcaggggcctctgggtcagtcctctcgcccagactacaggagtcctccgtttccttacatattccccaccctctcctagttctccgctctagttgagcaactttactggcaggtctagcggcagcggcgcgcgcgtgtgccgggagccccgggggacgtcctcggctggagcgccccaccgtcctgcagaggcgtgggcgctgtagggcgacatccctggtgcgtgcagacctagggcatccgggttgttctggcccgcggtctgtgtcactgggcgtggagcggtctgggtgttaggcagaggagagcggggtagaaaaatagtgtcatagcctaaactatttgctctccaatccaactgcgtctcggcaagtcctgcatgtccctgggagatgctgcgggaagggggagaaatctacacggcgcctggagagttgtcctgccgcgcgcacacccgcggcagagtctctctgggtcgcgttcctcatctttgtgtctccctctgtctccatcttctctgcctcccttcccctctcccagcctctgttctctctctctagcttctgcgtcccctcccccacagctgacaaatgaatggctagtgtgaaatccctgcctttcccgtgctccaaggcagcagggagggaggagcg

SEQ ID NO: 116364 - DNA, 1039 bp, Homo sapiens
ttcccttaagtcattcattttgcactccacaatctgcggcgtacatctaggagtttggaggaccctgaaaaaaggtcttggtctgtgcaaagtgcagagatgccttctcgcgagtcggctggaacgcacgcggcgccctgggtccagttcgccgcttagtggacgaacgcacatggccagggtggagccaggtttcggaggtctagacgcgccaccctgggcgtctttaagaaagataatacacataccgtgctctcaaaacccatgaccacttgaacccaacgctagggccccgccccaggatattgcaaaagaagggctcctaatccaaaacttaaacttcctcaacttcagggcgggcgtcggacgggaaagtggagagaaggcgggcagtgggaggaaaaaagaaagggaaggaagggaagtggaaggaaagaggaccgtggaggggaggaaaaggagaaaggaacggagatggggcagatggcattcaaacagccaggaacggaccggaagggttcgtttcggggtttgggtctgaatttcgagactcgttttaggatactcttttccctttcccagcggcaacaaatgtgactgcagaggcgtgccgggatggaagggtgggaaagaactagacaagcggaggtggtccagccccgcccaaaggggctgggtctggggcccgcccccactcgctcacctcgcgccaagggaggacccgcaacgggcgctccccgcagcggctgggttagccagccgccacgtgggttggcgcttcggctcccagccgagacgggtgtgacttcctgggctcagagactgcagtacagccgcacaggcggccggcgcagccgaggcccccacccaccgaggccaatgggggcggggcggggaaggcagggcccagcttaaccgagagagccgagtggcctcgcccccaggattcggggccggctgcttctggagctgacccgagttccatccagacagcgctgaacactcttattaaaaggctatttaagttttattttatttt

SEQ ID NO: 116365 - DNA, 1049 bp, Homo sapiens
caaacatatttatgcaacttattcaaatgtatttagagcatgtctgatctcctccttgtattcttacctagtcttaggggtaatcttaaggaaagtgatgcgtatacttgttgtacctatgtagatggaggaccattctcctctccccaacaaaagacacttttataaggattgagtgtggcacaaagagttcgatttttagtatttaaattgagtaggaaactcaaatacagaagatcctttcctgggtcacacctttggtttttttaaatgagatttgactctctagatattgacaaacatcatattattgggtcatggtaaatcttcaagtggactgattcaaaagtgttcaaaagtatttcaggtgttaaggaattgttggcacggagtttcaaaggtgtttctgcataagaaatagaggcgttgatcatgtatttgatctacaaacattcctcaaggatataccctgaacctggcaatgaagaaatattgtgggaattattaagttgaataaagtactagctctgccttccagaagcctactgttctacagaggagattagacatgtttacagataatttgaagtacatagcaataaattataggatgatttattccaagcataaagtgtatattgctactatagtggtaacctaggttataattttcaaatgtaagagccccaaatactattctttttactcttagtgatatgaaactatgttagaacatctgcagaaagtctgaattagtaattttaataataaatattgagtactgatatattgtatatcactgagatttattttatatacattattttatcaattcctatgatcacttcggtaagtactaattttcacaactaagtagtgacagaaaatgaggtttagagagatatagtattttacccaaagtcacagaatataagtagagaatgcagaacttgcattctgggctatttgacagtggagcccagacttttaaaattaggcttataaagatttcctggaaaaaaagaaaaataaaaaatagagaacaaatt

SEQ ID NO: 116366 - DNA, 1581 bp, Homo sapiens
aaagtttaaaagtttaaacagaaggacattctgcagataaatattttaggacggttaggtgaacagaaaccaacctttccccattatataattgaaggtaatgtctcactgcaaagtgatggtagctggatttgttataattatgaaagcctttggttccaacacaggaccaaagtgcatccttcaaatgttaggctttccctggttccagtcctatgaagcacttttttattttcacttcatctttgaattttgttttcatttcctctaaggtaatgtggcagttattgtaacaaacattttttgtctttcgacctgtagacataattttcatctttcagctgctcttcctaatgttggtccagtcctttaaacctgccctacggattctagtctgcccttctttgcccttaattgcttgacctcttatgcttgccttttttttttttatcacttattttgttcatgttaaacactaagttaaaaaattttaaaatgaatgatgccacatttctatataaagaaatgagcattattaatccctgttgttgtaaaacatcattgaaattgtatgctattctctttatataaagtcattctaattatgtcacatgttgaagatgtaaccaaactattataaaggctgcttatccattcacatattgaatagattaagtttgggttttttaagattgttaatttgttattttctctttcctctagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggtaaggcttttattatctgcaagaaggtagtataacatgacacctggttcagaagcattgagaaatagcactcagaagtaactgttgtttggggtttggatgagcggaaaaacacctgtcaatccagtagtccacgtctttcaccaaaaatgaactggtactcattcaaaagtcaaggcaggtgcatttttggcagccacttcattgattccatgaaggaaagtattgtatactgaaaataacgaatacctcaaggcatgacacataatttaataatcattacttcagtgttgagtcttatcagtgattctttttcaagactctgaaggcgaatctacattttaaaaattattacatatgtgtgtatgcacatgtacatacatatacacacatatatacacatatacacatgaaaaacctttcccccttttttctctcttaatatgattattaaaatatttgagtttgcttttaggaaattct

SEQ ID NO: 116367 - DNA, 1316 bp, Homo sapiens
acatagcagactttttccttaaaaaaacaaaaacctggatagtaatctaaagaatcactcagaaggatttgttcattttaaagaatgtattataaaatgttattaaatgactgattctatggccaatgtacacacacacatacacgtatagaataaaacttctcgggtatgtgttatttatgattatgtattcataattataacgaagctaagtcaccattatcttttctgctttaaagtatcagaagctgctaccttgccatgaaaaagtattacatgctcctccaattccttccccaccatatttatccaacaggaaaggaatgaataataaaactttgggctttttttcccttcttttttttccaggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtaagtgtttgatacctttttaaaaattacagttttaaaaaaaatgcttcgaagcatgcattgatgttcaactagccgttggagtggattccatgtcttgcagtgtgtgcacggaatggaaacagttcagtgattttcaaaagcaagcaaactgaacagcagtgatatggttaaaaccacaggaattttggcaaatggatttttagaggggtgaggaaatatcaggttaagctgtaactgtgctctgttgtgtccagagccacagagcatttttctaagtattttatattaattgcagtccttaagttttgcaatttgtttattggtgttacaatgccaaggccaactgaggctgagttaaatccttaagattgttgattttgtcttcggtatcactctgtttctttgagatggcaaagaatttaaatttcagtaattacaggtgagtatttgaagctgacatggatactcaaaatgttcaagtcataactaaaaatgaaccatactatcaataaaaatctccatttatgtcaagtaatggaaatacatgccttctaatcattaattctgtagtatcatattgacgtacaatatgtgttctttgcaacctataacagagtatctttagttaggtttactaattaacatttttt

SEQ ID NO: 116368 - DNA, 1011 bp, Homo sapiens
aaaagtaagcaaagtaatgtctttgtaagataaagttttcctgtatatcttctcttaatgattaaacaattttgcatatttagttttttacttcagaatttagcaagttctgtgaaagttggagagttatacaaggctttgaaagatcatttcatacatccccaaacttaagtgaatcaaaaccattcaaaactcatgataatctctcacagaatgtgattaattatctccaggagagggagatggaacatgtttcctagaaaactcattctaatattccatgaccttcactctcagataatttttctaattaagtactttgcatttgaatttgaacccatgttttcatttttgagttggagaccaaaatctgaataacagccatttctattgttgatcacaattgtttatttatccctcagcatcttctccaactgaaacagttttcttgttttacagtttcaatctccaaatttctaattattgatatgttcttgctttgaagtttcatcattgtttagcacattcctctatttatgcttaagtttagaaatcaagatggtggtccagagaaggctaaattaattcccaccactttctatcctatcttatatactcattcactgttaaaatttgcctgcccttctaacctttggttagttcattatcttttttgtgtgtgccctagttcataatctgaccacatgtgccaaaactaacctttccccgattggtatattacaaatgtttcctgtttattgaatttgaatttgttagcattccatcactcatataactttaaaaagatagtttgaattggccgggcgcggtcgctcacgcctgtaatcccagcattttgggaggccaaggtgggcggatcatgaggtcaggagatcgagaccatcctggctaacacggtgaaaccccatctctactaaaaatacaaaaaattagccgggcatggtggcgggcgcctgtagtcccagtccctaacccaaaccctaaccctaa

SEQ ID NO: 116369 - DNA, 1528 bp, Homo sapiens
ctaaaattattgaaaacccttgtttttggaaacaaagtcacataaatactggctttctagaacagattctctaggacatattgctaccactttattacacagcaggactagaggaaggaatgcaacagcaaactccatagtaataattgacaatgaaatctagttatttagttttaaaaatatgagtcaacttttaaaacactataaacatattttcatagcattgtagaaagttgctagcagagagcttggattggaacataggaagcctggattcacagcccctttggccctaatgcaattgtacctgtttctaagttaatttcatcagccaaggaaatactcagagggaaaaagtaaatttagcttttttgttgttattaataataatatgattaaattttctctaatatgctgtttgctaagtatttatattatgtttccatgggaactttttctgtatgtatctttttactatttccccaaagaatgcagttataagacaaacatgaaatttggcagttaaatgaagtaatggttatggaatttcagaggatagagaattgaattaaaatagtcatccacattttgggtttttaagttgttcatgtcaatcaaaatagaacaacgcttcttccaggaaatgaatgtagaaaaagcttttctttaaaaaggggaggaaaaggttatttaatgtttttaaactccaactcttttttggttagttttgttttaatattagaaagataaataatgacagactttaaagaatatttaaatgtatcataatgtaaatagccctcaaatgttcatgataaaatcagtgaagctgagctttaaaatggtctggggaatgaccacaactaataacagctcgtgccagacaaaaaataaggaacctgttacagccctagtctgatttacaataaaatcacatcattttatgattaagtttttacagagcaaatggagctaaaaggtagcctgttttgttttttgagggctcctgttctggaattattaaaaataaaaaagaagatactatagatactatggctattacacctcttttcagggcaaacaagcatttactcataaaactagctttaagtcctataggatgtagcaaaacaataactacaggtttcttcaggacagttcttttgagttcagtggcaactattaataggtttttatttttaaaaatactgatttttattttaaaaaaacaatcattatatagtaggctgctgccttttccctgtgttgagaaagaatcttgtttacaaactgttgcttttatacacaatttaaatttctttcaacaggccaggccattctctgtaaatctggagccattataatgcagcattttatgatgacaggttactttatattgcctgagcctgttctttctgatgcttagggttgttcccagtgatttgtaattacagacctaaaatacattatgtgggtactttacttcctgttctacatttgtgtttcaggctaaagtaagcctggaaac

SEQ ID NO: 116370 - DNA, 1911 bp, Homo sapiens
aatgtagaactacaacaaatgccgactagcctctgccaggcacattttataatttattagaaacaaatctacaccatgaagttgaaagaaggatgaagacaaatgtccaacacctgggatcaagtgaagagtggtattaaaaagttttaatatcctgtttttatgaaagtctccacattatggacaatgtaatggtttatatgtaacttggatacatttcatgtggcttttttgttgttttgcaatctgagacacaccctctcccctgagataatatgcagcaacttgaaaagaagggagcatgtggagaaagctggagacagggtacagaagcctccagaagaatagtactaaattctcctgcgaggcttcaagttgacgctgtagtttctggtaaataaacaatctactgtatctaaaatctgcatttatatttttgggagcttttccttatcttaaaactacataatattaattttcctcaactggtaacagtcatgcatacttttaggtaaaagcagtgataacccttataacgtaaaacaactgatcaatttatgactattaagtgttcaattatctgtccttgggttaattcaagtatagttttaagactcctctccatcacagaacatttctgggccacccaaaaatactccctacaaaatactcaggagcacttaacaaacactgggcatacaagtttttattagtgacttgtctaatcaactctttgaaattatttttctagctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaatt

SEQ ID NO: 116371 - DNA, 1023 bp, Homo sapiens
ttttagcttcatatatttgtacaagaattggaagaatatgttaaacaatgtggaagaatgttagatacaattttatgttaaaagtcataagaagccctgctttgtcatctaatataaccaaatcatcactgttacatcacttcaaaacatgcagaacaaagtgttttaatttcagtgtcttttcatacattactactcaagtgtagcactagactgtgttaacattccattggtctttaactattaaccttcagtacttacaatgtggacggctaaaatcgttttgcatatccctaaggttgacagaaagatatttaaaggtttgctttggtttttctcttccaggattttacaggtttattatatgacttgtgtggtgggtaataggtctctaatgtaagtgttattttaatgtaaatgcaacatattcttatgctattgttttggggtattttactgtggttttatctatttagagcaagtacaacctagcttagttgtagggagtattacagtttattgtattaaatataatttcagaaggtggctatatattcattatccttgcttcctaaaaaccaggctgtagtgttgttcattttatgatttaattgttttaccgctaggaatatttgtgatgccttctattccactcaaatattttagctctctgacagaactcttaaaagctgtttgtttacattgattaatacttggagttgtcatgatcaaatacgatttattgctgtctaaaggtgagcccacaccatcttttacatttgataagctgagttgagaatatatagcaaatgcagttcaataaatcaattcaggtttgtctctttctagtttagaaattacgatcatggattttagttaatttgctatattttcattttcatataagaattaaatgaatgagtattcgttgttttcttgacctggctctgagaagacaggatagaagatttttttttttttttttaagcagggttctctcttactgttggaatattccctttc

SEQ ID NO: 116372 - DNA, 1035 bp, Homo sapiens
gatttgatcatgattttcttgctaatgatattgtttcttggaaatcataacatatttcctcttttctacatccttttccatctctcggaactggtgtaggaaaaagaaaatgaattgccagtaagtcggaatgaggattgcgttaggctggaaaagagacaggaatataacggtgaaagaaaaacaaaaaagaggtaaaaggaagcaaaaagtaaatgactaccaacacttagtttcataatttaaaaaaatgcttgaatggatatgcagattgtttttcaattgatactactctgttagtgtagctaataagttgagttgaataatataaaacccagtaaaaatgttctgcatttaaaaactcttccaagtgggaaactgccagttaggaagtcaaattacaaaatggaaaaagtgaaacttgatctctctgaaagaattggcagtcatcaaaaaaaaagaactaagttataaatggttgctggaagtggagggtctgagtaagctaaacctgaaacaatttatacaaaggtgtacatttataagtgagttgtggacttgattcagctagacctgggagacgtatataggtgtttcttctccttctgcttctaaaatgtgagactataatccaccttgaaattaattttgttttgcataataatattaggtcagaaaaccgtgcaatacttggttacttccatcaggcagaattctaatgtgagagtgtgtatatgtgtgtacaacaaggggatgtatctgtggaataattatgtatctacctacctacctaccttcctacctacctacctgcgtacctacctacctacctacctacctacctacctacctacctacctacctgtcatcatctgtatttttgtgtgttctgtatatgctgttctccttaactaaaagcattgtttattgtcttcataagacaatgaagtttactcacctctaactgctcacctatactaatattatttattttctatgagaaattttatcctccaacattttgagctttggcaa

SEQ ID NO: 116373 - DNA, 1926 bp, Homo sapiens
tattttttaaataggaaaacaaaatctttttgttacacattaaaataaaatccattttaaaaaagaaatgtgatcctaatatatctctgctgagtagattggtgtacatttacgtttaattaaaagctcttaaacttaaattgtaaaattccccaaagagaacgtgaactttaaccagctgcctatgcatcttagcaactatgttttgtgtctggtaacagtatgactggaagacttgtgctctgtctacaaaactttgttatgaagtacttaaaaatacttgtgaataatttgaggtcagctagcaataaagctttgtgtgaaatgtcattaaaaaaagcctattaaccatggtactgttatattcaagtcaagctgttaaaatacattcatataaacatagaaaagattatgcatacaccctgtagagttctgtggtttgattcttgaaatccaaacaaaagttatattgccttttgagtaaaattctagaatagagcagtcttttataagactaagagcttcatctaagagcttgaaatgtcaattacaccattgggttgctctgttcctatgaaatagagcacatctccatttcggaatgagatacctcctctcacagtagcacaggtgtaccccccaacccccttactatacaccgcaaagaaacttttctggtttgcaataatctctgttgagattctctaataacgtgtgtggtgggtggaggtggtgacaggaaatggggatgaagaggtaatttcagaggaagaataaactaagagggggcaagtaggatttggtgagatgcaaggagttagtgacaaatatttgggtgatagggcagggaaaaatttatctgcatatattaatagtagataggttttataccccacctctccctgctatgagatgttaaaagtatgggaagaaattatactgacagaataaaatttagattgtatgtataggaaatgtcagcagaaaattttaacttgaaagccctgggtaattaacatttctctctccttcaaactgatattaagaaatccagccaggtgcagcggtacacactgtaatcccagcactttgggaggctgaggcaggaggattgctcaaactcaagagtttgaggctgcctgtaatggtacccctgcactctagcctgggtaacagatcaacaacctgtctaaaaaaaaattcaataaaaccatttgcaagttgtcgcgaacttatttaaagaataataatagttgcttaattgtgagactattactttcagaaaaaggaaacaaaataatttcaactcccattttgcatattttttgaaattaaagaattcccatttagtagacaattttttttctggggatctaatatacaaaattaagactgtagttaataaaattgcattgtattagagattttgttaaaaaagtaaatttcagttgctcttctcacaaaaagatggtatatatgttaatctgcttccttttaccatctatatgcatcccataacatcatattgtaaacctcaaatacacaatagagtttattttagaaaaagaaaatttctatcatacttattaaatgagcatattattttatttatatgtagattttcttctcaattacttaatttattttgatgtgctgccagcttcatgatgagaaacataagatgaaactgcataatacatttctgttttctatcattttgaaggcaagtcagatcaaatagttgcgaggtgggtggagaaaggaatcctaatctaaatttaatgattagtacatttgcaataagtacattccaaaagtttcccattaaaataggagaaaagagtttagtaaggccagttctctaacttactggcaggaacatttgtttcagagagagagagaggaagggggcaaggagagacttgg

SEQ ID NO: 116374 - DNA, 3885 bp, Homo sapiens
agaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatgg

SEQ ID NO: 116375 - DNA, 1557 bp, Homo sapiens
ataaactgcagttttgttagtttttacatgtaactacttcaatataattgtggggtgtattttgtgaaagtcaaccccacctgtggatgagcaattctgtgggaagattgccaatgaagaatacagtgctatgaacaatgccactttcttgtggaattatgtaaaaattggcaacctagaaagtgtagctgatactgccagtgtaaaatttagatatatttgaaaaatattattgtcccactggaatatcagttatagtgtgcttattgtgaaacacacacacagacacacacacacacatatgtatatgacctggtggaatgggggggtgagttaaataatttaatttatttcatttttaataaacttaaaatcttgatgcattttcattgggcattacctatcttacccttctttttaggaagaaggcatacagttctagctgtatcccaaaacgtacctattcataaaggatttttttctctttgtcagttttacatgacaagagcctgtgacttctcagatatctctttgggaaatgggagaggactacttccagaacctttgaagttgttatgcaaatagggcattcataattctattagccggaactcttatctatcacttgaatgagtctcttagaaaagttgtgttggtaaggaattagccccagttgcttcacaagtaagtcagccagtgctatagcagcccaagagattttggctggcccctcttccagttttctctggctttaatcaaggaagttgctgttagatgctgcctttgcaatccaaagatatatagccatccacttggcacgaatcagttgggctcacttcataataatttctttgtcatcgtgaccaaattttatgaatcagttacttcagggacattgcacagatactggcttgggtatcctactaacacttggttgggggtgccaagtttgaatgacgtatgtgcgtttaataagctcctgcctgtttcttctcagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtatgtaccaaatagatacgagtttccaggaacttcacttctcatcactctcttagttttgtctgtgtgcaagtgaaaagaagtagctttttcaatcataatacaacttatcaaatccctcatctgtgaattacttaaaatcatctcacctatgttaagtcccccatttggggaaacattcaactataatataggtaggcattggtttgtctgccagcagtaatagttgaaacacttgctgtaggttgaatcataagcagttgctatttgatcatttttaaatatacaaaaacagctatttcttatggctcaatagaattcttactatggttatactttcatagtctctattttgaatatttatatgcctgtctaaaattacagttgttttcagttatttt

SEQ ID NO: 116376 - DNA, 1046 bp, Homo sapiens
catatttaatgttatgctatacagctagactaattcaactagtatactaaattaatgatgttatttggctaagttatctaaattgcccttattcttgagattctgatggattcattccacattactggcctctataataggatgttgttatcattgatgaaatgccaaattctcatttctgttatatttttaaaatctattactttttttatttggggtgtttgcccaataaatttcacaaaagtgaattcatgaataaaattgtgcctagccttacccttgtgatttatattaagattatttcttttaatacatttcagtttttactttgtcacttggctttctcctaacctagttattctttaacttgactattgttaacttgacgattgttctctatagcaaaatgtgcctactgctttattggaaaccctaacaaataacttcactaatgaattgctttgcttgtcacccaagtaatatcttcaaagacactcagttaaaccatccaagttaaatatacattaaagctggcaaacttaaacaaacttttcttatctagcttatatactgttagctgactttaaagttctttcttaaaccaactgttaaatgaatgactagtcagagtgttttctttcagatctgttttccagtgctaatgacctttcccttccctggctatgaactcttgtcgctcccttaaaattcttcagtgtctgctcattgccttcagtataaaatgttaattattagtatggcagacaaaaccaatccactccgtctgccacttcctgagctatagcatctcaaaatactctcagctcctggaataagccatgggttctcactcctgggcggctttgcctgtactggccctagtgtttagcatattctcacgtcttatcctcatttcatctcacaaacagtcaaataccctgcatagccaagggtctccttccaggaagccttccttgctgggaatgactaagagctcctcttctgtgctcccacatcttttttgtcctccacccatcctaactcag

SEQ ID NO: 116377 - DNA, 1497 bp, Homo sapiens
gattttaatatttcagaattatgattttggggactttagatgttagggattttaacctctagggattttggtctttaggaatttcaaaatttgggattatgacttttgagattatgtcttttgggattataattgtcaccggtttttgccaactgcctggtctctgtaggcatttgagctttttaaccattcccttagaagtttattttatgcttataaactatggatcacaaatgccatccttatatctgtagttgaatatttacaagatataataaaataagaacatgtgtaatataaattttatgagaattgtttagttaacattaaacaagaaatattttaaaagcgaattttttaaaaggtgtgtttatcattggccaatttctaaagcacgctgtacagactttttccctaaacaaatagaaattctgtaaaatattttaacctatttgcaattaataatggtgttatcacatgaatatttaatccctagacccagacttttacccatctcaaataagagtacgaagtacacatgtaaaatataaacctatttgattaatttgtctttgaatacaaaaataataaaactaaaaaccatactctataaatattttaggaaagatttaaaccccaataatgagaaattctattagaagaaagagaacactaacatacatcaagcccgagtctcatatgaaagtcagctgttagcaataagtacgttagtctgctgttttctcacccaaggtagaatgtattctcaataccttttctacatgagaagctttcctgaccatgtcccttacttcagcacctctgcgatgagatttgtaaaactagcaaatcaagtattttctatttttctttttccggtgtaggaatctttactaaattattcgtctctatccaaatgtcatgtttgccctcttatgtctccaatggtccctggagtcatacttttcattttatgatttaaacattcttacatttcctattttattttctcctatagcagggtttctcaacagcagagctattgacatttttggtcagataattctttattttgagaggctatcctgtgcattaaagcatgtttagcataatccctgccctttgtatactacatgtcagtagcacctttacatcctttctgcattgtaaaaagcaaacatgtctctagacattgccatatgtctccagaagaggcaaactgtcccacgttgagaaccactgccctataccaaaaaagattcacaaaaacaccatgattgtttacatttcccaatggataacaagttttataaaatactggttctacctcattaaagaagaagaaggaaaaaaaccctatttttgcattttatctcccctactcgctgatttttatatttgtgcagtcaattctttactaatcagaactctggggaagtttttaaatgtttataggcttttaaaaaagatacccttttctctttttagatattttaa

SEQ ID NO: 116378 - DNA, 1312 bp, Homo sapiens
atttataatatatacaaaaggcatattttttaaaagaacacctcaatgcatactgcccatgtatctgtggagtatcctgtgggttcctctcaatcctatctatttacttctcaactcccaccagagataatgacttaattcccttgcttttcccttttctattatgatatacacttgtttcactaaacaataaattatttagtgttgtacatttttgaactttaaataagtgggatcatactgtatatattctgtgctttgctcttttttttgttcagcattatgtttgtgagatttattcatgttgatgcatgtaatggcatgttctttgtttttgtttctgtattgtatttcttgtataactatacaacattttacttatcaattctcctgtcagtggacgcttgagtcatattcggtgtttttgcttttataaacaatgtttctatgagcattcttgaacttgttcttggtcaacttttgtgagtttctgtaggatatatttccaggagtgaagttgctgagtcataggatatatgtaccataaaatctactttaaaaagccaaatttttttccaaagtggtggtaccaattttcactcccaccaacaatctgtgatagatcctgttgctctacatcttctccaacatttggcactattggactttgaaatttttgccaatctggtgggtataaaatgtaatctcttgtgacttaattcacattttttgatacgtctctctgaatatcttttcatatatttatcaatcacttgaagctctgcttttgtaaagtttctgttcatatcttttggttatttttgaaaattgtttacttataatcttatacatactaatttgtaggagttctttttatattctggttactaatcccttgacaattttatatgttgcaaatatcttctcccagtttgttgcttgacttcacccttaccttatgatattttctgatgaacagaatccttaattttatttattttttttcctttatgatctaatcttttttgtgttttaagaaatctttacctactgataacctacaggtcacattggcaggcttccaaattaatccgcctgggggaggtcttatgattcatggcttacatcctgtccctgagtaaacaattttatcgtgagttcctcaaatcttatcatgaattccttaaactgttgacatactgattaatatgtagcctactgacagtggaaaaacactgatttgtttctgaatcctgaagttttactgattgttttgcacatagagcattttagcttgtattttgtaaatcgt

SEQ ID NO: 116379 - DNA, 3031 bp, Homo sapiens
tatttgtatttaggagactttgtccatatttcaaaactatgatgttattgtagattgtaaggttttttgtttgtttgtttgtttgtttgttttgttttgttttgttttgtttttgagacacagtcttgctctgtcacgaggctggagtgcagtggtgcaatctcggctcactgcaacctccgcctcccaggttcaagtgattctcctgcctaagcctcccgagtagctgggactacaggtgcccaccaccatgcctggctaattttttgtatttttagtagaaacagggtttcaccatgttggccaggatggtcttaatctcttgatctcgtgatccaccccgcttggcctcccaaagtgctgggattacaggcataagccactgtgcctggcctgtagattgtacgtttttataaggaggtaatagtaatagttaaattcattattgtcccaagtgaaggtaattaagaaataaaaacttagggacggtgatgaagacagtatgctttttaatttggaaattttgtcagaatagtggcccttccagaggggtagatgaatgtatgaccatttagtcctatggttgttttaataaaacaaatttcaagatggcataatctgagattcaaagtaggcccagagcctcaacattacattttctttttgaaaaatttcatattcttaattctaaaagattgcctttgatgaagttgcttactttggtaccataaagaaagagagaaaaataagagactcatattagttgaaatacttagattatttggaaataacccaatttgctttcctttagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgtgtgttttctttttttctttctttccttccatgtagcatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgta

SEQ ID NO: 116380 - DNA, 1018 bp, Homo sapiens
ctatgcttcacaacatgaggggcagaatgtgatccgtagtcacatggcaaggggcaagggaaattgtgtggctctggtacctgagggcttcagggaacatgccagggcatcagtgggaatgtctagacacccagacagaaccagaggctgctctgggagctggggatgctgttagaccctctgcacagatggaatcaagagtcagatgattagttatttaagccattatgatcacttcaaggctgttctagtgaagacaggggtaaatgaggctaaaagtgtttcagacactttaatttagtagtaaaagagccctttctactcacaatgaaagcttattctgaacacagatacataatacagatagaagtagagctctctgtgttgaaatggtaagaacctggagctacccgcttagctcaaccggcatctatgtttcttacagctccctaagtgcttccaatttgcagccaaggtggaggaccactgccttagagaaatgcttctcaaacattaatgtacttactagtcacctggggatcttgttaaaatgcaggtttctattcaggaggtctgggatggggtctgaggctctgcaagtctaacaagctcccaggtgattctgatgttgccggtaggtaaaacacactttgaataacaaggtcttggaacactggttctctcactttcgtgggcataaaaatctcatagggtgcttattaaaacaccgattattgtgcttggctctcagaatgttggattcagtaggtctatgatagggcctggcaatttgcatttctaatatgttcacgggtgatgtagctctgggcgtgatcacgtagggcaatatttgcaaaacctggcagaacttggcaacctcataatgtatactcatgcctggcacctccacccctccccactccccttgacgctccatccctgcctctagcagaatctgctttaaaggccccttgttgatgctaatcaaaccattgatataaggccttataggtcacat

SEQ ID NO: 116381 - DNA, 1027 bp, Homo sapiens
attgattttcaacatgaatctatttctttattctaggaaattatacctattgttatttcctttagattaagttatttgcaccataaactatggtatccaaataaagcaagtcatttaaaaaacattaacttttaagcagttatgacaaggtgttgaaatgttatcatcagagaaattgagatttataatgaagaggaagcttaatggacttatgctcacttattcatagtaatatagatttggagttatttgatttgtataataggaaaagaaaaatacacatgaagagaaaaagaagagattgttgtcctatcaaatatattttttaaataatgtgattatatctcctttaattttcattcaaacatttgattactgtagtaggccataaaacatttaaaaaagggtaaactagaactaggcgtatataaagaagagtgaagagtttagttaataaaaactataaagaaagggacattctctaaaatcaagaccaatgagagaaggaataagcatttaatcaaagaaagcttaaatcatgttttagagcatctacagcagcagtccccatcctctttggtaccaaggactgggtttcatgaaagacaattttgccacagaaggtgggttggcattagattctcataaggagcacgcaacctacatcccttgcatatgcagttcacaatagtttgtgttcttatgagaatttaatgctgctgctgatctgacgggaggcggagctcatgcagtgatgctctttcacctactgcctggttcataacaggccacggactggtaggaccccaatctaaagtatggaacaggcttagggtaagtggacaaagaaagcttagggtaagtggacaaagaaagtaaagggctaacggatgaatgacacagcctttgttctcatctttcctcatactactagtaacacagaagatagaatgaagacaaagatatgacactttaagaattcattgaaaataaatgttttggcctggagcagtggctcatgcctgta

SEQ ID NO: 116382 - DNA, 1042 bp, Homo sapiens
gataaattgtccaagttcaataaatacttggaatgaatacttggaatgaacagcatcaggaaaacttaaataagtatgatcatttcaatgtttcttactcccagcaatctcttctaacttaaatttaaccaatcaaataaaacagtacatttaaatcaaatagcaggccttgttggcttattaattaacttgactctcatcatgattacagccatatatttaggatttttctgagtaaattttctttacctgtgtattgctccatttcatctgagtttaacaagttctctaaaatgataaggttaagtatttgtaaaacaggaaaacacagctatcgtttgatcttttttaatttaaatatcccattttcactatctagaagtgatttacttacctctattattttcttatgcaagtgatttctataataaatttataaaaatatatttccctttaaaacatcactttgaagatgattacatatctattacaaaacctctcctgttcaagcttagataaaacaaggaaaaacaaacctagcataggcaatgccttttctgtgtcaccgtttttgcctttgcatgcagtattcccactgatagttggatgaggaaaggagcattacagcaacattaacatgtcaagctcacaggctgtacctgccaagcagataaatgtattgtgggaattaacaagcatgctgcacctgggttttctcaatggtattaaaaataattcttcgaatagcataggtatggtagcattggtgccttaagacttaatattaagatttgtatatcctgaagctaaataaggaaggtttggaaccctgggaatgtgatgctatctgtcctaacatctaaaacagactgagaggttttgctttagatttcagagaagtaattggaagaaaaaggttaaacaaccgtactatatagtcaacaaattcattgtgttaaatgtagacaacataaaaatgaagacataacttttattgagtgcttactgtgcacctgatgcttttttaagcgctcaaatttca

SEQ ID NO: 116383 - DNA, 1049 bp, Homo sapiens
agttttccctgccctttgttcttccttcttttttattcgattcccattatctttagtgatcattcccttagcatttcagttttctctctgaagtcctttgtgctgcacgttgtttgattacttgtgtttatgctttgtttcttcagctaggatcattagcacatatctctcagcattggcaaaagtcctcgaaatcattgacacctagcatatactttatttttaaaaaagaaagaaagaagagaaaagggatgggtttattgtccttttcaacagactagagtatacggggtgaaactgcttcacttgattcaataaaatcgtttccggtaacaggccccaggaatcctagacctaagcctggcgcgaaactacatttcccacaatccttcgggggctgataaggctccgcaatggtctgaactacaattcccacaatccagggcgatttccgctttgtcgcgtttcctcaaggctccgccccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaaggttagtgtgtaaggggcacggcttcgttgggggagggggcgcttggctgtgactcgcgcacctgcaaggccgcctccgggctgtggcgtgggagatgatagccagaaaccaggctgagacgcagactagcattccacttagcccaaggaccagtgaggaagctgggcatcctagcgcgtagccgctaaaggaatgggcaggtagatccggaagccctgcctccatcagccacctgacgccccctcccccgccccgcagaaagccctgagatggctccgggaggccacggctgtaggtgtgttggttaaatccgagctggaggtcatcggacccgaaatgaaggtcattggaaaatcatgagg

SEQ ID NO: 116384 - DNA, 1040 bp, Homo sapiens
acttgtttaagttgtgaaaaatccctgaagataaaacccttctagtgctccttgatacataagtcccagataattatgcaattgtaaatctgtgcctcaccaactcagccatgttgggaaactcaaacttttaaatatactttcctcattaaggcagtggttcttaaatgaggatgattttacaacacaatggggcatttggcaatgtgagacatttttgatcgttccaacttgggggcaaaattaccagtggtgctgaggttgagaagccttgtgtcaaggggatatgttaatatatgctcaaaggagtcgttcatattggaaggttagcagatttgctgtgtgtggataaaatatttagcttaattgtcatcagagtttctcagagtaatactatagaacactaggatgattggaaagagtgtcatagtttagagggggaataacttatccaagctactaatgcggaaaggttgcggtgcatgtgatgaagcaaatcagtatgaatgaattcatgatactgtaaacgctttctgatgtactactcaaactgatagaaaatattttcatgaaactacatgatttctgttaaatgaatgggatttttaaaatgccattaatttctgtttttattttgcagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcgatcttaggtttatttctatgatttttttttttatcgttaacttggaaaaaatacttttgctcttgccctttgacatagtaaattttttttcccatgattgattaat

SEQ ID NO: 116385 - DNA, 1044 bp, Homo sapiens
tttcatctgtggtttgttaggaaaagtttttgaagtttcaggtttcttgggtaggaatttaatctgatcacttatcttccttacaggcatactacctggcgtcttcctacatttattgctcctctgggaaagtgtaaagtctttaagatggaaagcatgagaaaatgtgtatctaatgagaaccggatatagttctgtcccttccaagttgaggtggtgtcccagaatttagtcaaactgcggctaccaaggcagtcatagtgtatattaacttgtgtgtgttacttgataaagctagatgattagtgagaagctttgaatacaggtgtttaaacgagtactatagtaataatttgaaaaatgtattggttagaatgtttttatttcagtgcacagcccagcttctgattagagaaagcatagtgatgcagaagagtctttgggtcacttaatgagaacttgggtcagagagaaaggaaaggaatcctgtgtattataggtgtgattaagagcctatattccaacaatgtatcttcttccataggcttgccacttaatattaacgcactgcttttatagtggagactttggaagtacaacagtgaggcaaaacaaaatcaatagagcttcccttaaacattttttgttggtggccagtatagtattctatttaaaaattaagttttacagtctgtaaaatatacaggacaatgacttttttaaaatgtaagttaatacctcctcctcacttgtcttaattgaacttaggtgtttattcttaaaggtggaccttgatgaaaatgttgagatgggaagtgttattaggcaaaacttgttatagatttctcatataacccttaattgacccttagaattttaacaaccggccgggcgcagtggctcacacctgtaatcccagcactttgagaggctgaggtgggcggatcacctgaggtcaggagttcgagaccaacctggccaacctggtgaaaccctgtctctactaaaaatacaaaaataagccggacgcggtggcacgcgcct

SEQ ID NO: 116386 - DNA, 1001 bp, Homo sapiens
aatatgggaggggactataaaatggcatgaatacagcaagttgagctttcctcagggcatcaaagtaacagtaccatgtgtattacttattttcatgtaatacgagataatagaatactagtagtgagggacaggctgggagataggacaaatacttatgagttcttccttcaggcccagcaagctaagttgtcttttgttaaatgagtcaaatttctccacaatagatgttgctttttggctaccattaccttaattttaaaccaaaaatactgaatacggatgttgtttattgtttgaatatgcaggtatttctgtgttaccttgaaatcactggcagtacatttcagttttgtgctgcgttaaaaattgttgttattagatacaacttattgataactatgtatgtcttgtcacatctctacaggatttagggtatgatgattttaggtgttttagtggttatgtgatttagtgagtaaaataatgaacagtatgggggacaaaaagaaatatacaattctacagtctagttggaagatgaggcattactggtagggaaataagatgataaaagtagtctacagatacgttgtgcaggtaaatttttcaaattcagaggatagttgccaaagagtgaaagaatgaaagtaaatgaaagaatgatactgaaatttcataccataattctcttgaaggaaatttcagtatcattcatttaggattattacagtgagaaagtgtgattaacttttgtaacatttgtgtttcaaattgtagtcaagttgttatgtgtaacatagagttttagttacagagggaagcttctctgcttagatacagaagtagccttaggtagagtgacttgcttcactccaccctacaccctagctaagttcatataactaggtagtggtagaactgggacagaatccgattctcatactgtttcacatatatttagatttgagtaatatttataattcatttttttttaaatt

SEQ ID NO: 116387 - DNA, 1082 bp, Homo sapiens
tcataatgattttctttaatgtgcttatttaggtggttctagaaaggaatagtttaattggttaagtggtaatgtctgctgccattcagctagtgaaatattggccatcattaagaaggattgtagaatcaagatagaatacaatattctatgattattcaaatattgagttaaatgttgtataatacaagttctgttgtctgaaacattgtccaagatacaatgaagcttgagatagcatagagaaagcagttaaagctttcaaggataggagaagagatttacttaaatttacttaatagattttgatttgtgaatattaagattgaaaggaaaattgctggaaaaaaagacaaatacagttatagatacagggttaatggtaccatccaacaaatctggaaactttgtattcagatgcattcttttaagcctgaaaggacaaattcaagaattactaatggttttatattgatgaaatacatcagcaacttgttgtttccataattgtgtggaggttgaaaacatctaggtttcagtaaaaggaaactaagttgtatatgcatctctgtactcttaaattggtaacagaaaaaaaacatacattcctttctcataatatatcccttggtacctaccactttcagagaaagaatgctgtacccattggataatgggtatctgggtgaattaaacaagccctggtttttttataagaaaaatgttaactgacataagcatctacatcatgcttatctaaaataaacattttctgaagtaactctatatcttatgtatgtatagtgtgttaattatatttattttgtgttttgattttatatctaccctacatctgaaagagtaataacattgaagcataagtttttcaattcagttttcttgtagttacaccccaaaaccttcaatatatgtacaatcagtttctgttaacagaagttgtaatttgaatctaacaataattcagtgatatagttagtgcagatactactatcaaacccattttactcatgaggtaattaaaattcagattatttattattttcaggaattgacatgtggat

SEQ ID NO: 116388 - DNA, 1035 bp, Homo sapiens
tattacgaagatttacatacagaatttagcagttttagccagtattccctaactatgcttaggttccttccaaattaggacaggtgtagatattactgaccagaagttactgctgcaaaatttctgctctctatttttatgtattaaagctggtaagatacaccagagagatagcagacaagcaatgtggatggttgtgaatcataaaccagaaaatttgaaagaaattatcttaaaaaaaaaacaagttcctggtgaaaatttacatatgtttatgactttgaatgcactttgtaataatactacttaacatcttttcttttttatttgataattagggaaaaactaacagcttaattcttacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacaggtaaatcataattttttagctatcttttacttttcgcaaaaatagttgaaatcttgataatacagtattcagagtcaaaattatataaaagtttctaacttctaaaaattataagaccttcaatataatttcatagtagtcatgcccaagaattctttagacagtgtcaaatatgaatacaaattagtaacttatactttgtttccttccaaaacaatttttgtgattttaaaaattagacataagctgtttgcaacaaatttactaaatccatgtgttatctgtaggaggagcaaaatatcttaggaaaagaaaatatatcaacattattttatcagtgagatactttagtaggaaaaaaaaagtttctaaagatacctgagacttattatacagatgttatcatgtaactgagttcttctcaagttgacatttcttacatgtgattgttggtttttacttctcactttcaaagtaaactcattgtttgtcccaaaactcagaatgaattatagtta

SEQ ID NO: 116389 - DNA, 1043 bp, Homo sapiens
ggtttttttcttctttttgcctgcttttcatgtgttttatgacctgtttctgatataaaaccagtatgtgtaaatgtgataataaaaattcttaatttacctgaactctgcttcctaaataaatgccatgtttctgtgaattcttcattcttagtatctcatatatactcttgggggtgaaaaaaaaggtagacttttaatcatttcctcatttatggtgactctttgaatatggtattgttgacctggctgcccacttgatgggtatggaaaatcagaatctgggccatgtattctggcctgtaaatctatattgagaacattgttttttctaaaataatatgaatgttatgatcatttattctattaatgtatttgtgttatgtgctttgaaaaaaatttgctaattagataatccttggcaagaaagtttacacatatttttaaagattttgcagttttatgagacagattaatactagaaatttttattttaacagcattggggacatcatagatcactatcgaaaagaacagattgttgaaggatattatcttaaggaacctgtaccaatgcaggtcagtgttgcatttcttattgcaataattagcattttattttaaaatgcattttggtggtatgtttttgcacacatttgtacaattcaaattggatacaacttaaaactacagattatttagatttttttagaaagtcaactgtaagaatcttttagtttttatctatgttgattttaggtaatcaggaacaacctagtggctttttgagattagaagcagtcgtggaggaaggtaagttgcagtaggtccaggagtgagttttttggaggcaaaagtagagacagcagggataaaccacagccaggattattaaagcctggggagtaataaaaggaaataaaaaatactgatagaagaggattagggcaaaaaatggtttacactttttctttgtttatttgcctgtagttttacggtgagaggatttgagaatgtctgtatactctgagtgaaaactgtat

SEQ ID NO: 116390 - DNA, 1112 bp, Homo sapiens
agaggaggattatctgaaatcatggttataacaccagctgtggatggatgggtgtggcatgtgacacacttagtggattgagggaactgttaggtatttgaagtgtgtatgttttgttcattctcatgtcttagttcacctggtacggttgtctgtattcacctagcatttctcacagacacaattgtgcataggcaaacatgaatttgctttatgcttacattggttcctaatctaccagttatgctgggacaagtttatgtttttaaaacatgatttgctgtaaaatataactgactgtattcgaaaatagcttattaggtatccatggaaacagacaacttattagttgttcttgggattggcaaggaaacctttctgtgaactttgttgtcggtgttcttcgaaattataaggaagcatttctgagaatttctttggaaagcaaaagatcatttatgtgttatgtgtatctagattttagtattttaagcgctttggcttttaattggtacttttatagatttttacttcatttccatcaagaatgtatgaaataattttaatgttttttaaaattcaggatcaagaacaagtactcaatgacacagtggatggcaaggaaatctataataccatccgtcgtaaaacaaaggatgccttttataaaaacattgttaagaaaggttatcttctgaaaaagggtaagttcagacttttatcattaacccatttgatagagacgttgtaaatatggagctccgaacttattgtgatatatatttaataagttttgacatgagttattagtaattgacacttgtttagagcccatatataagcattcttcaaaatttagagtgtaggtatattaaaagtctacattttcaaccagaatgtttcttctacccatggtttctttttttctttctttctttcttttttttttttgaggaactccttatggcacatggcacattcataatattgatattttacagatttacctcaatttgacataacgacattttggggaattgtgggtgggggtgtgctttataaagtggaagaattttttccttaagactgttaaagaattattccaaaacaag

SEQ ID NO: 116391 - DNA, 1005 bp, Homo sapiens
aaattcaaccttggaaaaatgaggttaaaaatgattcactaatgatacttacaactgcaattagatgaatcttaaggaagtattaagatgaatattgcaatatctgtaagattgaagaaaagctttagcattattttgatatagtttatatgaacagatgcagttagattggaagtctgttggcacaatcaaaagaaaggtccacattacacttgatggtaaaagagaaagaattgccagagtaaaaagaaggatcagatccttgaagcacaagttgaagattgtgaatgattcctattctggttagtaacaagaaaggagtttctgtctggtagggggaaagcaataaatatacatttaccacttgctgtaaggttgtagcttgcttcttgtacagtttcttgttgaaggtgacttaaagaatttgaagacattagaaaaagtctttgtaatgaattatatttaatgataccaggtctgaaacctagtatgaaaaagttatgttcatgagaactaaactcaagtctctcatttagaaaacagatttttcttttaagactgggcgcagtggctcacgcctgtaatcccagcacttcgggagcccaaggtgggctgatcgcttaagctcaggggttggagaccagcctgggcctacatggcaaaccccgtctctttaaaaaattaaaaaattagccaggtgtggtgatgcacacctgtggtcctacctactcaggagagtgaggtatgaggattgtctgagcccaggctcacaactgccaggatgttgcagtgagctgactgtaccactacacccatggcagagtgaggcccggtctcaaacaaaactaaaccaaaaacaacaacaaaaatttttttttcaaagtatgctactttattattaactattttttttaaagtgccttcctgtgaaatagagaagcacttagtgagaaagactgaatgccaaggcaaatagcattaacaaagtacatttcaaggaaatga

SEQ ID NO: 116392 - DNA, 1017 bp, Homo sapiens
actccatgtctgaaaataaaagtcagtcaacacaaggaaagatattttaggaatctattctctaagccaagtcgagatataatgtctactttagattagctattaatccatgtgcagtgtccttcttatagcgtctattaagtaattgtgtgaagaaataatattttttaaaaaacactctttaaaaaatattttgcaacaaagggagaacccacctctataacaaaagtaaaaaattagctaggtgttctggcttatgcctgtagtcccagccactgggtagaatgaggcaggaagattgcattagcacaggagtttgagttacagtgagtaagatcgagacactgtaagccagcctaggcaacaaactgagacactgtctcttaaaaaatttttttgctttctttgaaccctaatatttctggagtatatggttgtattttatacaaatacagctaaatttctgcttatattctaacgaaggaacttaaaggtggttaagaagtgaaagtggctttgttggaaatataatttgccaaccctagatatgaggaagatgctcttaaaactagatcctagcgtgagactcacagaataaacctgaatgagcttacaactgaacgtcatatttcacatctttatcaaatatctcatttaatgctcatttcacatgtaatgcacataaaattttacggctatgtatccctaatttttagatgagaaaggtagtgctcaaaacattttggtaacttacatgatttttttaaatgttagaaattgagttagaaatttaaacttcagtatcctattttctaagtattttaccatggtccctctttctgaataaaatgtcacataccataatgacatttcagcatgttttgcaagcctaacatagaacattttttaatgtatttatacataatatttctgtatttccataaatggtatttccagtttttgttgatttattgggctgtgggggtctctggttattctcttctatttcaaaaagct

SEQ ID NO: 116393 - DNA, 1417 bp, Homo sapiens
ctccacaggctgaattagatattatttctctgtactcgaatagcattcaccactgttaacagcacttaccagtgctgaaacataattgatttcttgccttcttgactaaactgacctctatgcaactcaaagaacacatctcaatcatctctgtactctctacctatcagagtttagtgcaccgtagacactcagtaaataaacaactaaatattgaatttgtgatgttactgaaaactcctttaatgaaaagcatttaacaccatagggaagactgaacaccaggaaaatttacttgcatgactaattatcgtgttctctttttaaacaataattgcttgtttttcttcccaagtatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagaggtattaaattatttatcagtcttgtttttgttggaattaacagaaacatttaacatttaataaaagatccattaaggtaaacatagtaattcatagcttagtagcacaatgatgccagagattttaaaccttgttttatactgtaattttggtagaaataagtagactacgaattcattctattttaaataaatttattcaatgggacatcattttaaatataagaacttgtgaaagaacatatttcttgttagtctcatggagcatgcttataatgctacgtactttaaacaatcttttaaaatgtcattttagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaaggtatggtatggccatgttagtgtgatacaagaaactgggtttagattttatatcaaggatatatggactctatctctgaatatactaaattgttaaattatattgcaaaataagttattctgttttccctccttaaaaattgcagttggatgtcagttctgattatgttggttactatgggaagctgatatttctaatgtaggttttggcagataagtactagaagccacaagaaggtggtatctgtgtctacatcaatggcttgactgtttggcatatttatctgtattctcttgttttttattttcttttgagatggcatctcagtcgcccaggctgcagtgcagtggcgcagtctcggctcactgcaacctctacctctcaggttcaagcgattctcctgcctcagcctcc

SEQ ID NO: 116394 - DNA, 1485 bp, Homo sapiens
cactttagggtataaaaattctcttagttatgaccagaaatactcagccaatgactgaataatagagacttatgttttgaggggaattgtggtaatattttatgcatccttttgctttgatacagtttttttcaaatccaggttcccatcctgaaattgctgaccgagctttcatttattttcataccatttttcctctgtctagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataattgattacttctgtctaaaagagctaagcatttaatttatttattttcttcctccttcaggggcagtttaaaccttagcatcagagcaaggcccagggagaagctgaagctttagattagtatttttgctaatggcctcttttgaaaaggattttataaa

SEQ ID NO: 116395 - DNA, 1110 bp, Homo sapiens
ggaaaaaaaaatgctaagggcttaaaagatgtctgcttagtagttccaagctacaaaaggcagttatttctatgggggctgctaacctatgtggcttcaatcaccgtttaacactgataccaaaaatctcaacatgtcccatgctccttttccttgaaatcagctcaattcattccattctctcccttcttggctcttttatcaaattactctcctttccaccccttctgttttttagctggacttggaccaacatagtatcccaggtggtctccttccttggttacatgatagaagacagggaggatatggattagtcaagatatttttgctgtgcactttggctcccatttatcacacctcaatctttagccatactaacctgtcattcctcagtctgaaatccttctcccttttatttaaaatcacaaacctgacttaccctgcttcttatattttaacatcatttgtctctcaagttgaaatggaaacttgttacttacctttgtaggccctctagtaactagcttgtcagtgttgaaataaaatctctcacactttaacgtttttaatggggctgggtgggaaaattttcagtgataagtgtggaccttgctctgatgccaaagtttggcgatctgaaagggaaaatgagacaaattgtgaacatcttgtaattctgtctagagcctagcagcaatatatttaactaggactgcgatggaggatttataacttttggcttcttccactctgcttttgtaaaaatctcacatcacgaattttattcctttcactctggaatgagaaaaaaaaaaaacccacaaaactcaagcctacagtgtaaagaattattgttagagagatgaatatgcatatagtaagtattgccttaaaatagatgtaactataatggtacctacctttctggaaagtacagcctgggatgtactgagactgaggaggtgtgtgtatttgtgcaatttaattagattcaggacacttgaattactcggaattccttcaagccagttttcctgaaaaaaatctggcttggtaaacagacgtccacagtttggttccaattataatagttaacacttactgaat

SEQ ID NO: 116396 - DNA, 1048 bp, Homo sapiens
ttattctccaagagtacaggcattatagagttgtgggttttttcattttttgcatacttccttacgtacagtactgttgtccattattaaagggatttttctctcttctgtctttatttaatgaagaatccttcctgtgttcatagaaagcagaagcaatatgtatacatactacatttttgctttttttcttattctccaaggatttttcccttacccccttttaaaaaaaattttctatctgtcaagtcaaataagtgaataatcagaggcaaaaggtcacagccataacctttattcctcactggaggagtctggtgagaccatgccaacattactaacagtgaactattacaaaatttcctggtttatcttttgtaatccacatgggtaaaaggaggagaacattttcttaaagggaggtaagaggtaaacaatactggttatgcttcagtgttatccttaccacactttttttccttcttaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaatagcacctgttttgaatattcttattccatcgtgactaatatcaaattaaagctgcaactcatttgcctaattttttaagcaaaatatgataggcaaacctatgctttttttaaaaaaggcaccacaaaaaacaaaacttagtagccagctttaaaagtgttaaggaatgtgttttgccctctagaaacctttataaatggctttttgaatgccatcctgatatatttagctatttgtccattactattaaactgcagaaggtatttcaactgttacatggtactgaaagccagtcgtctgggtaatgaatattatttttctttagttacccgaaaacatttc

SEQ ID NO: 116397 - DNA, 1082 bp, Homo sapiens
tcgggagttcgagaccagcctggccaacatggcgaaaccccgtctctactaaaaatacaataatcagctggacgtggtggtgggtgcctgtaatcccagctacttgtaagactgaggcagggagaactgcttgaaccctggaggggtcacagtgagccaagatcacgccattgcactccagcctgggcaacagagcaagactctgtctcaaaaaaaaaaacaaaaaaaaaattatgaaacacaattcctgtacttaactcactgcaaactggaaactgttcatggaccagctctggtacttgctaccatgagtagtgctactttaggactaaatatttgttttccttgatcttcaaaattattttacctttagttttcatgacacaaaaactgttttgtcattgtcagtcaatacaagtgaaaccaaagttccctttgatcaaaacccaaatctgtcatgacctcagaagttacttagcagttgtttacctttgccagccttttctctgcacgtatatccatatatttatgaaataagcagcgtttttttcttctttgcatttttcatacatattgtacaatgggtgattatcaatgcttagcttttgctagtctgggtgaaaaagtatcacattggtattttaatttgcattttcttgattatgggacattgaactttccatacttaacagtcacttatatttcatctgtattgcttatttatcccctttgcccaattttctggcttttttgtttgtttgtttgtttttgagatggagtcttgctgtgtcacccaggcttgagtgcagtggcgtgatctcactgcaacctctgcctcccgggttcaagcagttctcctgcctcagccttccaagtagctgggacgacaggtgcatgccaacatgcccagctaatttttttttgtatttttagtagagacgggattttaccgtgttagccaaggatggtctcaagctcctgacgtcgtgatccgcccgcctcagcctcccaaagtgctgggattacaggcgtgagccactgcacctggccacatttttgtggtttgtagtgctttatagatt

SEQ ID NO: 116398 - DNA, 2868 bp, Homo sapiens
gaataatagctctttctcttaacagtggaaaaggggaaatcatgggttaggatactgttatgcctcaggatttggtgttgacaggaaatagcgcctttctttggtaagagatagttttctgagagtgatggagtttctgagaattatcaaagacattaagacagatggaaaatatttatgcagtcactgaaaaataggagagtcaattgtctgtggaaatactatggttgcttggcagtgtttaagagccttgctgaggtcaatgaacatgagtttatagtaacattaccagacttctgcttgtatggttttctctggcagccctcagaaatcttggtatagttgcaaagcgaaagtttgttggattcaaccactgttcagtttctggttttgccagaaatttgttggcagcatattggggcagggaattcaggagagaaatgaggaccagaggacactggtgagtgggagcaagtagagggataagtgagcaaaggttcagaggagggagaacagctgtgaagtaaatgagtaaatatattagaaagggaggcattgtggtcagagtagtgggtctgaatttgtcatatcacaggtgaggcatttttgcataattgactctgaatattttgtttcagagtgtagaaaagctttcttagtgctttaggtgttgcatatggatatctgaggacttaggatttatagtttattttatagggtatgaagaactgtcaggaaataggaggtcttccacatctcttgggcatactctaaaactttttctgtgggaattcgaagtctagtgtgttctaatcaaatcgagattcatttttatttacttcttcctgaaagcaaattttaaatagaaggaatttcatataaaaataaggtgtattcctacatgtggccttacatttgaatcacctgggttgcctgagagaagcatttacctgggaatatgtatttcttggccctactttagactcaatggaatctctaagagcttcccttccctccccttcctactcaggtggaaaaggaccaagagaagggattaatgtaaattgaggacagtgtcaattactgtgctaggaactttagatatgttatagcatatatttcttaataggagttgtgtaatttttaaactgttgttatactccatttaaaccctcagaaatggtaacatttgcaaactttctttgtagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaaggtattaattagttttttaacttaggtcaaattcagtcactgggtttatttattcatagaatcatttctgactgtaatctttaatattctttgtggctgggatggttggtgagaagaagaaatgaaattgccttttgaggaaatctttaaacatcatgaaaaatactgttaaactaagaggatacatttaggattaaagtagaagtaaaccaggtgatccttgaaagactgatatagctatcagtatatgacaaatttagaagttcctgtgaactggtgagcaacttgagtgcagcaaatgtctgccttgttttatctttattccccttctgtagagcatgtatgacacgcggaagttaaatattgttaactaactgaagcacaagctagcagccaattagacatttttagtttctatattaagtttctcaatttatgacctttgaggttctgcttgatttcattcctagaaatagctgaggaagaaagatgataaaacttcctaaagttaattaaaactattttacatgattataatcccttatccataatttcagaatccattgataaggtggcagcaaatagagcagattgtatttagtttttatttcacttaataggaatatttgtgttcccttgcagaaatcttaatattcctgattacagacatcacttgggtatttcacatttcataatatatacaccagataacttttctaagacatgaatacttattaataagaatttcgcaacacatctgcatctaggataagggattgtaggtttatattttatttatgatatgcctgttctctgcaaacgcagctcaccaactgtatataaatgtatacgtttaatcccaaagtgatttatatctccacttatttactaagcaaacatttattagataccttctatgtactactatgcactgtactacactttaggagtatgaataagataaatctctgtgttaggaaagatagtcatgtaaattactgatgtatatggagttaagatgtggacttccattaattttgtgggggttgggtggttattttttttgagacagcatctcactctcacccaggctggaatgcagtggcacagtcaaagctcattgcagcctcaacctcccagcctcaagcgatcctcctacttcagcttgctgagtagctggaaccacaggcacacaccgccacaccttggctaatctttttgttttttttgtagagttggggtttccctatgctgcctaggctcatctcagtcactcctagactcgagtagtctcctgcctaggcctcccaaagtgctggggtgacaggtgcacaccaccatacctggcctgcagacttcattctgtaagggaacaaaagtcctcttttccacaattcaaataaccaaaagtttgattaatcttgaagcattgtatatagtgcatctataaattcttcagtgaaggtccaaatgaatttatttcatcttagaagttta

SEQ ID NO: 116399 - DNA, 1726 bp, Homo sapiens
atacttacatggtacatatgtgggtactgctttatttttaactcttccatctacattatacaaagtactcttattcctcagttaatttgtttttccagatatttaggttgtactgcataacactgtcattgagtcagtgatgtttgaatgccatggcaatattggtttgacctaattttatagttgtcttacgtctcctaatgaagtgtgaacaggaagtgtcttttaaaaaacaattcttgcaatgtctagcagtcgcttttgaatattaggcaattatagaatatacttttagaaataaattatttagatacttctcaaagtatatgcatgttcttccaccccacccaccccctgcctcctgcctccttattttttcctctaggctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaaggtaaacttgatgtaaaataaactaatactacattctcctttcctattctttaacaaaagaatccaaaattttaaaactcataatcatcctcgttgttatagcatggatacaacctgtgggtctggcctggtcatctagggcagttgttttcaaacttcagtgggcatcatcagtcatctggagaaattgttaactgagattgttgggtgggacttacagagtttctgatttaagtgatctgcaatctcatttaagtgatcttcattacatccagggatgtaatgaagaccattgagagtttagaacggtgcttactataaaggcttaagataactcttctaactttgaattatattgtcatggatctgggcctgatttaaaccataaaaaattcttaaactagaagattgctaagtgacttatatttttagaggtttgtgaacttaagtcactatgtaggcatcaataatatacgtaaacaaacattgacaaaagcaacttttttaagttgttttgtttggctctaaaagagaagttggatagtctgagtcgaatcaaatcaggaattggttcattcatgttagatcagtggctcaatttgggtaccttctatgtgccaaactttgtgcttgaggatgtaaccagaaataggacaggaacagtctcaacttttgtgaaccttacaatctaaaggttttagacaatcatatatccagtgtgctcaatgatacagaggggaaaatatattttagagggagataacagattaaggggtaaggaaaacattctgagaacgtatcatttaaaataaaattcagagtaggaataggagagagaagaacattccaatcagagacttccctggtaaaaagctcaaattcaagaaaccattccgtgctgaagagcctgaacagagcctagcaatgcagggggaagagatcacagacagctgctgccagagtggaaggcagagtctagactgtggagacaatgttacagattttgaatacagcaaagagaagctagtgaaaggtttaaatttagagagtggcatgattagatttgcagctttaaaagatcatgttggcaaccttatggatcaggtatttatcgcgcatctgtatgtgtca

SEQ ID NO: 116400 - DNA, 1074 bp, Homo sapiens
ttggttaatctgtgaacgtttgtatttttcttcctgaatttatctaattcagaacatttttgatagtctgatttctaatacacacacacacacacacacacacacacacacacgtatttttaaatccagtgaccataggaaggattagccagagtaggctggggatagacaagcaaaggatgggaaagaatcttttggctatggcatttctgtagtaattcatcacaatttgttttgattaaagaagaattaatgagtattagtatttttctgggtaatctctacaaagaaacctttccataaataagttctgtttcacaaaatttaacatttaacatttgtgactagatcctgatgatatattttttttaacccttagggtacggcttgtatgtatttcaaacgtttttatcttaataactcagtaatggaatatcaccccaggataataatgtgagtatgtctgtctaatatattgttttcatttaagaagacctttataatcttttgagtattttttgggaggagagaattgtgagagagagagagagagaactgacttcctaatacagggtaatttagacttgaattctatttttttttttttattcagaacttgagatctctgtttacctgtacttcagtaattctgatggtatgtgaacttcagcttgtccagattcaaattttgtttttctcaaattagctacttctctaacatctcttcctattagacacctttgttcttccagttgttcagactgagaatcatttatagtggcccctcccacatccagtcagtttacggatcctatagcttcatactcatttcagttgaacaaaggtctgttgttgctgctctctgctgagcgctgtgtctatcattaaaaatgaaattagtatgaaactcatcaaagagtttgctctcaatgacattgtacctgttttctcttttttgattcccatttccaccagtcaagattaggcccttgatctcactgccaactgttttttacagtagctttcttactgttttctcatactgaacagcatgaagtggccaggtgaatttca

SEQ ID NO: 116401 - DNA, 1062 bp, Homo sapiens
ggctgccttaaaaaaatcaccacaaactgggtagcttaaaataacagaaatttattgaaacatttgctgtttttttacaacttgtgacgtaatgactgaccgagaaacggatgttggaagctttccaatcatattttaaaaagtctgtctactttttaatttataaataatgatatcacaactgtgagcatgtgcacacagcctgtcatgattgtttatactttaatgaagcaaaggtctagctgacattccgaaaagtcgtgaaatgatggtacagttttagtttattaaatattttcctacagctattttgtgtaatgattagcgaatctataaagaaaatgaggcgtgatatatacccttcgttggatatataaactaaatttaatctagatagagaaaaatgttttacaattgtttaattcattgaattcattgaacttgtgttgtaattgttgatctaaaggttcttccgaatgatccagtctttcttgagcctcatgaagaaatgacactctgcaaatactatgagaaaaggttattggaattctgttcggtgtttaagccagcaatgccaagatctgttgtggtaagttacagtggtgatgaaatataatgtcctttagttggcttgtgaaatttgacctcttctaaattccctgtccactcaagtcttaaaaattcaccttagttacaattaattagtttttggcacattatatatttttcaatacaggccttaaatcatgagttgctgtatcatatcttcaaaagtatttcaagtctcactttgtggtcagaaaaaaatttgaggtcaggtaatgtcataaagaaagaaaaaaaataaattactttcctctaagttctcaactaatgagccataggactgggactagaacatagactactgcttttccaactctgtgacacccaataaatgtttgaaataatgcattcattcatcattggtaatcatatgccccagctgaaactgataccataagatttttttaagccttgattagtagaagctggagttttatctttggtgaaaaagattgc

SEQ ID NO: 116402 - DNA, 1396 bp, Homo sapiens
tgttaatttcaaatataggaagatttttttttaataaaaagcttggtaattagttactcttcaaattgtatttgtgtctttgattttctaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacaataaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcagcagagtaagcaatttatttgt

SEQ ID NO: 116403 - DNA, 1025 bp, Homo sapiens
aaaattatagttttacctctgctctcttttattcttctttaatttgaattcgtggttaagttattagaggcagtttttaatttttgttaaaaatctaaaatgcatgtgatagattgtgaaaaaatggctgcccatcaaagagggtaggatgaaggaaaaataaagtgacaggttcttcttctgtcacagacaaattggtttgtggaaaggtctttgtaatcagaagcaaaaatatggtataatgtagtttcaacccagaaatgtgtttgagtccatcatgtgttctgataaagcattgaaaaaaataaaatatggtaaacagagtccatgtgtgctcataatctcctaagaagaacacagcatatacaggaaagctcagaatggcatcaggaatttaaggtggtttcttctgcctgttctttccctatatactttaagctcctcctcatgctccttcttgagatactctatcagatcaacttcttcagatatttatgatggtatggaataatctaattagaaagtactatttaatgactattatcctaaatcctcaactcataaactgaacaaataattttctagttcactaccttattctgttcctttcattcacgttacctgttatcctcaaaggctgtgaaatagctgtcttcaggctgctcccagttagttgtccttgttgcacaactggagggagcacagtattgtttataggtccccaggaaagggtcaaggctgtgggtaggcttgtgtcttacgtactgttactctcacatgatggctcctaaatctcattgttcattgtagtggaaacatgttgataaaatgttatgcctttatctttcttagccaacattgcttttccattgaaattttatgtccatgtcccctcatgacttaataaaaagaaatgagagagtatatatagtaaagcctttgtcccatccccatttcttacctccatttcataaacagttcgagcaaaattttacacttcaaattttcctatattgtagttttag

SEQ ID NO: 116404 - DNA, 1114 bp, Homo sapiens
ggtgtttgtgtgtattttgaaccctccagtttagctcttaagtgtggttgataatgaaagcagtttatggtaataaaatgggtgaagaatttgcgttttttctaaaataagaaaaatttttatcagccatctatctctgtaggatacaaacttggacaattaacaatgaagttatagcgcagacctgaaacctttgctgtattaggtatattgccttgtcaggagtaatgcaaattatatatatatatatatatatatatatatatatatatatatatatatatatatatatatatatatgatagggaaattatttcaagtgtgttcatactcattcaaaaagaaattaaaatgtggaatcacttaacgattgttaacaatggaagttaaaaattataaatgatcattacacgttaaaaggttcctcagttgcgggttgttgcagtaggttccgtctgccatatgccttctagtaatatggacctggctaatcactatcatttacttgtagataatgaggagacactttgtttcagttgccctagaaagtatcagacgactcttctgtactgaaaatccattagattcgttgactatataaagttagaatcattaaatacctgcttattaaatcaggaataaagtatgagattattaaagaatactagaatagaagtgaacaaatctgaattttagtcctatatttacattaacttattgccaagagcaagtcatttaacttttctgtatctaaatgttctcatttgaaaaattaagataatgatataatttctcacaggctcaaatcagtgttaaatcataatgataaatataaaatgatggtgacagtagtatcgtaagtagtagaatactgcaaataagctcctacctccattttagtaagaccccagcttctgtagtttattagcacgtgctgtttctgaatttttatatttatttcttacgtactttcagaactttacttcatatcaacttcttggcacctttatttatggttctgctctgggtaaaaccaatcaccaaagactacattatgaacccaccactgggcaaagaaagtatccctttgtaagtatgggcatttgagggctga

SEQ ID NO: 116405 - DNA, 1637 bp, Homo sapiens
ttcgccgtgttggccaggctggtctcatactcctgacttcaggtgatccgccggcttagacctcccaaagtgctgggattacagacgtgagccactgcgcccggcccacagttgttttttgtttgtttgtttgtttgtttaagttttttaaaatgtctgtaaagtagcaataataatgtggttagtgtgagaattaaaagttaattggtaatgcccggcatatggcaagtactaagtgatagctgttaattttccatgcttgacataaactttacgtaaaggttacttttctaggtttgtttgccaagcaccttagtttgttttgcgatttcaaggagaacaatttggtgtataatggaaatctgagttctatctttgggccatgcactgatttaaccttgattaaatcaatttgtgtgtgttggggtggttcagataagataatctcttcagcctattttaataggtgaacatgttgaaacttttgctgtttttgaatactcagttggaacttgttttctctaaagattttttcttattactaatgtgaagtggtgaccccagacacttagttttcataccacagatcaacaatagctactagtaaaattctcaaattttaacttgttgaattattacggaggattcctgtgttatgtgtttaattataaatgtaaactggtttaacagacatgcctaataaagacagttctctagaataacctctaccctggcttttcatgtcactgagaacatactgcataaaaatcttgaaataaccttctagtaaaatttgagtgagataaactagaaatacattccctagctacaacttagtatatgggtgctcttttccttaatttaaaagtgttttaaactccacttggaaataaatgttgtagtcaaattttattgcaatcaagtcctataaagatcattgtgtatagctcctataaatttattgtggtttttcctgaacttttccttctgcagcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacaggtaatagtttcatacaactttaaaaatcaattttgctttatctagtgttaatatttttgacttcagtatttaagttttatgtctgataaatatctaaaattaaatttaaagtgtatactctgtaatgttcaaaataattaacctttattattaagatcttcattttttgcttttgttttagctaagtttttaattaatgtttttttccaaaaatactgtctcgtttttttccttacagttaaataagtttctgtaatgctaaagtttactcttatagttgaagaattaatgcaaattttatgcacactcatggaatgtacaaatatcaaagggacgttttcaaagactgttcctgctaataaccaaattttattgcattatggcatactaattaacacatgaaagagctaagctagtcacttcaaaatttaagatgctctgttttctaacattttatttccatggaaagattctgtatttcacatttgtgat

SEQ ID NO: 116406 - DNA, 3294 bp, Homo sapiens
ttctgtctcggcttcccaaaacactaggattacaggcatgagtctttgtgccctgccagtattgcttattattgaatattcttttcctcactttcttcatggtttacacatatgtgggaatacatatacttgatatgcagttttattttaatgtgattgagcccttgatacatatgtaccagagaaattagaaaaatatactttttaatagctattcatattgtttatgtgagtaaattttatctttcattttactctataatgcctaataatgtgggagcaaaggtcccacacagcctttagcactgaactgactttgcttcgttttaagtaatccattcctgaaaggcatcaaacagtaacatctctgcaggaatcctgtagctcgctggctgtctccctatcccagagaggacagaaagttctgaagagcttacaggccaagctactttctgccagctttgattctccaaaaagagggtggggaagaaggcagtaaaattgtgtgtatgcttgagtatgtgattttttttttgttcaaacctgtagcatgtgataaagttacctaccacctttaaaggcatataggagaccagaattaaattccagatatccagtttaacaccagagagaaataagtttacatcctatcttttatctttagttataacataacctgtttttcctttcataccctatgattggaatatagcagaagtaacccctgtctggcttctctttgttttcttattgtatgtgcctacttagtagtcaaacacgtgtctgcattgattacacaggacaatagctttgcttgattccatagtcatacatacctcagttaattcagaaattctctgcagttgttactgatgaaatgttccttgttaaaatggtccccaaattagacacataaaactttaaaaatcagttcacttaaaaggaagcaaagtatttaacttccatggtcattttgttgtctttcccccctcactgatatgtgacatacataagacagcaaattatgctttctacagaatcttaaaagttctaaaagcacaggaatgactttttaaaatttgtgacactaaaaccttgaaccctgaaacctagaactgagtcttctcttgtcatcagctctgctttctgcttcacctgagttgttcatgcatctcagccatcacagctgctttcaatctcactcctaaacccaaactaattctcagctctactcttctttctttctcatttgtaattctaaccatcttctctgaccaagtctgtgtgttccacttccatttatgccaagttacatgttatggggaaggagaaaggtaaagaaacccttgcaatgaggatggagtatttctagtaaatgtctttcctgtatgatggcccatgaagtcttagagttgctgtaggcgtgtgtactggttttatggatatgaagtgtatcatttttgcttatgaaaaaatgaaaagtaaaaaggtaaaaatgttgcttgcaaagccagaggtcctttggtggaagtaaaactttaaaaaatgaaaatattttacaatgtatagtttttttttttcccaagaatctttcttagaaataagctgtagcacagagagtaatactgagtcaattatgtgaatttgagtgagaagaaagctattctacaaagagtgataaagcttctcagtagtcctattatatttggttaaaggcctggatcattagtcacatttccacagtgcttgtattttacaatgtggaggtttaaggtacaaaaccctattatgtatgttttcatggctgtgttaaaattttaattttctttcgttgccaggcatacaaattttatacaaagctaaaagctgtgactagtttaagttaaaataaattttaaggttttctggtttaataatcagttctatatgtagatttgtttattaaaagtctacaaatgttgtttttatttgctgtgggaaataaacaactacaacaaactagtacaacttagtcaccatttctaaattccttcaaaggctttaactatattcttttatttacaaaaatgttctgctttagattaataaggaaaagcaaaacattataccctgaagtaaactgcataagatttcagttctagtgagaaaaggaatgaaactcagagttattgaatctgagccaaggtacttgttttatcttgaaaagttgtatatgtcatgttatgtcaacgcttgtttgttgtatgaacatggagatttttttgtgacattaatgctgtcatattactcagatttcaagacaaaaatctagagttaaatagagatttggggtaataggacattatttctgtttattaatttataattgagtctgactttgctcttttagctgcaaagtgataattttttttctgaaactgaaattttgttctgaaaataaaaatttttctgaaaataaaagatagttttcttttgtattttaaataaaggttgtatattatgctttcagaaatttttggctattctcttcacagtctggttaggttgaggctggctgaaagctttttttgtggaatggcgttttaaacaggcacgatagttttttgcttatatctaagggaattttaggttctttttctctgtaattaaagtaatggaaactgcatatctaagaaagtatgaaaaatattttagtttaaaattatttttgttaaaaaattttttttaacattggaagataggatcagattatttttaagacttttacttaataggtcattaggattaatgtacttatttttagttttcagtgtatatctgtaataagttcttggtacagtttctaggtttctttgcaatgtagaatgtgaagtataatatattttgagtattttagttgccttttcttatggaaaaacagaggtggaagatttaattatttgaatagaaaaacattagggattttatttagtagcagtgatcagaaaaacaatagaatcttttttcacagaatagaaaaactcagtttatataaaaatcacttagttgagtggaaatgtgatctattttaaagagataatcataaatttgtgaaagttttttgagaaatctctatgtttattccttaggatactatttatcatacttgtgtattagcaacaaaatatttcttcttggaatatggtctatttcttctcaaaagagcattgagataatctcgctccatcgcccaggctggagtgaagtcatggtcttgactcgttgcagcctcagcctcctggattcaagtgattc

SEQ ID NO: 116407 - DNA, 1043 bp, Homo sapiens
caggaattttctctgagctttgaagtccagagtttttttgagtttcattatatagggacaattttaagtcattgatacgaaattgatttcaatgatccaacttaatttccaggcccctcccatcactggaggtcaagttcctgaaagtcctgaccctctaatcatgtgcttggtgtttctgataatcagctccatcctgcagctatctggggcccaccttgacctacctcattagcataacaaagatacttctacactcttgtttttataaggacttttaaaactctgtgccaagaactggggacaaagagcagatatattttttattataccacaagaagactgcttgtaaacaataggagataagagtttgccaagtaggggcataggtgttcacaaggagagaagaatatatgcaaaaagcaccaagggatgaaagaatttgtgaggaagaaaatgtcacttagtcaagccagaaagtgtcaccttcaaatgggaatggttgaaggtgaatctggagaagtaggcattggtcagatcatgaaaggctgtagaagcaagagataatgcatgacccccatacacatgtgggccttgaaatatgtgttttaatgggaattttcaagtatacaaggagtagatagaattatgaattcctgtgtactcatcacaattaatagctgatggccaaacttgtttcatctgtacttcccccagcgtacatttcagtatatatatcaaaaataatgagatttttaaaaattaccacaatctcattatcatacctaaaattttttaatgtaatcaaatattcagtgggtactcagattgccagttctacagttgttgcagtttttttgtttgtttgttttgttttgtttttgagatagggtcttactttgttgcccagagtggaatgcaggggcacaatgatggctcattacagccttgacttctcaggctcaagcagtcctcccacctcaccctctcccccgaccacaggtgcatgccaccagacctggctagttttttaattttttgta

SEQ ID NO: 116408 - DNA, 1061 bp, Homo sapiens
aattttgtagctcttgttaaataacacatattgctattagtattttttttagactgttcttttaaactttttttttaaaagaaactgtatagtagtctggtttaactctattaatattacccttataattgtttaaaattttatactgatacaattttttaaatgttttgtttcatttagatctgttcattgagctagggaggtgtggtgatatgttacaacttccaaaatctcagtgttataaaattaatggaagtttctcagtttcttcagacaggaagcagggtcaaaatggggaatcagaaagggattgggcagctctccaggtaggtccctcacaaaatgatgactcaagggctcagctatcctctgagctatccttcttcccttaggactcctctgttccccctgctaccttggagtcccctgctagattgctgtgccagttggtgagtgaagagagagtgagctgtggatctttcaggagattcttaagtgtcaaacttagaagtagatacatcatttttgcccacattacataggctggggccttgtgactagttctggccaaagtgcaggggaggctgggaaataatacttatggtataaaaaacaagattggtgagtacctagttactttctgccataggtgatattatctccatttttacaaatgacaaaacaagttttaaatgatttactcagtttcacacactgataaatgaaacagatccagacctcttatcctgaaagtctgattcacagtctagtatttatgtgatttatggctgctcatcagttccacatcttgtcctggaactgtcatacttgaatagagttttaaatttggttggggagacaaatacaacttttctacaatcactgtgacttttgttggcagtttacggagtaatttatttaaattattttccttttctattttgtttttcaagccatacttcgtcttttagaatatatcctataggttataagtagtatgcagttcacttgctatgttcttatggattctccatgacaacataatcagcttttattttaaa

SEQ ID NO: 116409 - DNA, 1429 bp, Homo sapiens
ttaagaagagggaaatggcatagtaaagagatagagtgaggttacatttttgtattgaacattattttagtcaaacattaacactgagaatgtactatgatgtttgcctttctttgggtcattctgtttaatttcttctttgcttttatgtttgatcagtctctgagttcttcaacaatgtctctaaaatgtatttctcttctgggtactgaagataccactgtaatttaaagtttcataatttcttgtctggattattacagaaagctagttggtatttcctaattctagtcaatccagctcactgatttttgcttgtttgtttttgccttaacataaatttacatctttaaaggtatatctgtcaacagtatctcatcatgtttggtgatttggaggaaggggagagttgggcaagatgccctcttccccagtttatatactgcctcatatgtatcttccaggtcagtctttctgaaataccatttaacagttataactagtagttgtgactgagacataatttttgctgttaaggagcagaaatcatatacttttaataaattattatatatgtttgtgagagattttactgaattatgaccttgaagattccgtgtaatgctgttagttctttcaaagctaggttgatgttgccattgtttacaaaacttcccatgactacaaaatgatctcttgcttttaagtctgtaatctcaggtagaccaaccttctggcatacttactaatgtatttcttggtcttgttctgcctgaaagagttctttgtaatggcattcattgaatggagattgtagaacttctatcagaaactcacagaaaataggatagtaaattcaaatgataggaaatgtgaaagaaaagggtaaaaaatgcaacctttgatgttaggtcagtagaaaaatgaactgaactttaacctagttgatagagtttaagacattaaaatatccacaaataaaaccatagttgagtcaggtttggtagacattttaaaaacagttgggtaacatgatacctctagttttgttctttttatcccgtttgcaaatgacatgattccatatctagaaaaccccacagtctgtgcccaaaagctccttaatctgacacacaacttgagcaaagtttcagaacaaaaaatcaatgtataaaaatcagtagcattcctatacatcaactccaagttgagagccaggtcacgaatgcaatctgactcacaatagccacaaaaagaataaaattcctaggattacagctaactaaggaggtgaaagacctgtataaccggaattacaaaatactgctcaaagaaatcagagataacataaacaaatggaaaagaattccatgctcttggataggaagaattaatattgtccaaatggccatactgcccaaagcaatgt

SEQ ID NO: 116410 - DNA, 1068 bp, Homo sapiens
atttacccaaaattatttggggtttgagagtattctaccctctagtgtggtattttgtatatttcatcagactttcatcactccttgaatgaaatatgctttaatgatatttgctgctttctgccctaaatcactactcaccaagcatcctgtttctaatttggcttccagtatatcattaagacagtaatcgaatggaacacttagtaaacctaaatatctgatccacttcatagtttgtttcactgtatgttaagtgacaaaactcttacaaacttattacaaccagtctccaatacataaagattgatcatcctttatgtattagcaaaagcctatttgccgtgtgttcggaaaagccgaggatgcacccaaggtgctttccttgggaggcctatctgaagcttgtcagccttcttcgtgagtttctttcagtctacaccttttcccgtcagtggttctagtattctaccaatcatccaaactaaaacatcttgaaataacctttgaaacattcctcagttttattctacagttgttatactttatgttcagtcacattcagagtttgattttcttctgaagtagatttttgttctttccttttgtttcaacgacatttatcttattcttagtttttatctttaattgattaatatatcgctatatctaattttcattatgtgttacttgaattatttcagctccctgcccctgcctgtttagaagtcctaggtgatctttctattaaacatttcagctaaataccttctcttggttttaaagactcaaggagctaaaattcagtcttcatcctattttccacagttcctttttatttagtaagtttgctttggttgaggtaggcgttttgctgttgcaaataccttctgtgttcacacttgtcatttagcctgaaattcccttctctttacttttctgtgattttagtttctgtctttaggtttcatctactctatgaaactttatccaatttaaaaaaattctacaacccatattcatagtaccgtgcaattttgtgctcaaatattattttaatatgtatat

SEQ ID NO: 116411 - DNA, 1319 bp, Homo sapiens
ttctgcccattgttagttatatggatttggaaaagtcactcaattttgataagagttccaaattcctcctgggtaagagaagtgggacttgatgggtattaaagcaccttcttaaatttatgattccatgactactcaacatttttgaggatagttacatgtttcagattaaataaaagttagtctgatttccactgttttgtttccatgccattttggcttaagtttgatttcttttatcattctctttttcatttttttcataagtcacatagatagtacttggaatctttgtatatttggccaagtctttcactactgtcttaaatactgctccagaatggaacacaactcttggaatgttttgatttaattcttgttttaatcaatgataaactaattctgtgctctcattctctcatacattatgtataccgatactcaatagatacctgtgcctataacaaggtttttgtattatgaatgaaggagaataggattatgatccagactgaaaatactgaactcacgcttaatttttatgctttcaagttgttgtgaagacaagtctataggaaatttactaatggaataaagccatttgctctattgcactttcctttttgaaaattacagaccaactttgatcaaatataaatctttctaccattcaagctaatttgtggaagataggtagattagagctagctcctggaattgcagatatcacggcttgcatctgtgtatcatcctgtagtaacttactgctgtaattgaacaatggtttgtgggcaggtgtgggagagtaggccatggggaggttataaacctttgccataatcaattggatttgatgaaaagttttctttttgaggggagtggaggggagtgttgggaagagtgtgtaaatgctataagagaaacacatataataggctcaaagagtacagtggaaagaaattatttctaactgagagcaggttgggtcatgtagtaggtcacaggttcccaacccctgggactgtggacttgtactggtccatggcctgttaggaactgggctgcacatcaggaggtgagtggtgggcaagtgagtattaatgcctgaggtccacctcctgtcagatcagtggtggcattatattctcataggagcgcaaaccctgttgtgaactgtgcatgtgagggacctgagttaggtgacccttaaatgacaatctaatgcctgatgatctgaggtggaacaatttcatcccgaaaccatccttcctccacactgcctccacaatgtgtgaaaaaatcgtcttccatgaaaccag

SEQ ID NO: 116412 - DNA, 1062 bp, Homo sapiens
agggtaacaagagggcgtcagttaagctgagacaaaatgacggccaaaggtggtctttactctctctaaatcacctgggtctggagtcgactcccatcgcgcaccctcactcccacccctggccccctcccgccccccacccgcccccctccctctcccctcccgctccccacaccaacgtgtgcctccgtcacctctcagacagtggatgcgttcctgttgaaaccacccaatctacctcagggtcctcgcaagcgcagccaccacgatccgcccgcccacgtacctgtgctgcgcctgcgcctcctccgctctctcaaggtcagcaccgcccccagcccacaacctggcacccacggaagttgctttagaggacgtcctgcgtatcttcacctctgcgtggcgtggggtcgacggcgctctggagaagggaggaacttcctgtcccgcgcgcgcacaacttccggcagagccggaagaccctctctttcgctgtttgagagtctctcggctcaaggaccgggaggtaagaggtttgggactgccccggcaactccagggtgtctggtccacgacctatcctaggcgccatggtgagttcttctgtgagggcaggagtgacaacggtggggcgaaaagggcggggaggtcagtactgtgaaaagagccatcaggtgctctgctcagaatggagttgagacgttgggatgagctgctgggtaggacccaccacctatctcagggtgtctgagcccctgaggaagcagcattacgcctacctgtctgggagactagcgggccggaggcaggggcgtatctgtcagggagtatggactgggtagcctgcctgttcatggcccatttactgtgtatggcctgtggcgccaggtgatcccagagttgaccttgccgggtcagtcacctcttctgcgcccccttctccatccgcggaacagtggccaagaacttcagatcttagaaatgcttttagcctctccaggtggacacaacgggtctccttgtataagatcaacacctgtcatttaaagaaacggtagtccc

SEQ ID NO: 116413 - DNA, 1046 bp, Homo sapiens
accatcccagtttaggggaaagaatcaaacttggaaaccctgctgccgatgtagcagcaccgacttttgtctcgcccactttgaagaggtcagttgaccctatacagcttctttgatatgtgacagaaaggaggtcatttgctgaaatgaaagacacattacaaaccagattttaagtgtgactctttccttcagctgggtcacagttcttactttgagccagagcaacacactttactggtcagataaaaatactctgccatattttagaataatgacctttcttatgctttggtgtctccaaatggttaaatggagaatatatccaattgacaggaggaattctgttcatcatttttactcttgtgtttatatcttctcataaaaaaaaaacatgtgaaaatggcatcatgtatctctattgtatttttcattcaaaaatctcaaacaggtgagtgtaatccagtctttaggttataggaccaaagactctcaaagactgttacaaacccccggacagtgtccctaagggctggactttgcatgtggattaccgagttaactgagagatgtgtaatatcatctgtagtcagaaaactccctactccctatatggagcaaccaaggacattcacatgtgttgcttactcttgaaagtatatgggataaatgggctcctgatatgctagtttcagaataactatggcaggaccttaaaatttcccactttccataagatcatagctcatattcaattactggcaggataaacatgtaagattattaactctgccttactagttcttttagaggagcatagccccttgatgaaggcattgttctaagccaaatctggacctatccaatctttattcatgcattttatccgctttcttagatcattctttcagaaatgaaatgagtgaggtacatgaaatatattttctgatgcactctttttaaaataaaatactttttatggttgtgcatttatttgtgaagtgaatgtttagaaaactttaaaaccaattctaccattctgtcct

SEQ ID NO: 116414 - DNA, 1033 bp, Homo sapiens
ggtgcaaattcattatctctggcaacgcagaacgtagtgtggggactgaaaaagaccgtggcaatggatgaacaatagggcttcagttcatcagtaacaaaagcagtggggaaattggttgagtttcagagcacgtcctcctcggcagagggggctggactagaccttggacagcccccccaaaaacttgccaagcctcgcacacaccacttcactctccactccgaggctcagggagcaagtgcctggcatggggggtaaaagttggctttttttttactccttggtcttttgcgcccttctccctctccccagaagggaagacccatttaaactattttagacgcaatcaaccaagaatcaccatgtggaattgagcggcagttttaaatgtgttgagcaggggagaggaatgatgagaaaaacatttttttttttttttttggagacgccgaaagaagcctgtttgtgtgctgcggccgtgctgtgactttggatcttgtctttcagccggcgcctcggttcctgcccagctggatttggggggcagcattgcctggcgcagggagatcaagtgagtatcgtggcggccctcaggctgcagctcgcccgcggcgcgaggccagcagtgcccgccgcggccccgcgcccgcactcctcacctcgcccgctagccggtgcccgcagagtcccgctgcgggccgctccgagggccagtccggggctttgcttcagctaattgattgtgtgcctcggatgttaaacctgttgatctcgtgagttttcttagccagtactgttaattatccagcggcttgacccccaatcgcagagagatgccaggaaatcttcgcgttggaaaagggaatttttgtatgtaattttgtggtggtggtggtggtggtgtgtttgggggggcttttcccttttaaacctagagcaaaatgcacttgtattttgcacttctgtattcgaattcgcattttgaagaattcgcctccctttaaccgccccaaagttgcaattacctggc

SEQ ID NO: 116415 - DNA, 1051 bp, Homo sapiens
acaacattatctgactatttggtaatgaaccctcagtacagggctttcttcagatttctgaatatttcaaaaggcagaatcttttgtttctctggaaatataccacacttgtaaagcaatttatatctctggaaaagattcctgcagggatgcaagcactcagcacccatgatttcaggtaagccaaaacaggtgtttagatcctgaaattttcccatagtgcctcaaagatccattaaagtgtagatctaatgctgtatttctaatttctggaacacaacctcgcttgtttctatattccaattatcagaagacatttgggtagtagttaattggtaaaaatctgtcagtgtggaaagtgaagcagtaaggagctcagttttcatcaattctgaatggtgcaatgtctcacacataatatttaagtcaaaagcttaacctcccttgtatatttaatgcaagataaattaccaacacagcattttcaagtatttaggtaactctatatttggactgaatttgactagcagcaacatatttcttctagcaacattaatttaaaaattagctttgtacatgaggctgtttctactcaagtcactaataataattaacacacagtatttcacagtatttgattttatattattagacagtttattataggaattgcatttatgagagattcaaaaattgtaaatgactcaactctaaaaaaatactcttctgtaacagataataaaatcactcttaagaaaagttaataacatctttcttattcataagactttggacgttttctttatcatcttggagaaaaacacaaagaaaagaaaaagcatagctttctggaaaaaaagtgatgcttccttggctctttaaacatagagctaagtacatgagttattgaggtgaaataagttgctttcaacagttgttaatatatcattaataatcatacatgcaataaataacaacatatgagttatttcctaagagatatatgactgcaaattgcagtaacacatcacagcatgtgtaaagaatgctc

SEQ ID NO: 116416 - DNA, 1179 bp, Homo sapiens
atattaaacaccatctttttcccaaaagcttcccataacgctctatgaatcatgagacttccattgaaggcctatagcatttagagaaacaaattgttttgatactttcatacacttaatatggaatcttttggctggaaactaagttttgttgagataaaaaccactttatttgtatgttaaactgctaaagattagaccttgctgtcttttttgtggactttagtgttcttctctctttgtgactttttcatgcttttcagtatctaagagcaatgaaattttaaaaatattgggtatatagaataataaacatggtgaatgtgaagttaaaggtaaataagatgtactacaagatagacataaagctgtggtaatgatacagaaagagtcacttccccctgccccctcaacagcatatataaaataaaacacagcacatcttttggaaaaaatgaaaggaacgttttgaaaagccagaatggataatcttttaaataatgatgatgttttttaacatttatttagcagctactatattggatattagcattaattatgtcacttaatttccataataacttgtaaagtagatatagtattatacctatacatgtgtataatagatgcatatatagagatgaggaagctaaagctttgagagattattaatctgcccaggttatcacaaagctaatactgtacatggtagagccagaactcaaaatcaaatctccaaaatggcaaagaatgtgcttttaaacgtaatattgtattgcctttcgggctatgaagtaaaatattaactagacttctatgtttatggagttttaaaaattacatgctattataggaagcagtgtattagcaacatactcagttggaacttccaattctaagatttgcttttccccttcaaagccagatggtctctaaggtacttaatctacttagttctgtaaaattcttattgttagcaacttgtaataagatttgctctatgaaatggttgatgtatgaaaaattttgttaaagaaggcagtataaaaggaaacaaagtgtcatattttcttgattcaataaatgttttaccaaagcttattttaagctaggcattgtggtagatttattagatataggaacttgatataagatattgttaatagagaaggttataaa

SEQ ID NO: 116417 - DNA, 1578 bp, Homo sapiens
ctatttactactttgtaaattttggaaaaccaagaggttcttctaatcacaaaggtattagtggaattttcaaatgctgtctgagattgtgcctgtgtctgcgatggcagtactttttgtctcttgcagtttttcttgttttgaagttggattaaatttgaggaagaatcagtgttagtatgacgtttagtcagcaagcagcttttatttagttagctccaattattttgttggtatgtctctccacaggtagatgacacactccttgtgtgcttgatgtcagtggagcctagtacaattcttgataatagtagatcttaaataaatatggtataaatgtagtcctttttattttgcctctgtgtgatatagttttgcttacttttataataagacaagttgctcatgataaaaaaggttaacatttaaaatatggatttgatttttctaatttcaggtttatctcggggtttggggatctcatttgacattttattgtcagactaaaagttgacagtcacagctttaattctcatctaatatttagttgatttcacaaatgaatgcctttgtgattatgcaggtttattaaaatatatatgtttttaaactgtagtgacagactggatattggaaagagatccccatgaagaaatactcaaggcatttaaactatttgatgatgatgattcaggtaaaataagcttgaggaatttgcgacgtgttgctagagaattgggtgaaaacatgagtgatgaagaacttcgagctatgatagaagaatttgacaaagatggtgatggagaaagtaagttttaagtgaaacgtattttccaggttttcctgatgctacacatgtaatacatttttctaaaaccaaatgacttgcaagacttttttgtaaacttaactgcttcttgtaatggaccttctgtctaaataattcacatattcaatttagaatgaagcagatctctaaaaccaattatacttcaagaaggtccttcacttttctctgaaggtgaaaccaccaaaatttcagcctttcaatataatttcagtctttaatggcttctccctcaacctacatgctaagttctaagttctattgattttccccttcaaatgttttgaatctgtttttatctttgtccattgtggctgtcctagttcaggccctaatttctagttaggaatgttataatggcctcatttattcttgccttggctgcctactgggtgcagtgtcctgcgtgttgactggtgctacacaatgaaaaaggcagatgtggttcttgctttcactttgcagtctcttgtagtgtcctaattgccctttcggcatataaaagtctctaatctcttcttcagtctcttggtatcattcttttcctaaaatatacatttgataatgccatttctgtgtttagacacttgaaacgattcttcagtgcctacagagtaaagttcaaagccttctatgatctatcccaccttgagtaactgattttactttccagtgtattctttcacttttcttctttaaccctcacctcctgtatgtacacattttgtcaa

SEQ ID NO: 116418 - DNA, 1698 bp, Homo sapiens
acaataaataaattagaaaaaaaacagtattctcagtactataggacctgattaagtttgtgggactgaaaatgatttatgcttttcaaatatggaatctagctgtaaatgttgctgttatcttttggttggggtaggggaggcagctgcagttactatggtggtagtggaatgagtttggagtccaacatgtctaactggtatgtttggatagaaatttccgaaagacattgagaaatacagttaaagctgtatttctagcattacctataataatttttaatttacttttgatgtgatgtttttggatttgccgtattcttaagtgatttttacacattaaaggtctaagaaagtattttgatgaagtacatttctgatagtatgtgtaattaaatcatttgaaaatacagttgcatggacagaaatttggagttttgtgaaataaatgaaacccaccttaactgcctctatatcagtttactaatattttcattgaaaataaatatattccttataattaaattctactttgtggaacaagaatagaacctgaaggcatggaggagagtcattataaagttatatattaggtaatgtttttgctgtccaaaatgatgagcatttataattcccaagaaaagctgcattttaaggaagaatattgataaaagaatatatagacacatagctctgaaataactaacacaattaaagtaccagtgggataagaatttatacatcttggagccccatctgttccccaatcaccctgttgcttctttaagtacattaatactttcagcaagctgcttttttggttcacctgtcatgtaaattatttaattggtgaagaaaatttcttaacactttttttccttgtcctgcttttttgttgggactaaattcaaaataagttgagtatgtgccatagagttaagtgtggtattttattttggtgttatggctgtagatatgccagcttctttttgactgaatatttatgagctttgatgatttgcatacttacagtaatatacttcaattagttacttggaagcctttttggataaaattaatggataaaaggaaactattgaaaatatgtgtagatgatataatagtcatttgaataggtgattattgaaccaaatacgggtgaaacagcagcaaaacaacagcttgttggagacttcgattgtatttttttcattctgggttccttaaacattccagtattttccatctataagcagttgcttttttttttttttttaatgattctgtaaccttcaacaggaccgagttatttttaatagcatagtaaaggccataaataccttttcttgtagtggcagatagtgtatataattacttcagagatacttatttagatactgttagaattttatttagtaacttaccaatttttatgccatagatttttattttaatttttattgtggctattgattaaagactggtaaaattgaaaatacttaagcttattactatgttattacatgtgattatatttagtgtattaaaatacacaattaccattgaggtttgaaactacatttatttttagttagttgtctgagagtgatttatccaaacaaaatgggtaagctttaaggagaccttctttgcagaggttttttttgggtgggctttcctgctatagtcagatttgat

SEQ ID NO: 116419 - DNA, 1052 bp, Homo sapiens
ctattatagactcttcctagtactggaaaaaagctttaaaatatatttaatttaagtttagagtcaagacagcctgaggctagtgagtaacatagatattttaggaattagtgtctttaagactaacataagtcaaacgtttgtacactatttttgacatgtactacttattattgctgattgagattgtaatactgtattattgtcttcattttgcttatttaacactgaattttttggtattaggtactgtactggggttgggaagaagacttaattaaaagttactaaaaggttcttctttcagggagtttacaatgtaaatataggtgacaacaggctatagtactatgtggtaaattgtaattttgtctaggacagaagtcagcaactatagcctttggaccaaattcagctgctgcttgtacaccaccacaccccttcttttatgcagcttttgtgctactatggcagagtgagtagttagagactttatggccctctacaaagcctaaaatatttactattggccttttacaggaaagatttgttaatccctgatctagaggaattgaagtctttgcagaggagattttaaatttaggcctttggaaatgtgagtaagatttcattccaagattgccaggaagagtagagaaaaagcattctaggcttagaaagcagcaacaacaaagaatggtactagacggatagcatgtttgggaaactaggtagtgttctgggctagacatagggaaatgactggaaacataggattgggccagattggtaaagtcttgcaaaacatgaagattttgaattctagtcagcagagatcattcacaatttttaagggaaggggatatgatatgtttgagaaagaaaactgatgagagtattattgatgatgagttggaaggaagagagactgcagacagaaaatactatttttttcgctgaggatggcgagggtgaaaagaaaatacatttaagaataaaaaagaggctgggcttggtggctcatgcctgtaatcccagcactttgggaggtc

SEQ ID NO: 116420 - DNA, 1708 bp, Homo sapiens
gtttcaaaactcgttattccagtgttgcggctccatttgaaaatttggagcacatttagatgggcagctcttaaggaaaacatttctggctttaaaataatttttgctttttttctttaagcgtttccagagtttatgagaagttaacctccggtttacatgttaaatgagacaagactcatcacatttttatatagaatgaagcacaaacattgtatattggcatctaatatttgtcatatgtttagactcattaatattttcgatggtttgttaatatcaatggaggaaatgacacataaattgccaaactgttaaaaacgtgtaatctaaaaacattttgaaccaacagtgctaaaatactgtataagttaattcactttttttttgtaattttatgaacataattatcagaactatcaacagtaaaccgatatatagtgattgtcagttatgaattttggtttcatttggagattttttttaaattctttaacattcttgtaggataacgtgtttttgtttttttggttggagttggttggagtttcagacataaaagtagtgttgcttattcacagttcttgtttcttccacagtaacattagtgggaataaataaaaagctgggaaaaagaaaagtttggtcctcatttcttttaataatctgtaacactctttagttttgcgaagttcagatttatagcaatttagactatggaataaacaggtcattgactcataaagggaaagtttccctatctttctccaaagtactttcttttttgaaatttagaaggtaattattggctaatttctgttagtaaagagaattaaagtggactaagggctttttctttccatttcatagaagtgagcttgtagtggacaaaacaaagaggaaaaaaagaagagaactgtctgaggaacagaaacaagaaattaaagatgcttttgaactatttgatacagacaaagatgaagcaatagattatcatgaattaaaggtaatggtatactttaaaatatttgtttctgtgttaaaatgatttgcatttttacagttgctttacattacatttctaaataattattttaactaaattggttttggaactatgaaggcattttaagcattcatagttagatgctgtaataaaactgaagagaactcctaacatagtttttagaaaatctttttcacatgagaaaacgaatagtattttaaatgtaaaaatacattcccagggaaggtgcttatttttcactgtcataattaaaggatttcaaactggaatttattcttaccatcttcttttcactgttttttgtttttgtttttgtttcttggtgactcatactgttttcagactgtgggagtgttgtcttttaatcttataatttggatttgttagtaacatagtctcaatccactttctctggtgcaaacaactttagtgctgtttgatgttgacacatgctaataggtaaaaatgtcagctttaagacctagaatgtcaaagtgtagggagagatttgtaaattattatttgtcagggtataaggagagatttgggtttagggtagaatgggacttactttcagcacagtgggaaagatagtattttgagatttttaatggccttaatggataggtgaatgtaagtgtttatttggtagttttaatttttgtaatttcgtaagggatt

SEQ ID NO: 116421 - DNA, 1070 bp, Homo sapiens
aaatcatcattaagaaatacagtatttatgaaataaagtgtcatccttcccaatttctttggaagcatataatgctctagtatgctttacatgctaagtcaagtatacaacatgtttatctgtaaactctgtttccatttgtaggggatgtgatcaaccttggtgacagacagctcactgttatgcacatgccaggtcactccaggggcagtatttgcttacatgacaaagaccgaaagattctcttcagtggagacgtcgtgtatgatggatcactgattgactggctcccatacagcaggataagtgactatgttggaacttgtgaacgtctaatagaattagtggacagaggtctggtagagaaggtgcttcctgggcacttcaatacctttggtgctgaaaggctttttcgattggcttctaactatatttcaaaagctgggatatgtcacaaagtttctacttttgccatgcgatctcttgcaagtttagctctacgtgtaacaaattctaggacctcgccctagtatctatactgataatatattttgattaattatatacattaattcattctgtgctatttaactgattaatagtgagcatttcatgaagtgcttttataccactattatatatcagagaaagattgagaatgaataagccaaaaagaaaattgttagtttaaattgttttctttcttccaagaaagaagccacttaaataagcttatactttgccaaagctgtcatcttgtaatatatgctctagaaatgacataaaggtttatggggaagcaaagagagattttgtggcaagagaactgcccttgcctctgtttttcttgttttattcccttgatgacctagggaaaaaaaggcatgtagagtattatgtttatactttaaacttgatatttttagtgtattatttaaagataaaggttcttgggtttaaaatacattagaacttaatgcagacatataaagtaacattgagaatgacaactaaaacattccattgttatggtcctgaattttttatgcttcatttcatgtatttattct

SEQ ID NO: 116422 - DNA, 1049 bp, Homo sapiens
gaaagaacccatgcagggctgagtatcatgtgtgaggtcacataccccatctcggaaagagctgggactagaacccaggtttccagttgatggtagaatcccaacatttttggagctgaaaggggcctgcaaactacttgtgtggtgctttaagcctttaaaagggtgaaaagaaagcttaatgtttaccaaacactttgaaggtgatagtactgtgttatccgtgttatcaaaagttgtttttcattaggagctggatgccccaccctctcaggtagtgtctaatttcctctcttctcaagaatattaatttcccgtatcttctgaatgatgtggcctgctaacttgctgttaacataatccaggtgcctgggaggatacataaaatatttgtattaaaaatttgtatacagttacacacatgaacagcataaagtcttcattgctttggtagaatgcaaggagctgaaatcatttattacatttcctttaatgaattgatgatcacttgtcatggagaagcataaatctgtgcactgtatctctaacccaaaagccgacttgtaaatgagggacaaggagagaatagccatatcttccagtgcattattctggataaaaaagcaactcgccctactaatagtgaaatggttatcttcctctaagatagcagcagaccttaaattgacatagtacatacctctcgagtgggcatacatcattttgcccatttttcactatagtcaagtgatacaaagttctggcattgtgatccctattacatacatgtttaaaccatatgcccagtgtcaccaagatattatctcagaggagtggtttcaggtggacttaagtcatttgcagaggctaaaacaggttgtaggaaggtggtggattgaacagacacatctaatttggctctcttccgaagcactgttgaactgtgaaaaaatcgtgatttcaatttaaatccccattggcggggggaactgttttggatgctagaaagtagatgtggtgactaagttaacagttttatactatgccag

SEQ ID NO: 116423 - DNA, 1054 bp, Homo sapiens
ggaggcgtagagcgaggcgggggcgtgggatgcgggggtcggaataggaggaggaaggacgcagaccgacgctgcccgtagcgtgcgctcccgcacccttccgccaggtcggcagcaagcagaggctgcgccaccagcacgggggcgcaggagctaccgcagcctcggcagccgcaccacgagagagctttaacgcaggggccactgcagcagaatggagactcaggtggcgaccgtttcgccaccccgggcgtgtgacagcagaggcccgcagtgagggtgggaagagctagaaccgcccacccactggctctgcagggcgcgcactcccagctggcgcagaaagtgtggggcctcgcgggttgtacggcgactacggcgcctgccaagggcaaaaaaacctctttgccgagggggtggggccttcctagggagtgggcggggctagttggtagggctcactccgcggtcctggtgccgcgtgcaggtcggtgcgcgcttctcccgaggtggaacgggcggcagtcaagcgccggcgttctctgccgtcaccctttccttgccggccggcacttcggctgcagagttttgcccacgcttcgagacttagggagcaggtaaccgaggaagcaatcgaagacttgggaggggtggtgagggtagaggggaattaaaggggcacgtggaaaaggtgaggggaagtcaggggtagagattcattaaagcgcctctggtttgaggggcgtttggagatagcttggtacctcccctccttgtcctgctcccttcagaattttttaagtccaatttccagatcttacctagtctctactcctaggactgtttgcagtgagttagaagggtatttatgctcttactgatagtaggttattttcaaaatccatggctttatgattttttaggcactagtcattgccgcagattgcagctgaggaccgactattcagtatctgttttcgtaactgttggcactttatatcgtagggaagggagttgttaatatggtttgtcttttcttataaaaaataaaatt

SEQ ID NO: 116424 - DNA, 1130 bp, Homo sapiens
taataccgtgacttgactttcactgcctcctctagcttctatgtctgcttctatctgtttgtgcatttattcatggagctgacgttgttactggtggagggtgtccaggttcttggcgtcttgaacaaagaattggacgaaacgcgcaaagcaaagaaagaatgaagcaacaaaagcagatacttactgaaaatgaaagtacactccagtgaggcagtgggtggagcatatgggctcaagggtccccttacagaatttgtgggggtttaaataccctctaggggtttccatttagttacttggtgtacaccctatgtaaatgaagaggatgaagtaaagttacaaagtcatttacttggcatatgccctatggagaggatatttcctgtcatagccgtaatgtgaattggccttttgttccctgcctccagaccctattttcctgcctcagtgtggacaaggaactgtgtaagacgtggaggacaagacatttcagttacctcataactcataaaatgttagaactaggaggaatttcagagattagctcagcatctgctaggacgttgttttggtagttgattaaaattgacttttttatttcagctcttggatgcttaaactacacccattttcaaacctctcagaacaattctgaatagaaattttcaggagacatcctgaaatggaaggggcaatgctactgattttacatttttaattgagtctgttttgcagttattaattcacttcattgaataaagacctccctgggattaaaaaagtcttctaaccagcctagacctatgcttcctgaagtgtaatgcaaatggaagaacagtggaaaggtaaagcagtcctgcttttgttaggaattagctttgcgtctttaggtaatcaagtaaccgcttagggtgttgctttcctcttctgtaaaatgggaggtttaatctgcgtggttctttttttttttttttttgagagggagcctcactctgtcgcctaggctggagtgcagcggcgcaagcaacctccacctcccgggttcaagtgattctcctgcctcagcctcccgagtagctgggactacaggcgcgtgccaccatgtccagctaagcctgtagtcccag

SEQ ID NO: 116425 - DNA, 1013 bp, Homo sapiens
tattttacacacctgctaagattcctctggttaaaatgaagtacacttaccagtgaaggagaagccagtgcaggtggatttgtgggagcctttcactatactcttggtacttctctatctgaggcaacattttagcagttttggccctaatgatattaattgccagtaccaatgttcagaactagtaaaaaatatagttaacttcagtcttaaaaaaaaaaatcctactacgtgattatcatttattcatcatcattggaaaattggtgaggtatgatttgtttattctttgagaaaattaatttactctgaaaactatgtgactgcctaggatgcagtagcacgatgctggacagcatacgcaaagacaaggaaatataatacagagttgcagttgcagaaaaatgtgttaactggtagttttacttcagcaggcccaaaacccaaaaaggcaaaagacgcaggcaaaggcacaccactcactaatactgaagatgtgttgaaaaaaatggaggtaaggttttcttcttactatacaagtgaactgaaaaaatgtaaaagatcctacctcgttttgctctgtttcaacctttcagcattctcttactttttaataatgtaaatttggcagaagcgagcccaacatataaggtaactgggaaggtttgaactttgcaggctgggagatatggagggtctgtcctgtccttcgttaccactcacctggccacttacctcaccttctgtcacctctttctttttcactgtatccccctttccgcttatatttgaatcatgcaggcagagagaaacatgaacaagttttaaaaagagttacatatgtaactcttttaaaaacctctcatttttcctcctgttggttaatatgtacagttttaatgctttttttttggtcttaagtattgaagactcttgagggaaaaatgtattttatagaacttatttttatagctttctttatctaaatatttcaaaaataaaaaaatgtagat

SEQ ID NO: 116426 - DNA, 1053 bp, Homo sapiens
cccagatgactttcttattgctgattttttcagcaaaagcagttccaagttttttttataatagagcattcgtggatggagagggagtgacatacattcaaatctcatgattaatgtgtgagtaattagtggtaaactaatatctgaggtttcttatttctgcataacaggaggctctgtatggtggctgtaaggctgtataatatttaaaccagaagaactgctctctgtccataattgaacactgttttcagtatctttatattattcattttattcttaaatctgtaaagtagtaaagttagatggttaaatctcaacaggagagaaaatggagactagtaagtagaagagctgaaactagtagcttaatgcaaaaggaatgaagcaatgagacaatatatgtggctttgagatcaatttttattaaaaagttgcataaatctacttttaacctattttatgagtctgatttagatctgtgtggtggaaataaagatgaggatttttttttttaaaggtatttgaggtagcaataatagaaatagagacttcctggttcctatgtggcactgaatgaatactgtatttaaaaagtacttttggccaggcgccgtggctcacgcctgtaatctcagcactttgggaggccgaggcgggtggatcatgaggtcaggagatcgagaccatcctggctaacacagtgaaaccccatctctactaaaaattcaaaaaaaattagctgggcgtggtagcaggcgcctgtagtcccagttactcgggaggctgaggcaggagaatgatgtgaacctgggaggtggagcttgcagtgagccgagatcgtaccactgccctccagcctgggtgacagagcaagactcccatctcaaaaaaaaaaaaagtacttttacataactggtttaaataactgtgttcttaattataaaaataaaataatagcatgttttttagatatagtgtgtaccctgcacagagctaaataaatatggcactacaatttcctattaactatacaacttattggttgcaggt

SEQ ID NO: 116427 - DNA, 1116 bp, Homo sapiens
agtttgagaccagcatagccaacatggagaaaccctgtctctactaaaaaaattagccaggcttggtggtatgcacctgtagtcccagctacgcaggaagctcaagcaggagaatcacttgaacccaggagaaggaggttgctgtgagccgagatcgtggcactgcactccagcctgggtgacagagcgagactttctctcaaaaaagaaggtaggagataaattataaaaaataaagcattgtgcattagagctgataagcccaatattaatctgaaacccaattattaagtaacaaaatcaaagaaaatgctggtttagtggtgagacagtaaattccttctttcttgagttgactcatagtttcctaggtggtagccaggaggtggtggtaagatgggagtagaataaggtgatagataactgttcccttaaggctaagcagggaagtcagcagtctagtggtttccatacaaattaatgaaactcacttataccaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggtaatggttcatttggggatggtagcaaaattaataaggtttatctaataaggaatcagatatagagtatgtattgaaatcaataaacagaaaccaagatgatgggaaccagaagtatattattatcaatggcatcgattccttgctatcaagagaacttccttgctatcgagagaactattatagcattgaaattataatgatgtcaaattgaatataggaaataaaaatgattggcaactttgtaagtataaatctgcaagttaaggagattgatcagattagtgcagttaagatttaacaacataaaaatttaagtcagcaattcaggtaacggagggcttaaccacctaggtctagaggagaatccctgcagtgtgtttcaaattccaaagtgcatgtggatactatcagagaagattgataatttaacctcaggtatctggctgagtcaggactctgtgttttc

SEQ ID NO: 116428 - DNA, 3086 bp, Homo sapiens
tagatagaatataatataggcatcttttggatttggtttggtatcatgcctttttttttttttttaataggaagtaaaagtctttctggcttatgcttagttatgttttatgactaaaaatctcagtactggtgtagtctaatggatgttaatgtaaactggctttttttcttgtctgtgcattttttgggtaagtgtttagtggtttagctaactaaactatgtatcatcccagtaagctgtaatgtgttagtagctatattatcctattgagatggtatgggcaacccttcatgttctcttagctagttagtgcctgacaagagtggaaggtggtggtcttaaggaagaaagcggcacaggtaaacacaagtgaaaactgttgtgtttttgaagcagataaaaagcagagacttttaggcctggaatattttcttactactcattcattttaacgtttacaaaggaatatatcatttcacttaggaaaatgactacattaattcatactttgaagatggagatgattttggcgcagacagtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaacaaaactctggttaatgattattcaaaaaagttgttgtgagatgggcatgctggtctgtgcctatagtcccagctactcgggaggctgaggttggagaat

SEQ ID NO: 116429 - DNA, 1048 bp, Homo sapiens
ttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaaggggaaagtgatttataattcctacaacagaggccaagaaatagattaaaatattttcaagaccccaaaataatgtattatggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaagg

SEQ ID NO: 116430 - DNA, 2071 bp, Homo sapiens
atggagtctcgctctgttgcccaggctggagtgcagtggcacaatctctgctcactgtaaccaccacctcccggcttccagtaattctcctgcctcagcctccggagtagctgggactacaggcatgcaccaccatgcctggctaatttttgtatttttagtagagatggggtttcacctgttggccacactggtcttgaactcctgacctcaggtgatctacctgcctcggcctcccaaagtgctgggattacaggcatgagccaccacgtctggctgacttcaattacatttttgctgatagtccataaatctgtgtctctagccgagatcgttcttgagtttcagacatatatctacaactctgtcctgaacatcttccacttctgtatctcaagcagctccaagtcagcatatctaaaatctgcatttagcctctttttaccctccacagtgttccatttctcaatgaatgccatcgtccatcaagttgaccaaaccagaaatctaagcttcatactagacccactttatctctctgacatgaatcaggtgatacatgattaggttttaaagtattgatggaaatgaatgggactaatagatggtgggagagcctggcataccaattggtaatctgccagacactcccctcttcccccaacacagtggaataggatatacagacaggttatctcacagtggatgggataatacaaacaggttgaggaatgtataatatatagagaaaaagcttataaaagtgattaatcttgaaagtagttgaataatgcatttacactgagaagtttgggagggaaatggcttcagaaataagggggataaattaccaattttttaaattctaaggtatatatgcttttccacacattttagcatctttttttggaatggtggcatcttcaatttttggtgaagttttttttttccctagatatacataaaataatactgcatcttagagttatggcatcttagttttgataaaatatggtagttttagttgggtagcatttgtctatattccagtttccaaactggaataaagaacataactacccataatccttccttcacaaattgtttacaagcagaaggactgtggtatttatgcatgatgcacaaagggaagcagcaaaggattctagaatctacttaaatagcattaattagtgttactaacatatatgggtgatagtaaaaagtagttggtgatttcctaagattggtacatctaaagtggtgtagaattctcatctacaaataaaattaaaatttctctgggtgcaacttaatactactaataattcaactttttttttcctccaaaagtaactagaatgaatgactattgctgcctttattttgattggaattcagttgtatgttgcttttttttcccccccacaggtagcagatatcaagagagttaacaatctcatcagtgatcaagacttttttgcccttaggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagt

SEQ ID NO: 116431 - DNA, 1074 bp, Homo sapiens
ctgccaaatacgtttgttctactttaacagttgtaaaacctgaacctaggccaggcgcagtggctcacacctgtaatcgtagcactttgggaggctgaagtgggcagatcacctgaggtcaagagttcgagaccagcctggccaacatggtgaaaccctgtctctactaaaaatacaaaaattagctgggcgtagtggtgggcgcctgtaatcccagctactcgggagactgaaacaggagaatcacttaaacctgggaggcaaaggttgcagtgagctgagatcgcactactgcactccagcctgggtgacagagtgagactccatctcaaaacaaaacaaaacaaaacaaaaaaacgaacttaaacctaaatgtttaaataactaaaaccattaaaacaaaaacaaaagattgtgtcctgaatgtacgatgcatgcaaatcagtcagttggatcagctacattccaaaattttctctgctttttttttcctccagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtaagttttaatattacataatgcaattcagaagaaattatttgtttacgcacactgaaataaattctgtgtccttttttaccttgtttattcctttctccattttttgctcttattttttgcatagaaatctgtgtcacatgggctgggcgcggtggctcacgcctgtaatcccagcactttgggaggccgaggcgggtggatcacgaggtcaggagcttgagaccatcctagctaacacagtgaaaccccgtctctactaaaaatacaaaaaaattagccgggcgtgttggcaggcgcctgtagtccca

SEQ ID NO: 116432 - DNA, 1057 bp, Homo sapiens
caattgaggaaactcaaggccatgtgaagggaagtgacttgtctaaacttctacagctgggaagatggcagagactagattggagcccaaagctgagtggaatcaatgcttgcctcctgctttggaggtgacttggggcccaacaccccaggaggcacttgcagtgtccagctaaaggtttcatggcatctgtgttaggatgcccatggaggtactgccaggaattcttcccattgtcctatgaaatcaaagtcctgggacactgcatggaggcattccacaaggtggtgagcgtgcatgtgtgtgtacgtgcctgcacacacgtgtgtgcaggcacgtacacacacatgcacgctcaccaccttgtgaactggttttccgcctctgaatgacatggagataagaaatttcttactttcctctttgaccctagtctgaggagacattaggagggtataggagagcaaattctctgtctaactggcagctactgcttagctccaggcaagggatgccatggagaaatgtggacccagatttgccaattctggtaatttttcaaaataatctagacatccatttttttaaaatgtgaaatctacaaattttaaatcttggcaaaaatgatcttttagtattgttttgtaatcacagtttggactaaaaaacacatatctctaggcatctgggtttgtaacattaaattccctcttttgctttctttcttactggcagtgagtgcaaataattcatttagaaagcataagcacctagattcttcaataaaaacagactgtcttcaatgaagagaaagaaactcacagaaagtatccaaagaaacaatttttaaaaattagataatactactgaatttcaggagaaaaaaaaaattttgtttgactagagctaattaaagttgttttcagtgagatcttaatttcaagaaaactgcttttcatgactttttaagatctatgtaggattacaaaattacgtttgtttgagaagagttacaggggtcaaaaatctatccttagatccttaagaccgcttcata

SEQ ID NO: 116433 - DNA, 1048 bp, Homo sapiens
cgtgtttaactcctgaattaacaaccatttggagaaaagcaagaataattcacaaggaaaactaacaatttttatgtaatgtttaacgtactttccagattcttaggtattattagactttcagtactacttctaagcatatcaaactgataaaactgatagaaatgtatgacagttttttactgtttaatctttggagttatctaaggaccagttaaggctgaaagacattatacctggacttcattacttgtactattgcttccttacgttttcttttcctgtgtaaaatacattatttacctgtggaaaatattttattaattggagactaaacaagcctttctatttgctccctcagttaaagaatttttatttctatgtaattgtattgaaacataatgacttgttacactttagtttatttgcaggtgttttggctgttgatgttttgcctctgtttatattcctttaacaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaaggtat

SEQ ID NO: 116434 - DNA, 1035 bp, Homo sapiens
tatctggaagagttgtaaatattgccttaaaagcctgcaaaattcagaagtaaaactggaagtagcgggtgccatttgtctctctgacttctctagggttaacgtggaaaaccaagtgctgaaatctggatatactagccgtgacctaattattttggaaaatgatgaccctgggggagtttttgaattttctcctgcttccagaggaccctatgttataaaagtaagtacgaaaaaaacttccatttattctgtgctcacaactttagaagaatgatctcaaagggtttcaacttttgtggatttgtttttaaaggaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagaggtatgggattttatattttctttgtgtttctctgtaagattgatagtatttggtatattatgaatataaatattttgaatattggcaaagagacaggaaagaggtgggcaagaaaagactgagaagtacatagatttggaaaatttttaacaaaaggtttaaaaatgaagactcattcatattagaatggtgtatttttgctccacatgaagaaataacaaacaatcttagactttcagtgtgtgatcagttttcatctccttttagctttattcatgttaaggcttcctttaggtaatatgtattgactgaacttttaatgatgtggttttaaactgaagaaattttgctatagaattactttgttcaaaaaaagaaatttgagttttatattaatggaaccaggtatagttctattatgcttactcaccaatacatatgtaactctaattttattttattcacttttgtaagtttaagtgactagatcatcagagataacatccacttttcttaccattttagagtagtat

SEQ ID NO: 116435 - DNA, 1100 bp, Homo sapiens
tagtaagcagaaattattctccccacccccctcgttcaaacttcaatcctttgtgagactgagaaacttgaattattcaagatcttcaggaactcttctctcagatgatatgtgactacccccaccctgtactttgcttttggaaaactttttccaactgtcatttagtattttttgatggagcttagaatttatctttcagtttggattttgaagacaagacttttatgactgtttctcttttattaaagttctaccttattcttctcttcccatgaaattcttcatagtttgcctcgtagaaccagctggtttgtttcttttaagacaatagatagtaaaaatatgtttccttaataacacaggaagctctcattagagtaagattcactacttataaattttctttaatttattttgtaggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtactgtgtttttccatgtcttattttatttccatgtcttatttatactaaattttacattttatacttagataattagagccatatacaaaatgcaattggtgaagtatttgtgtcatgactatctgattttaaatgttaaaatacccttcttgtttcaagtgttattcttaacattcacttttttgatatcttagtttggttcagttttagggatggaggcctacatccatcctcaaacatgcaaatagactttctccacaccaactatagtgtctccaacaagacgttagtggaaggtaggaggtaaggattcatggtagcttaaagcttgatctttgtgtcataatttaagcaatcaattttcgcatcacttttggttttaaaaagcacagaattaaacctttctaattcatatactcttttcaggcttgactgattatcaataaaattatgctg

SEQ ID NO: 116436 - DNA, 1035 bp, Homo sapiens
ataccttaacttcagttctgctattcagaaagctctgattatcaagggttattggagtcaaacttatttcatgacagaactcatctgcgctaagtgaggctattgataatatgtatcccaattagatggaatactttgcaaaagtgttaatgtgtttatcaggtgctactgggagtgttatggaatacatacgatatgcattgttaattacctttataagtttgagaaattgagagatgatatggtgtttatcaggacagtccctttcattacaaaacccggtatcattacctcattattattatttattattttgatgaagaaagccatagtacataagccatccaaaggaaaaattggtaggactgagatacgaaaattgtctttatgtataaaatagataatttgggtaaatatgcaaaaatttttctttcctgtgttcccaaatctcaggtaagagcaaggagaccaagccagtgtttgggagcagggaagtggttaaacagtgctgagcttggttgaatgcataaaacagtagaaatgtgctgtctagtaggtggcatataaaaataccagcttttcttgtcttccagagacaagtccttgtatctccaaatcactatttgcattactaaaaaggttactataaaatatttgaaaagttgccctttgtgtcacttaaagctaaaaatccttatgtaatagaaagagaaaatgttagtgaccatgagctaatactgattaataattgtacatgaaatgttattgagatgataataatacttgtgatcatatgaccacttatagtgacacttgttatattattgagaaacttctccccatatctctagaatatgcattgttatatattaattggacttgaatactcactagaaaaccaaccttgcagttgcgtaggaagcaatagtggccgagaatctgatttatccctccgtgagttgggattggaggaaaaggaatttatacaatgacctctactcctggactcatatgtagggactgtctaacatgtca

SEQ ID NO: 116437 - DNA, 1005 bp, Homo sapiens
gcagattgcctgagctcaggagttcaagaccagcctgggcaacatggtgaaaccccatctctactaaaatataaaagaaattagccgggcatggcagcacgtgcctgtagtcccagctactctggaggctgaggcaggagaattgcttgaactcaggaagcggaggttgtggtgagccaagatggcgccactacactccaacactccagcactccagcctgcgtggtagagagtccatctctataaataaataaataaataaataaataaataaataaataaataaaataaatagtagagggaaaaccccaaatgagaatcctatttggctgatggaatcttgctgaggtttcttgatgacttttggccagttcttagaattttgatagctttctgtgttctgtgtggatcttctgtctttcagttccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtaagaaaagacatctaaaaagcagtacatacagagggatgtaagcacagagggacatgtatccttgattaacacagcctctcaaagttgcaattaggataatcaactagaaaactagaaatactcttgtatctttttcaagggacaaatctagagtctttttttttggggggggggatggagtctcgcttgattttacaatttttttatttttatttttattttattattattatactttaagttttagggtacatgtgcacaacgtgcaggttagttacatatgtatacatgtgccatgctggtgtgctgcacccattaactcatcatttggcattaggtatatctcctaaagctatccctcc

SEQ ID NO: 116438 - DNA, 1041 bp, Homo sapiens
ttgtcaaataattttatttaagataatgtgggaaataaagcatagtatattaacgctccattaaaatgtatatttcagattttttttaaaaaagttataggacgtaaaagtactattattgaaatggtaaacataaacagggatattaaaattgagtcacatgattatataacaatattaaggagtttaaacagcctgtatgtcttatatataactaggttctgttattaaatgttgatgatgggttattctgttacatgctgggtttgtaagtgtaattggggagttcttttagtccatttatatttcattccattttgttcttgtacttgtatgtatatgtttgatttttttcccttgaatcatttttattctaatttcagaactgtgatgctgttaaggaagttttcactgtatttttaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaaggtatatgagatagctacttgcctctgtgggagtgatgagaattgtggggtggtggggaaggatcccttgcacagttaaatcatttaggttttgtggttttttctatgccataaattattttataggttattttaatgtgttaactgaattatgcttattagtataaagggcctttcatttatcatacctattgttagtgaaatgggtaataaattttacatcactgagctctctaaccccagaaatgcattgctctaatctgtaatttgttacaattagtacttaaatataactggcttttaaattaaagagcatttgtatgatgtatgaaggagctgatttccaggtctgttttttttttctttttttgtgaggcagcattgggctcactgagctccttcagaaatagaaaacaggatcttgggaacttgtgaca

SEQ ID NO: 116439 - DNA, 1604 bp, Homo sapiens
ctatataaatagttgctatactggactggtttttaaagtttgtattttttaaatttttttttttctgaatatttttgatctgcggtcttgaatccacagatgtagaacctgtggatagggagggctgactgttactacatttcctcaaaatgtagtcatgtttgttatcattgttactttgtttcagttaagtaaagcaataaaaattaactttgtaattttgttttgaaaccctgaatttgcataccttggaaaatattttcatagcttggttaaaaataagtgttgtttgattgaaaattagcaaggtttcctcacaggagaaaacaaaatgttgggagacaagtgtaattaagaaacaggattgtgtttgtactatgactttaaacatttttttaaaaaactaaagaccacagtcagcattcctcttctctatttgtaattactttgagtgcttaacctgtcttttaattgtcactccacattttagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgagcaatggttctaaatgaatttccgttgccccagtaaagtcatcatagtccatttttatgataaaatttataagaattcttactgtgtacattcttgttaatatacagaaatgtagtttggctttagaaaaaaatagaagttaattggcttgttaatggttgacatgacatacatagactgacatgactgtacatatatatctttttagtttaaaaaatagattttccgggaatatgtgaattttatccctttatgtttgatagtagtgtctttgacaaagcacagaggaaactataag

SEQ ID NO: 116440 - DNA, 1031 bp, Homo sapiens
ttattctttacattcacaactatattgtatttctttccaaacattctatagaaactcacagtgtatataaatataatacattctgcttttacctttttgaccagattcttcattttgctgatggagaaaggtataaaaatgtcaatatcatgattcttgatgatgacattccagaaggagatgaaaaatttcagctgattttaacaaatccttctcctggactagagctagggaaaaatacaataggtaattaataatttcttataaacagcttcctctccttcatgctgggttccttaatatgggggaagatgtaaaggaatgagaaagtcttggtggttttctgtgcttaaaatgagaatgattttaagttagagcatttcagaattcctgtgtctgtgtaacagtgcctctcacgtgtgtatgttggtgtatatatgcatgtatgtaaaagacaaagtaggttgatactacagataatattatttcctcagttattgtaggattatttaatttgtagatgtctttcctttggaatttgaattttgttctggtttcctacttagcaatagaaggaattacaaaggtagtaattctacctttgtagaattactttgtacctttgtacaaaggagtaaaggaactcctttagtgtcatctactctgtagtatttccgcatagtgttgaggtatactgatacttcagacagattatgggagacgtaattcttggttggaacagtttgatattgttgctaagagtcatcctactccattgcttgataggtattgtgctgactgtttagagaaggtaagaaagagacaaaggagaaaactcgggaacatacagaacttgagggttggaagggctcttaaaaagtcacttccgttcattctgatgatagacaagccaaatgaatttcaaggattgaatgctgactgacccttcaaactcctgttttagtcagtggctgagctggttttttttaaaaaaaattttagtttgatgaatatttgcattcctgaattat

SEQ ID NO: 116441 - DNA, 1004 bp, Homo sapiens
taaagacaggctcccactatgttgccgggtctcgaacccctgggctcaagcaatcttcctgctttggcctcccaaagtgctaggattacagatgtgagccactgcacccagccttgctttgaactatcaaaagtatggtttcctgataacatttcaaaaacattggaagaatatactttaggagtcataaatttgttcatatcctttggcctaattaattaacttgaagaatttatcaagtgaagataattaacatgaataattctgtctctacttaatatttaataattaaatatacaataacaaatatcaaatgtagggaaattattaaatatattttgatcaaccatatatattatctatgcactgaaatcatagacttgaaaactgtgtagaaacagaaaactgtaatagtatggacatggtgtaatattgttaattaagagttttttgtatttatactgtttataactgtgtcaattatgaattcatatgaatgataactagaaaggaaaatgaagcatttcatgatgggattatgagtatgtttcactttttaaaatatcctaatatgctatctaataaatattaagatgaatataaaagagtttaaaattagtttcggttttagcagccagtaatttcttttttattaaatgggtatggaaacctcatcaagctggcttgatcattctaaagcacttaaaaaattattatttacgtccagttatttcagaaattgaagtatatttagttacctcagaaatcacaatggaactttgagattttggaagattttgctttggaaccgatgcagggagtgtgggaggtgacagtttatatctcactcaagttgttttttctttccttcctgcagcccacatacttcttattggccaagatatgtctgctctttactgctggaattcggagcgtaatcaattctcttttgttctggaagtaccttctgcttatgatgtggcttctgttacagtaaagtccct

SEQ ID NO: 116442 - DNA, 1008 bp, Homo sapiens
aagtaagtttactaccactttccaaattacattagtttgaatttccgtgtgtaaattgttttagtttggtgtgggtgtgtgtgtttgtgtttacacatatacacttttatatttatttacttatttgaaatacattttcagttatctttgggtagtcttgaaccttactgtgaatggcaatgttaggaacaagcctgtctagaaaaactatgtttaacattaggattattaaaatgtttctgtttcaaacattttaatgaaagcctttgtaatttgtgcatatttaatttcctatgtgactagaaatcagtgaatattcacttcctaatgaataatcatctttgaaatgaatattttactggcctagagatgcaggtagtatctggatccttgatcttgctttctcgaaacagtccccagtagcagcttgcctaatattgccaattctttcctcttgtagaagcagaatacagaatatatggttatattccttcccaggtaggaagagatggctgcctttctaggaaatgattttattcaaaggcagaatatgaatatgactttaaaaataaatatcttactgctgcatttaacctgattggcttcattgcctctatcaaaattctttggttatctagccatttttaaagttcataaaaaattgctttaggagttggtttataatgagtttatgggtaagttgtggaatacatcactattttgtgaacttcaatctgtacctggaaaaaatcatattacatttttgcattaagaaataaatgagacttggaattttttcagttcattgttttctgttagattcattatctttgggaattttggtcagtgtatatttatatttataatatacattgagtattatttagccatagctaatgtgagccctattaaattatattttaatatgcagaatttagcatagcttaagaaatatatttttgaaaataatgtttaagttgaaatcaaacattgaagacacattttcag

SEQ ID NO: 116443 - DNA, 1047 bp, Homo sapiens
ggattaggaaaatgtggcacatatacaccatggaatactatgcagccataaaaaggatgagttcatgtcctttgcagggacatggatgaagctggaaaccatcattctcagcaaactaacacaaggatggaaaaccaagcactgcattttctcacttataggtgggaattgaacaatgaaaacacttggacacagggcagggaacatcatacactggggcctattggggggtggggggctaggggagagataacattaggagaaatacctaatgtaaatgacgagttgatgggtgcagcaaaccaacatagtacatgtatacctatgtgtcaaacctgcacgttgtgcacatgtacccttgaacttaaagtataataataaataaaagatttcattctaagtgcaaataggatgccattagaaaatcgtaagccagagaacaatgtcaccagattgtcttttaaagcagctcatttaagtctagtgcaaggaaaatggattcaagaagctggtggggcagcataggagcaggaaggatggctaggaggctgtttatttccctctactctccatgtcaaagctgatggtggctcagacaaggtggtggaaataaagatggcgagaagtgggtatacattgatatttggaagaaaaattcattgggctagaagtagaggctgagggaaagacaggaatcaaggataactccttgaatttaagtttgagcagctggataatttgtagggttgtttactaagatgcagaagctcaaggagaaattaagagttctgttttgggcgtgttcttctgagatactactgacatcccaggggagggtggtcacataggcagggcagcatgcgactgtgtgttgtggggtggtcagggctgcagatgcaggtctggaagatgttgacacatggggaggtgtttgaacacgtggggcctaaggggcatatctggaaacaggaaggatatggtgctgagtcctgagcttccaccatttagagatcagaggaaggagaaccagcagagaagcttgagaag

SEQ ID NO: 116444 - DNA, 1057 bp, Homo sapiens
tccagagaggctactggatgtccaggatgcagaaataatggctgggaaaagtacatgtaaattagtccagtttacagagtatagcagccaacagtggtttataagtggaaacaatcttcctaccctaaaaaataaggtaatctttcattcaaaacacttatgtggttggaatctgatttatttctttagcaggcacacttggaatgcatttgtttgatcacagttttggtaagtgctacacatggtgaactactatgaaatgtgttccatctttatgaactatttgtagaaagtttagtttctaaatgagttggaaatatatccttcatgttttgagtaaaatacatattatatatgtggggaaagtaaaaaatatatagctttaactaatatactattacgtacttaacttttaatgaagtcatccagttagagtcaaagtgagtgttgtcagctgaagactgctgaatggctaaggcggggtagaaagggcacaatggaaaaccaatcagatgtcctgcatgcataagtgagctaaatactaacagtgaaagaaaacaaatgactgtagctactagaaaaatgaagtcaagttcagggtaagagactcagtcattacaccaattgtaaaacatcattatatgttctgtttttaacattctaggtattatctttgagtgtgaaaggtcagagttcacaactcctgactaatgacaatgaggttctctacaggatttatgctgctgagcctagaattattcctcagacatctctgtgtctcctttggaatcaggctgctgcaaggtacttattaataaaataaaaaaatcagaatttggtccttccccatttcggtaccactgagcctaatgttttgtactgagcatagatggtggccccagatgacattagactggaaaataacctccacaataaataagaggaagcagcataggaaatggtctagtattgttctgatggcaaatgcagcccagcatttcaatatgtgtgtaacacattatttacttcttcatttttactactttcacgggatgtg

SEQ ID NO: 116445 - DNA, 1044 bp, Homo sapiens
gaagtttaagttaaaagtcattgtggagaaaatagcacactttcttcctggtttgggcatccagtattgcaaagttgcctttaaaattcataactaacactattgtaattacagaactatttctagtagataaaaaaggggtaattaccaaacctgagttttggtaggaccagtcaaaattttatgactgaaaaatcctattcacatgcctgaatattgggcttaactggtaagtgtaaagatcttacttgtcatggaaaatggagtagattacaattgccatgtcatcttttccagaggtactgggcagaggcaggtggcagacctgacatgcctagctgcccccaaagattcttgctatgatgctgttagaatcttcatggattattaaaccatatgtggacttttttgttcctacaggtctttgcttggctgttctttcccatatcttctgtgccaggtactccatgtttgcagctaaacttctgactcacatgatggcagccagcttaggtacacaggtaggagagcgctggcatttttgatttatcgtgagatgtttgtgtttcttcttctttggttcttgaactgagtgtaaaagtaaagtttaatctcaacttagttgaaataaacttgtttagttttgcagtggaagagaatggggacaggagagtcatataaggagaatcaggcctaaaatgcttctttctacagagaagcaccttaatatcatcgcttacaaaaaaaaaaacttcttatcacaaagcatcttattgtcagctaatatatgctgaatgtatttgtaatttatatatacattaaaattaacattttattaatctgtttgaaatatgctgtgttataaattctttatgtttagggcattaagatgatataaacttttaaagcatctggacactatgtattgtttcttataatagtttgatagaacattttcttttgaaaaatcagttttctatggtagaagaaactgtgtgaaaaacaatgacttattagcacacaatttaaagtatctagtttaaa

SEQ ID NO: 116446 - DNA, 1009 bp, Homo sapiens
attactttttctcagcgaatttcatgttggatatacaaactaacaaagcagaacatacttatttcatttacaattttggtaaagttttattatgacacctcattttaggtgtcactcccattatcttgtttaatctgttaacatgcaataaagacaataataaatagaagggaataaattttatgagcagaaagtagtatttgagaattttctgtccatccatttagatagagatttaatagttctcttaaaggcattatttgtatgcccaaacttctgcttatagaccattgccattctttttttttttttttttaaatctagatctgtgcttctggtgtgtaaccatgaatataggtttgtatatcaaaacaaataaatatctacttgtacttgtatgagcaaaatcacccttgaaaatcctttacactttgcttgatacctcagagtttgttttgttttgctttttcatttgcttaggtttttaaaatttaaataaattgccacaatttaaaaatcagaaagtttcaacaaaaacagatttcaagtgcaaaaaaaaatttcgagatctctcaacaatgctacctgcatttctttgccgcaactatatgcttgtgctaaggagcatctgcctcttgacatgggaatgtgcttgctgctttgacacaattcatcactcacctacattacttgcctgggctttatagacatatgagtttgtgcttcttgtcttaaaggagaagcatagttggaatcaaagaggtaaaggcatagacttccacccagcaatgcttttcttttaaaagaaaataaaatatgtcccctaccccaaaatacaaagaataaaataacagtctttcatagtaccactacctagaataaatcattattaatattttggcatatttgttttcagattttttcccctgactaatcccatttttgtcctgtagaattttatttctatatgcaggggtgaatttcttctcaagaagtctccctcattctt

SEQ ID NO: 116447 - DNA, 1054 bp, Homo sapiens
ataaagacacagctctaaattctttagtaggttagtttgtaagtgttcataaatgtggagcatttcaagccagattcatcttagtcctgaccttacttggttagagagttgtcaggccaacttcaagccaatggaagtgagatatgagtataatcaagtaagcatccagaccaaagttgagaaattcagctgcccttcatgtgtggtatcatatccacagtcccaagtcacctctattgcccctaaacctttgtacccaagagctctcccattaagaatgaatgtgaatccatttgacttttgctccagctacttacataatgatcaacctctgatttgtaattcctgtgcatgttagcaattctatctcaggtgtttaggatgcaaataattttttaaaaattagtacttggcctcctttgcttgctcccaaaggagaatttaatacatagtatgactgtgacatatgtatttattaaagtataaaatattttttcagttaggtgaaatatagaactcaacagtttggtatatagttggtgttcaactgacgtcaacttcttcctttttaaaaatatgtactattctagcaatatcatggattaaatgggattctgatagcttcagtttgtgttttattctaagtgttctaagtgtgataggtcattgtaaagttttggttcctgggtagagggtagactgtagtgtgaatagtggcctcttgggatagtggaagcagagaggacagtttagaggcctttgcagaagtccaggtgaaagatggtgctgattttaactaggagattagtagtggggagacgaggtttcaaggttgccctgtattttgaaggtaaagctaacaggacttactgctagattggatgttatgtgtaaggaaaagaaaggagtcaaggaagatccctgggttgaatcattcaagctttattgatttctttcccttaagacaccaattatccacgttatttctacctttaagaaatcacctttgaaccattttctgttattaagtggcttctcattcctccttttctgt

SEQ ID NO: 116448 - DNA, 1537 bp, Homo sapiens
actaaagtggatctcctgattcctgagtccttgatcttttgaccattccaaaatgttgctattatgccttggtgctctctgcctgtttgatttctcctctacctttcttgtctgccctcctgtgacctatatgttgtaacgtttgcctggctgaagtctgaagactcagactcttggctggttagtatagctggcttactgtccagctgacccactccataggtgatattcccaaccagacaaattggagtcctggtctcttgcccagcttcttgttctgtcataacaaccaacttgcttggtatgaagggttcatttgtgggaatactaaaaactttgtgagaatacgcaaaaagaaaaaaaagagagagagagacagagagagagataaagctaggctgtggaaagatttgcaagaaaggttgaagtttatatttcgttctctaggccagtgaccttcaaagctcaagtttgcacctcaaaagtaggcaagatgatccatggggtatggacagaaattattatattataatgactggctcagtgtgtttctatctttaaaaagtttttttctaagaaatacagttatttaaaatacagaagaaacaaaaaaaccaaacatttaaaatataaaataaattaaaaatacaaatgtttaaattgtggattgacccaagtcaccccatgtgtcagttggtcacatatcaactttggtaacaggcttctggaggaaagagtatgaactccgcgtcctggaggcgctgacagcaggaccttactcatttattcactttcagcttgtttgaggtattgctgtttatgcgtgcctagatttgcagattgtgtttttagccttaagcaaaataacatttgtaaagtggtcaagtgcctttaaaagattcctgccaagagcctgcaggttgaagctactacttgtgacgcagtcacatggaggagctgatacttgtgctcctaatactagctttagccacacttagagcaaaaatcagtggtattttaatcagatataaccgaacttctaccaccaaaagttgataatttccaagaagactattagaaaagtgaatgtatccaaatgcctttgacaaagaacctcaccctaagtgtatattccactttgagataatgcacattgtgaatatagtattatgattagccagtcatttaaaaatcgtgtttatttcatttttatactcaacctttaaaatgcccacttttaatggacacttttagtgtctatgtttagttttatatatatatattatctatctatctatctatctatctatctatctatctatctatctatctatacacccgcacacacctgtatgtatttaattttgagaataaacatatatattatagataaatatttatattttgggcacatgatcaaaaagttttcaggggattattctgtggtcatctgattggaaatttttagagaatacaggtactcccagtgaggggtggtttctttaataacaagaaactgaaaactgactgaaaatct

SEQ ID NO: 116449 - DNA, 1091 bp, Homo sapiens
ttttaatcttaaagatttgttagaccagaggccgggcgtggtagctcacgcctgtaatcccagcactttgggaggcggagacaggctgatcacaaggtcaggagatcaagaccattctggtgaaaccccatctctagtaaaaatacaagaattagccaggcgtggtggcgcatgcctgtagtctcagctacccgggaggctgcggcaggagaatcacttgaacccaggaggcggaagttgcagtgagccaagatcacgccactgcactccagcctgggttacagaacaagactctgactcaaaaaaaaaaaaaaaaaaaaattattagatcagcgtgtctaacctttgcattacaggttacttttctccttaattcacaaagaatattcctaagtcattcccatacgaatttattctagcttataaaaattctatatcttacttcaattttaatataaggttataaactgatatattatttatactaaaatattgtatacttatatcatcattttaaagcatgccatttctctagaggtcataatagattgatggttgtatgaactaatggcccatctgttgggcagtggttacttcatagtattttgcttgtcttctaggctcttccctagaagaattttaaaattcttagctcattatggaagagctaagaatttttaaaaatgcctcaaggggaaaatctccaagtgtcttgttcacttctttctggaacgtgttttctcaagttctctttcctgccagccctgaagtctaatttttgtctccttagctctttgagattgccagataattcgctggctttcctgactctcagcatctttcctcatcctggattttcagtctccctttcttctccaagtattaataggcggataccctgaagggaaaagtggtatgctgaatgtagcgctgatttcaataagcttctcttctttacaagattggcctgtcaatgttggctgcctcaacagctttacagtgccttcaaacaaatggttttgtttggttgattttgctttaattttattttgtctgattattctagatggaattataaatcatgtacaagc

SEQ ID NO: 116450 - DNA, 1025 bp, Homo sapiens
gacattgtaatctttcactttgactcctgactttcttaaggatgaaatggtgaaatatagactggatatagttgagttgttttgtgattgctttaataaatgtacctaagtattgatttaatcatttgttgtgaattctaaagctaaagagaaatgctggaaaacactggggcttcagggggagaatggccatgatggttaggaggatgtcatatgccatcatggagagggtcacagatagaagcgagggggagggctcaagtgtgagaagtcctaggggagagagcatggctttcttcaaatgaataactgacatagccaaaaaggaggcctggagaatcgactgggagaggcaagcattgaatggaagttaactgaatgaactctgaagttcttccctcaatgttttataattttgttctcttttataaacctaaagtacagacatattttttaaattgttgttaaatgcaccacattcaaccctacactaaatttaagtggatattttgtatattttctcagaattcatcttaaactttatagcttctttatgctggtttcagagtaaatgctcaaaaaactatttggttggctgatttaagtttcttgttgctaaaatatcacctaagatatggcttgtaaaccaaaattaccttctcttaacagaaaaagacaacgtaagatacttatgtaaagaaatttaacagaattttaaaattatatcttaaaattgtatcataactttgtaaggcaacaaatccaatttgtttgctattgctgtgtatatatatatatatttttttgaagtgcagtggcgcaatcttggctcactgcaacctcgcctcctggattcaagcaattcttctgcctctgcctcccgagtagctgggactacaggcacacgccaccatgcccggctaatttcttttttgtattttagtagagacaggatttcactgtgttgcccaggctggtctattgctatttatgttgtgaaaaatctgcttatgctgcactctcct

SEQ ID NO: 116451 - DNA, 1052 bp, Homo sapiens
ccacaagaattgacacacatttcaaacatgacttactacaagcatggctttcaaaatggatatatgtgactcatgaagagccttgttcaatctactattgctaaactttcaattttgacatatttttcattaagaggtgctgttctgtcttgcaatactgattgaccagccgccaaaccacatgaactacatttggaccacaattggcagaatgtattctaatgtgaaagataatacagcaagtacttctttgtaattccatgttcaaaatgaaagtataaaataagcaccaaaaaaaaaatgataaattttccatttaaaatgtaccagtggatctgtgggggtctatgaaatgtcttttgctttcctatctgaaggagagctcaagttgtttatattgtgctgttacttcagcagtgagtcaggaacactttatcctcccgtggcatgaatacagggggtgattgcaggcaaaacaaccagtcagagcaattattacatgctctttggaactctgtgctgtgcctcttggtaaataggattttatgataaaagcatcaagatgtagacatgtcaccagtgatgtgaattgttgttaagtagagttataaggtacaaatgtatgtatgcccttggatgtgaatttacccccaggacaatgttttccagtgtgtggtttccaggtgacttgtatcactagaaaatttcgatttctagtctcctacagagattcttatttctcaggtctagtgtgggccctgggtgtcagcactttgaacaagtcctcagaggattctaatgcagattgaggtttgaaagctatggacctagaagaaaaagaatcacttccaatcagtcaacataactaaattgttaacagaaaactataattttatatattcagcagtataaagtatatatgatattctgaaagaatgtaaaacaaatatattatattgagagtattcataatctaccctactatgtttttaacaagtacatgctggatcttctatattcacttagaaaaagaaaatgatatacagagacct

SEQ ID NO: 116452 - DNA, 1028 bp, Homo sapiens
agattttcctgaatttttcattgttataaacagtagttcaatgaacacatttccatatacatatgtgcaaagtttctctggaacatgtaactagaaatgaaattgcttgacctcatgtagatatatcttaaatattagtagacattgacaaattactctgaaaaatggttgcaacaatttaaacataaccagccatgttgaaacatatccccacagcttcaccaacacatggtgtcttgctctttcaaatagttgtccaacaattttttgtaatcggttgtttattttttcttattgatttgtagaaattttatttatttcatgaatataatcatttgtcaattaaatacattgcaaatatctgcttctagttttccttgtcttttaaattccatatatcaaatgaagtattcaagtttgatacagtcatattaaccaatattttccttaactcttgattttaaaaaaatcacctacagtatttcaatgtcatactctcttacagtgttttctaaactatttaaagttttattttttacacttagatattctattcatctggaatgtattttgtgaatggtgtcaaagagggatctactttttaaaaataataaccaattgtctcaagagcatttattaagtaatatctttccccatttacttgtcatatactaaaattactattcacatgtgggtaagctctctcttctgttccatttgattatccctgcaccaacaccatactcttttaattgttgtatgatatttctcctttaatctgctaatgatgagattatattgatagatattcaaatattaaagtctttgaaatgcttagataaaccctttattttagtccactcttggattcaaattattatacttaattcagtttttgcatgtatattctaagtaaagcaggtttataatgattctttctcatatgtttttggtattttggtatctaaattatgataacataaaaaatgaagtggagagaaatggtacagtttttttaagatggagtt

SEQ ID NO: 116453 - DNA, 1038 bp, Homo sapiens
agagtaagactctgtctcaaaaaaaaaaaaaaaaaaattaaggaatagcaatgacagtgtggaagaggggagttgtagaatgagaagggtagacctaggttctgggttcagtaagtttagatggagcattgaacaaaatgcaagttgatttccttatctacaaagtggaaaagtagctacccaaggtcattttcaccactggaggtatgagcttatacatctttttttttttttcaagactgggtctctatcctcctgcctcagcctccagattagctagcaccagaggcatgtgccaccatgcccagctagtgttttatagagacaagagtcttgctttgttgcccaggttggcctcaaactcctggcctcaggtgatcctcccccttcagcctcccaaagcgttgttacacatcttttaagtaagaagataatgctgtaaataagttatattggacagtcaccacattgcttctaggactgtattagaatacttatagacgttgagttcaacgtccctcaggttacataagagcattaattatattctgtttttgcattaactcaactacactttgatcaaagtcctattgccattagttataatttgttgaatggctgaacttggtatatttatcaggacttctggttgtaggatagcgagaaattcagactagcttaagaaaaaactgaatatattaacttgtaattccaggaataaaatatattaaacacatctgaatccaggaatccaaataatgccccgaggacatactcttttagtgcttcatcttacccttttttatattggccttattctttcatattagccttactttttcatgttagatggaccaggaaagatgaccccttttatagttgaaggatgacataccacctagagtcccaaatcaccttttttttttggagtcaaggtctggctctgtcacccaggctggaggaaaatggtgcgatctctgctcattgcaacctccaccatctcacaggctcaaaccatcctcccacctcagcctccca

SEQ ID NO: 116454 - DNA, 1865 bp, Homo sapiens
attaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtgctgaatatgtccttgtaggctctgttttaagaaaacaatatgtgggaaatgatttaatttttcctattgctcttccttgtggaaaataaagtgttttgtttttttctgttttgtataattgtttggagatttatttgaatcttgatcatattagtaactcaccatacatgcaaacacattaaattaaactattaaactctattttaagccattctgggtaagaattgtatctaggtctgtactaaagaaaattactgaccaactcctaggctaaagtagtcctcctgtctcaacctccgaagtagctaggactacaggtgcacaccaccacacccacctaattttctaatttttttgtagtcgtggtctcactatgttacccaagctgatctcaaactcgggcctcaagcgatcctcccaacttggcttcacaaagcactgggattacaggcgtgagacaccatgtccagactctaaatttcaatcttaaatatgaagcaaacttaaccaggtaaaataattcactttcaggcaccaattcct

SEQ ID NO: 116455 - DNA, 1940 bp, Homo sapiens
gattatatgtcttcatagttttgatcaccaaacaataattattttaccttgacgttgctttttaatacctactattctgtgtattttgacatgcataagaacatgctgttcgaattgcgtgtatctttttccttcagcaccacccagctatgcagaagtggtaacagaggaacaaaggcggaacaatcttgcaccagtgagtgcttgtgatgactttgagagagcccttcaaggaccactgtttgcatatatccaggagtttcgattcttgcctccacctctttattcagaggtaagtacctactccttaagtatgaaatgaactggctatcttgggaaatagcattgcaggcatttttttttcttaatgttattagatcttgattatcatgttaacagaacaaataatttaaaacaacagattaaaagttaatattaggttcatcaatatttactaagtttgatgcagaggtaggactgttcacttattagggaattaagataatgatctaacctcatgttgaattactaatttttttttctcttaaacttttatcttgagacacattttttgaaggaagaattttgtatatccaagcatcaataggaagaactagcattttgcaaacactgattaaatagtagaatttatcttattcatgatgcttttccaattgcatattttgacattctcagtcataagaaataatgtatttgtgataacatcttaaaacaacattcccacatggttagactattttcgttcatctcatattgatggcagctaagcacttaaatgtaaataaaacatggcccttaggagaaacccacagattactgaggaaaacaagctaagaagcaaaatattatgtaataatgtgataaaatgcacagctcatttgagaagcagcttattaggtcttgggcatcaggtggggcttcttgaaaaggtgactattaagctgaattttgaagaatgagtagtcctcaaaaggcaggaagaacagtgtatgtaaagacaaggagtgagtaggtggggtgtccagtaatttcaggatatttcagagtgactttagccactagtacacatttttaaggggttttggagttggttttgataccaaaataattctgtaaattactagaatcagctttttcttttggttactgtaatttacatagctgttttactctgaaatattactcccaaattaaacattaggggattgttcatcatatttctctttttttttattaacaccataactggaagggtcagttttcctttggttgtgatgatatgagatcttcttcattcattgattatagaatattcagaattattgatgagacataattttttctatttattttctaatacatacaatttctattagatgctaaaagtgttctgccacttgttacagattttgtcattacatttttacttggacatttctgtcttgcttattaagtcagtcatttctggcttgatttgaggcttcctggctgtccaaggaggcattttaaaaagaatgacaatctaagtatagttcacttttaagcaatttgtgggaaaattctgcctccttttaaaaagcactaaagataatttacaacttttaaaaccctaaaatatgttcagggtgtgatttaactaaaagttatttggcttttttccttcaaaaatgtgttttacctaaagcttctgaggcaatttgggttgttccacatttagatgcaagtggatggggtctcgtccaaaagctctttcagtaaaaaatatattaaacccaacaatttgcttttctatgaccattctctttgtacttgagaagcaacttttcattaaaaatatgtgcatataaaagtcactctgaagataaagaaggtgggaggaaacctcttgagtgttttgggttcagcagttttatttcctg

SEQ ID NO: 116456 - DNA, 1235 bp, Homo sapiens
atccatacactgacctttttctcttaatttttttcttacagtcaccccaagcaggcacaaaagaaaagacactctgttgctggttctgtacctcaggcccaatatccttaagtgccaaaattgaaaggaagggctataccccaggtatgtaagaggtagattcccacaaaaaacttttcttcacttagcttttgtgtttaaatttataatatgactactaaatataaacataatatagtattcttttgtgaaataacaaattgtgcttatccatttgtttttttcacaaagtagaatgtagtttcctttttcaaatagctactgattagttcatttctatgactcaagttatttgcagttcctgggacatcttttcatgtatgttagttgcactttcttactttagctttaagaatcttgacttcttttgttgtttttttctaacagtagatatgtatatatttttccctctctaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatgtacacatttaagaggttttttcctttcttttttcttttttgaaacacctgtcacccaggctggaatgcagtggcacagtctcagctccgctacagcctctgctttctgggctccagtgatcctcccacctcagctcccaagtagttgggactacaggtgtgcctatagccatgcctggataatttttgtattttttgtagtgatggagtttgaccatgtcgcccaggttggtcttgaactcctgggctcaagtgatccatccaccatggcctcccaaaatgttggaattataggcatgagccacagtgcctggcccaagaggtttttggtgtttttttttgttttgtttttaagtcttaaagttatgacatagttttgtcttacatccaggatttgatttttttaaattccatatatagtgacatataaaatacataactctttatatagtttgacttacaattataccttatatgtaaatgtactatacagaatta

SEQ ID NO: 116457 - DNA, 1075 bp, Homo sapiens
cattctcaactttgtgtttgaattcttggccttttcaaaaaatgcccattaaactttcatgattttgccaccatcattaaaagtagcctcctcttagtttaaatggattgtattcttctggctttttaaagcaaaattttaaagatatttattgtttattcttagttggaaataggaagttttttccccagtgacttatccctttggaaattttttaaattatatgtttgatacctcattggaacataaacaatacaatatattaacacttctattctgacctactgtgtaattgttagaaagaggtataaaattaatatattgacctttatattctgcacagaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactggtaagaattgactgaattatttattctttgtttttggcatataaatattaaagaataatcaatcacctaaactatgcagttgtcataatttaaaaatactggttttcttttaaaatttcataaatatacattttcttaaatacagtcaagaacactgaaattaatgaaaaatatgctcatatttttgacattgtagtatacctttaagtaaatataaaactaagaccagtatatgatatgaagtatctcttactcagagtatgacagccataacaaaaaacagatctggtccttggatgatttgagtggaagaagagcagtagtatcttttattataatacaatatcacttacttgacaatatcataatctaaaatttgtactatactttgttattccaatagagggatagttgtcaaataatggggaatcattagtttcattaaaaaactccttttttaaagaaatctatttttaattgcatttgtctgaaaataattcaaatttgacttaaaactttatttgatttaaacaaatggtaacatctttaaagcacataagaaatgggcattttccttttttaca

SEQ ID NO: 116458 - DNA, 1863 bp, Homo sapiens
cgcggcctgcgcctgcgcactggggttgtttttcacaaagctgctcttaaagtgagctggcagcttttagccgcccgtctttgtaaggagaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagaggtaagtttttgttattcataagtcattggactcattttctttggaaacgtaccttttcagttttctgaattaacgtgattctactcctagcataactaagcagtttgagaaaggttagcaaagttggaaggtttggattctccttgacgttcatcgtgtgttaagccgtaatgcatgcaggcatctgcaaagtgactgcaaactacacttattcagctacctctgtacccggctcggtctgtgccacacgcacttgtagtccatttgcaccttacttataaattctgtttgaatccaattcagtcgttttactaatatattttcaaatgaattggtaaaagctgcagtcttagatttttgcccttttacttgcaacctaagatgtaaaaactgaacttcgatcaagaaatgtaataacatttttaagagacttaatgggtgtgtttcatttttaatattggaatgcaaaagactttaaataattgatgactgttctttcataaaagatttctgtggcttattttgacatatggtatcaacaccccacgtgttttttctctattctttaccattcctttaaaaatttacacccagcattccttattttaaaggaatgactatctgtcattatgataggtatcgagtcaggtttagaagccatttaggatcagtaattttcttttccgagcatcatgtctaactttggaacgtgcattcaatgaaacccatgccagtcaaatggaattgaaaagtatagggcacactggatttgatttttggttagaagagagagataaagggttgtcaaaaggagaaggagtcctgagatttccaatctattgtttaaatggttacattgtggaaatataggagactctaggcttgtttttctaagtttccaccctttgttagaagcggttcaatcctgtttcggaccagttctggggggtggtgaggaggggcgcttgttctgctctcagcagattggttacacgcgtcaggtggtggcgatgacttaattcctagcccaagaagaatataatgttaaaactggttatgtaatttttgtgcctctcctttttaatgcagtatttagttcagatgttggcgatttttcagaaaaaaaattagagacatattttaccttattttttatattaaaaacgtacatcctggagaagtgctgatgactaaggcaagtgagaaatgaaggatgctttgagggacagtattaatgcattatttttgaaactattaaggtgaactcagttctttagcagga

SEQ ID NO: 116459 - DNA, 1104 bp, Homo sapiens
ataccccaatttcaaatccaattaaaatgatatccattactaaattaacccatgtacactcaaatcttgatataaaatgacatagtctcaagacactgattaattaatcaaacatgcaaaaatatttcaagaaaattattaatccacctgtttcgatgttatatctcaaaggtcttcaagctcctcatatattagaagtattatatactacattcattcttcttcacttcatttaaaagataacactgaaaaatatttcaccatatgctcgtttaaatgcagtgataaatatgttcttttcaaagcatatggtgatattattaggtgtctctgaatatagcaaggttgaaatgagacaatctgaactaaatggaaattatttgctgctctcatgtccatacatcagtatcatctctggattattattgttttaataaagaaaaactaaccacttgaagattagaaacatctgttgtcacctaccatagctatagtgggtagaattccaggactacttttcctttgactgtgtaagcctacttgactcattttcccagactctggcactgagaacttttgctatcaattaatcactgttgacatttgtgtaatgctccatagcaaggagtctactttcatatgtggcttagccaccttgcttcatgccacgccatgggattgtcttctactaatggtgaggggccttgagattcttctccaataaaagagtttgtttccaacatttcttcctgttctgatgtactcaatctttgaggaaaagaaaaaacttgtagattctatgtggaatgatgataaagactgattatttgttatgagaaatataaatctaaaaattaatgtattgaaatctgggaaaagagaggtttggtcatgatattctatacaattttttcttcatttattcaatgaattagaatgtatacacatttaatagtgtattaaggacttctcacattttaaataagttcatgagtatatttgaataataaacctttcattttataacatcagtgccttatagttcattgatagccatagtctggattttactttatttttctttaaagtgtctgactggaatgg

SEQ ID NO: 116460 - DNA, 1048 bp, Homo sapiens
actcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaacccatgtgtctggttgcttgatagatgttatccgtggaagagaactccttggttaatttccacctcaactattattagaattgaaggttttggtgtgtaaaaggggagacttttaaagtctactacaaagttggttagattcatttccaaaaaccaagctgctaccttggttttgtaaatgcggagggccaggctctacatgggctggggtccgcggggaggcagggcgccttggtcgctgacttcagccgttgagacctggtgggctgcgggcggtcccgtgctcagttgggccagggagtggtgtaggcagggtcgcgcgcccggtaagtctccaggcaccaagcaccgggggcgcagccggcttcagtgtctggcggcggcaaccggggctttaccgcatgtgggaacttgctgagctggagaagctacagagggacatggagagcgggacgtgggggtgacgggagt

SEQ ID NO: 116461 - DNA, 1048 bp, Homo sapiens
acttggcagaaaaggagctagaggaaaggataggttgtgccagaagccacaaatgatgcaaagtgtctgctgctgattttgtgtctttcttttagcctattatctctggtcaaacttgacttcttgcctttacagtctcaatacaatctcaactttaaagggcttgcaactgtgttagcaatggaaagagaacttgcttgtatcttatgcaggtaattcaacaaggcattgtaacatgttttctgagctgcacttggcattttccttacacaatctccgtgcacaccccatcacgccccattcactactcccagtgtggccggctcatacttgtcccttctaactgggaggatttccaatagaagcccttctttgtgcaaatattagtaactgtatatttcattttttcaaaaaggatattgttcttagaagctctagaattcatttttaaatgaattttagtagttatattttatttctttttagaaggcacattatttttcagtgttctgatatttctctgattctttatagctttctaaaaataactgctggtaagctcgtaagttcattagttaatcccaatgggactcaataacgcatattacagatctcctgattgttatatattagattttctcaagaattcccttacctgttattatcaacatagctatattgacagggtcttcattacttcctaattgcccatactcctttttcttgttaaagatcaatttttaaaatcaagccttgtcattttggaaatatcatagacatattatcctgttaatattaatgtgtttcatatctttctagtttcctgcctcctttatcatagtaatttacaaagtttattcattacctttttctttaaaaatgtattattttgtggggggcagggtgagagggtaggggcacatgtttgggttttttctccctggaacaaagatataaaagatgatctttcatattcaaaggtgaacaattgatattccctattctaagccagaccctaggaagtaaattatgtgtagattgttaaaat

SEQ ID NO: 116462 - DNA, 1066 bp, Homo sapiens
actcagtactttaggaaatgcatggccttcaggtccctctagtctgacttgacttcctgacttttcagccacaatcatccaccggtctcttggtgtcacacatttaaatttttaagaaaattattttttctcatctttttcctctagagcaagcttttccaacctgcagcccaggatggctttgaacgtggtccaacacaaattcgtaaactttttaaaaacattatgagagttttttgtgattttttttttttagctgatcagctaccattagtgttagcctattttatgtgtggcccaagacaatttttcttcttccagtgtggcacagggaagccaaaagattggacacccctgataggtgatgactctctgaataggctatacttagttttgtgtcccttcctggtttcaacagctgtgcataggaggtgtagggtaatgtgaaacaaaagatgaccccttactcctgtccctgaaacaggtcataagcaatgtagcttcactaaaaggagtgattggtgagcaggtactatgattcatacttctcatatataatctaccttaaacaaattactatccctagtttggggcaccaaaccattaacatgacccattgcttaaatgttaacttcctcgaagaagtcccagactacccgctgtatatgctgctagcatatgctcccatagtactctgtatttctacgagcataaagctcatcagtgttatcttactacttatgcaatgcctttcttctctcacaaactctcgaggcctgtgaaaacaggggccatgtctttcccattcaccattctgtcacctgtacctgacctagtgcttggctcatcatcagtgtccaaacatttgttaagttatttagttattaagtgccttaaccctataggaatcaactgttttaaattataggcttaataatcttccaaaacccagctctccctctagaacatttccacttctgacactgatattatcagtacccctcagacagggcagactctgactaatctctttccagcatcaaggcagtcgtcatgttttattggt

SEQ ID NO: 116463 - DNA, 2048 bp, Homo sapiens
cacagtcctaggccctgagttacagagaaaaagagtttgacacggtcattgctatcatggcttacaccttccagagcctctaatagaggttttgtaaaaagggagaaagtatgcacgtattaatgcaagtactagacataattaaagtaattaataacattgacaagaattactaaactattgaaatataatacagtttctttaaaaatacatactgtatattcagaaagggtaatgttatttttacatcttaaaaagaattcattttcatctctggttcaaaatatatatctttaaaaaaaaaactttttgcctggtgtgattccgtcctgcgcggctgttctctgcagcagcgttgttttatctccgtccgccttctctcctacctaagtgcgtgccgccacccgatggaagattcgatggacatggacatgagccccctgaggccccagaactatcttttcggttgtgaactaaaggccgacaaagatgatcactttaaggtggataatgatgaaaatgagcgccagttatccttaagaacggccagtttagggctggtgcaaaggatgaactgcacattgttgaagcagaggccatgaattacgaaggcagtccaattaaagtaacactggcaactttgaaaatgtctgtacagccaacagtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactctgaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcaacaccaagatcaaaaggacaagaatccttcaaaaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactaaccaagaggctattcaagatctctggcagtggaggaagtctctttaagaaaatagtttaaacaatttgttaaaaattttccgtcttatttcatttctgttaacagttgatatctggctgtcctttttataatgcagagtgagaactttctctaccgtgtttgataaatgttgtccaggttctattgccaagaatgtgttgtccaaaatgcctgtttagtttttaaagatcaactccaccctttgcttggttttaagtatgtatggaatgttatgataggacatagtactagcggtggtcagacatggaaatggtggggagacaaaaatatacatgtgaaataaaactcagtattttaataaagtaaaaaaaaaaaaaaaactttttgcctaatcaaaatttattcaagagctgttcctttctttcagttactagaaaaagagaaattcagggaaattttatatctaaaaactgggactttttacaaggtgggaagtcaccaagaccttgtgttatctgaagttaaattttatccaaatttcaggactaatattgcaatgacaaatattagtaagccacacacattttttccagtgggcaagatcaaatggcttgtgagaaatgttttttttttttttttttaagttagactgtatcctaaaattaagggacaaactatttagtactttgatgttttgccaaatttattaattataacaggtaatattttagagtatttgttactgaatcatcctcctaatttaaaccttctgcattgggataaaaatctcattttgaattaaagcta

SEQ ID NO: 116464 - DNA, 1781 bp, Homo sapiens
ctaacttaaaaaaaaaaaaaaaaaacatttctcacaagccatttgatcttgcccactggaaaaaatgtgtgtggcttactaatatttgtcattgcaatattagtcctgaaatttggataaaatttaacttcagataacacaaggtcttggtgacttcccaccttgtaaaaagtcccagtttttagatataaaatttccctgaatttctctttttctagtaactgaaagaaaggaacagctcttgaataaattttgattaggcaaaaagttttttttttttttttactttattaaaatactgagttttatttcacatgtatatttttgtctccccaccatttccatgtctgaccaccgctagtactatgtcctatcataacattccatacatacttaaaaccaagcaaagggtggagttgatctttaaaaactaaacaggcattttggacaacacattcttggcaatagaacctggacaacatttatcaaacacggtagagaaagttctcactctgcattataaaaaggacagccagatatcaactgttaacagaaatgaaataagacggaaaatttttaacaaattgtttaaactattttcttaaagagacttcctccactgccagagatcttgaatagcctcttggttagtcatccggaagcaattcttcacataattgatgaatttggcttccactttgggaagagaaccacctttttctatacttgcttgcatttttgctttaatgtcttctacagaactaggtccttttggtgttttaggagttttttcctgttttttgaaggattcttgtccttttgatcttggtgttgatggttttgagtcttttccattctgatttgacttttgtgcatttttggctggagtatctcgtatagatttcttcactggcgctttttcttcagcttcctcatcatcaaaatcatcatcatcatcatcttcatcatcatcctcttcatcatcatcgtcatcatcttcatcagcagcaagttttacttttttctgtggaaccttgctaccacctccaggggcagaccgctttccagatatacttcagagtttcacatcctcctcctcttcatcttctgactctgcatcttcctccacagctactaagtgctgtccactaatatgcactggccctgaaccacacttcaaccttaagaccactggtggtgttatttcaaagcccccaagggaaactgttggctgtacagacattttcaaagttgccagtgttactttaattggactgccttcgtaattcatggcctctgcttcaacaatgtgcagttcatcctttgcaccagccctaaactggccgttcttaaggataactggcgctcattttcatcattatccaccttaaagtgatcatctttgtcggcctttagttcacaaccgaaaagatagttctggggcctcagggggctcatgtccatgtccatcgaatcttccatcgggtggcggcacgcacttaggtaggagagaaggcggacggagataaaacaacgctgctgcagagaacagccgcgcaggacggaatcacaccaggcaaaaagttttttttttaaagatatatattttgaaccagagatgaaaatgaattctttttaagatgtaaaaataacattaccctttctgaatatacagtatgtatttttaaagaaactgtattatatttcaatagtttagtaattcttgtcaatgttattaattactttaattatgtctagtacttgcattaatacgtgcatac

SEQ ID NO: 116465 - DNA, 1343 bp, Homo sapiens
gccaaagtccctgcacatttgcaagttataccttggtgcttttccagaaggactatatgggagtgattgtggtagaaatgaaataagcagctgataaatgggtcatttttaattttcattttttatttaaactatcgatctttttattgcaataaaatgtcacaagtaaaaataaagaatttatgacagttttaacgtggtggaaggtagagcaaacaaatggagaaaaaatccaggtgaaggattaataattaaataatgaaactcttaaacttgaaaatatctgtgaactttaacaaaaatatgtataatagatatggatgcaaattccctttgatgcttacatctgagaacccagggaagtgaaaggaacatattaagaaggagacttcatagcaacactggactgagagttaagagaatcaagcccacttcacccctacccaacccaacccttccattagtggatctggctccttctttccttcatttattcagaaatgcttattgagccccctgtatgtcagatacttttctgaatactagggatttggctatgaaaaggataagcaaaattccttttcatagccaaatgtaagctctgttgcatagagcttacatttcagaagagaaaatagatactaggtagacaaatcgacatataaagtttatgttttagatagtgatgttaggataaaaattcagtaggctaagtggtgagagagtacctgatggggcccagtggtatgttttatatagcgtggtcaggagaggcctcagtgaggagctccttgtgttgtctgtaccttttaggaccttagtctcttcatacataaaatgagagcattgctaggtgatcactaaatggctgcaaaattctgttcttcctttaagggacatatcttcggatcagataatcttttgtatgtataagttacggtctttactgtcaactgatctcaaaatgtaataagaatgttcattgattcccaaggttaattccatttttacatttggggaatttaaactgagaataaaatgccttcccaaagattgcataatagtaaaagaaggattaaagctctcaattcctgccactcttagtctgaaaacgtcaccccaccatgtgctataatgagaagttgaattgaaatgtcagggcagttcaaagtagattaaagatgtgtaagctgtgatggactacatatttacaaataaggaattggataagtatatcccactgcactcatttacggcaggcaagtaagccatgtgatatgctttaagccagtaaaatagcaaattccccccaaaagatctataattttaatcaaaagtttgtt

SEQ ID NO: 116466 - DNA, 1049 bp, Homo sapiens
aagggcattatacgttaagaacttccaatccccaaacccccatttaaaaatttagcaagtaatctcaaatacaatgttatttgagttgaaatttctcttttgacattactaatcatttctctgcaagcttaattgagttttcagtgaagggcatttactctatgctctctgaccaatagttgcttaattgaagtgtatgtggaggactggtaaccagaatttgagcttttgaatacacatatacaaagtctttatacatatatatatatatatacacacacacacacacacacacacacacacacacacacacacattttttcccaattttttcttcagttaaagaggacaaatgctttaccctacaatttagaagcataatgtcaggaagtttcagaccttaatctgatgcgccttaaaatagttataaattagggaggtgttcttctcaataactatgttttaaatttgccagtgtgtccctgaaaaaagatcaacaaatctccgttaaaatctgtgccaaaatacttctcaagaactgctagccctctatatttaaaatgtttgcaccattaaaatttcaggaagtttgagaatttcttaagacattaaaatattggaccttttaaaatactaagtgaattacatatatgccttgagattttggcctatggttaactttccccatggagctgaaatattttgtgcttggaattaagccaaatctcccacttgcatgcatttaacttatgttgcatgcatccaagtcctggcatttgaatggtcttttttctttatctgaatgctttctaacttgagggaaaatgatactttccttttaaaacttgcctctctcctctccttcccctctttacccaaagcagatgtctttatactatgtacctacagtcctgtgaggaaagcaggcatcttgatattttccaacacgagaggattgattgcccttgaatacccccaaggcctgggggatttatggatgagctgtagtgagttatatgaaccctttgaaattctgtgtcgaattggta

SEQ ID NO: 116467 - DNA, 1129 bp, Homo sapiens
gatttttttaatagaatctttaggattttctacatacaggaccataacatctatgactaaaaccgtgtacatcttccttcttaatatatatgccattaagttcttttcttgccttactgtactggctgcaacctcatgtacaatgttgaacaggaataatgagagcaactgtagattctgattcatttgccttgaggatctttgttgctgcttctggtcttttgttttcttctgtttttagaaacttacctggacttaatctgcagactcccctcttcaaaatgtagatgttgatagcttggtgggttttttgttttgttttgttttgttttcaattttaattttattttaggtcagctcctagataataacctctttgcctacatagcctaatggtcagagtttttgttcaatcaccccaagctagtaagactctgtggatggatccgtgtttgagttacagagcctattcaaagtttccaagtctgccctagctttccttctctaccaggctatcctgggacttccgtcccagcactcatcctctcagtcagctaggaatgtgcgggagttcatctagtctctcagcctctcactcatttccagaatctccctgttgaatttctagctagtctactggtctaccgctcgccccaagcaagaccacaacctcagactagcagggccggggcttttgtggttggtttcccactgaatttgctttacttgaggataacatgattgggcatgggtttctgtccttctactgtaaatcaagtcagccccttctagcagcgaagctgcaggttttcacagccaatcatgctctggaagcactgctgtgctaccgagctgctcgccacagattgccactgtccttacctgtaatacagcagatttccttgaataaacatttctcagtttgtttttttgcttttggttgatttctggagtgctgaaatggttgtacttgacaattttgccacctttttagttgttcagtggaagaggatttgccaacttcttcacttgccatcttcggaagtcctgcctgggttcatttttgtacatccccaaaccctttatggaacaagatgaaagagcaaacaaataaaataaaacagaaaag

SEQ ID NO: 116468 - DNA, 1020 bp, Homo sapiens
tgttatgacaaaatttaacaagatgacttaaggggactgcatcagaatgcagttgtgtatttgtaataaattttaaattaataaagagtcttaaaggtgctttaaaaaaatttagctatagtttttgcttaagttctatccgtaagtgctaaatactcacgtactactttttcctgtttgctgtcctcacgtttgtacttttctctgaaatcctcttttgattatatatacattttagaaaaaaagtgtatttgtagatttttttcacaaaagtagttgtaatgtacatataagtagagtacaatcctcttgtttcacttttatagatagtaaaagttaattaagggaggaatggaatttctttataattaaatggaatattgtggatatataggcaagaacctaaattttttatgtaaaacaggaattcttgatgcagggatctgatgtgccatatgggaaattaatatgtaagatgattttactgtctatagttggtgtaactccggtgcagtgatatgactaatggggtaaagaaccataaagattgaataatgtacttatcaagactagatcttcaaagtcatatttattgggaaagctccaataggaatattctcctgtgtaagagttgcaggtgaccaggagactatgtggagccataagccatagcccttattggtgggtctcagtaccagcaattttacctgaaatttcatgccttgtaaaaattctgaagggtagaatcttaatgcactccagtgacacacattagaaacaatcaccctgtgtggaattaacttaaaatgaggggaaggagaaggttcaaactaaaaatcatctataattttttttaatctaagatcactttctaataagtaatgtgaatatgtgattatgcagtgtagttcatctgcgcttacagtgagcttaaaaattgcatgtaaagaaatggatttgtagaagggaggctttcagagtttctgaagtgttgggaagcatatttgcacctggcagcac

SEQ ID NO: 116469 - DNA, 1038 bp, Homo sapiens
aaaaaaaaatatgcctctgaatggctgattatactatgcacattgaatcagaatgtcagaatcttctaaataaattgttattatggaataaggcagaacttcaactctgaatttatataattcattccattgtagattttttttcaattgaagaatacatttctcagccataaattgtactgagtatgaacagcagagtcatttgaggttgattgaaaatataggagaacatcatgtttcctgtccttttgttaaacttggcatattgatttttttttttttttttttttttttgcacagcttatagtacagaaatgtgatatacagctatggcaagacaaactaaccacatgtgaatttgttaagtactgctggtttagcagaaattgtctgactgtgcaaatagcaagatttgacttttccaggaactctttatgacttaatcaattaaaataacaagttttgattttattgctcagaataaatcattagcaaaactcattttctcttgatcactcatttgtaggatgtttacattcattttgcttctgtatttcaagcaaagtaataaatatgtagaacttgaaccaaaagttcaaagtcaaatacaggaagataaagatgtaataaatgttatctcttaatagtagtttataaattttgctgagaagaatattctagatttttatttaaatttgccattgctattctttcttattctctttagtgttcatgattttgttctctttagactcaaaggtagcaagatttatacgtggctaatacatctttctgcatttaaatatagaatcttgtagagggtctctgaagtaggactagtttgctcttctcttcaccttattaaacctccttcgtaaatacatctattatatagtttaccttgcccagcttcaaagagtagagatggagaaatgatgagctatcactcagcagagagggttcccatggtttcttagaaatgctaatgtgttacctatcatgtttataaagttctctgaagcagataagccattgtgt

SEQ ID NO: 116470 - DNA, 1208 bp, Homo sapiens
cctactccaaagtgcttagaaaagtaagcataaggaaaatgagaaaagaagctcaacaaattttcggagtgctgaaatagaaaccaaaggattttctatctgtattacttaaaggaagggaaccaaacagataggaaacatgagatgctaaaattttaggttttggagatagatagtagatggatatttggaaatgttcattttgacttaataagcagtttctgcaaggaaataatgtgatcacagcagcttgtaagcataagagcctagcacacatgttttaacaggcagataagaaagggagaatcagagaatcatcaccttgagatgtggtgaaaaagtgcatggaagatataatagtaaaaatagaaggaatatgctggctggaagtggtagaaatgttatctgtggcaaatttaattgattgttctccccagttctgttttgaggagcataataattgcagaggactaaaaaagcacatggtgagtgcaaaaagatgagaatgactaacctatatgtggcttcgggccagttgaacgtctctggatctgtaatcttttaaatattagatggttaggtagatgatttctatactttccagctctaagattcttttctaatgctttaattcagacagaattaaataagcaccctatagcctaggagctcaaacagatcaaatgtttcagcttgtaacagctggtttattttggcctacagacaacagccatggtagaaaactcaggataattttatgaaggttttgacattttaaggaatataaaagttatggagaaatctcctgtgtgggcaggcaagaagtgaggatatccagtgatgctgcaaaaatgaaggagtgctagaaaaagttaagatgagctccacccattgagtttaaagaaatgataggatgtctacagaagacatccaagagagagctgtcagtgttgcctaaagaatggaaatcaggcatctgcatcaggagtgaatcagtaggtttgatttattggcagtaaagtgatagggaaatctcattaatagatggtttccagtgaaatagaaagaggtactaccaaagaacctttagagagatgagaaaaaagctaggaaacattaaataaataaaggtagaaaaataatctgaatcactctttagccaaaaatcagtaacatgttaaggtatgacttctcattaggaagccact

SEQ ID NO: 116471 - DNA, 1033 bp, Homo sapiens
ttttagtgtcttagctttgatgtctataaaagacccattcaaaactggaggtaggtgctcctcatgtgcacaacagaatttggctgaagttatttgaagctattagagataacctttctctacatgtcttttgggagaaaaactggtgccaacaataccagttaagctgtaattagtgtaactaacaactaatatgaaagagcagactagaggtcagtcttaagaatttaaaggtattaacaggttaaggttgtagggcatcctatcccccagcttaatctgttgccttagctggtgagatttgttgaagtcatcagtgccctctaaccttgaggtgttgctctctcataatttgttggtcacatgccaagttcctccttcctgtctactgagatgactttgggaatggcaaattcatttgaaagctcttgtcacaaatgactacagatttttaacctctaaatgtaaatgaaagattatggtttaatttgctttaatattcttgtcctaccagccttagactacattgaaattgtcattttactgcattatagaatatgatttgttgagaacatttaacatgtattgtaagaggaacgcttaaaatctaactattaaatcagatgttgtgtaactgattgttatacatgctgaatattccagtttttatgggctacttcttcaaatttaattgcccaccggtggcttttgtttatgtttacagtcaattctaatgcagttaaaggataagaatgtaacagaggaataacctctcgcttccatgaggtgtagttaacccctttcttctagtatctggctttggcttccttctcttatgtgataccaacacataaacaagaggaatgccccagaactttaatcactctttttcttttcccattaaagtaatatatgtaatgttgttcctgtagttagtttctacctagaaaagctagaaagctttttttcttttaaagcaacaggcagcaagatagcactattgagaaaaagtcaaaaggaaactttttccctt

SEQ ID NO: 116472 - DNA, 1046 bp, Homo sapiens
gccacaattagatctcaggtttctgatacagagaaaagagaaagtgtaggatattgcacataggaagatccaatattataaacactagaactgatccatcacttgactgatgttcgaatctatgattctgaaatagacctcaatgttagcacagtgccccaagtcatttttgctgtatcaaccaattaccacataaagcctgaggcctgctatgtggagggccttcttgcagtactgttcatttcattcagaacctgtaatctctgacatgagcccccttatccacctacctatatcctaagatagcttactggcattggtaccacagaccaggaggacatgtaagcatacggagacttagtctgttagttcttcatattaatcctattttatcttctggtacaaccaatttaatctttttaagggagagctgctaatattttggggttattcttaccagtatttaatttctgtcttgatcatactttcatttggtatctatctttttaacaagtaacagtagattgtaataatctgttttatagaaattctttgggattagcaaggtccttgcatttgtcatctcatttgttcctaagcttcaggcaaaggaatccctaaaatctcattgataaacatgttttattttgaaattgcagtgaaaaataaatatccagaacctagattgttatgcataaattatgtttatatctaattaaattcttacaatgctcttgtttttgttcttttccgcagttctgattttctgtttttcatttctgaaataactttgttgcttatgattttcttgtagtctgccttaaatccctagtggaaagagataggggtattaattcgtccataaattagtcaagcaaactaaaatcactataccagctactgttcttcctcttatatcctcagagaaggtagaaaatatacggttaatgttctttcagtgctttatgtagagcaaacttatttaatacagtagttccccccttatttgcagttttgctttccacaggttcagttacttacagtca

SEQ ID NO: 116473 - DNA, 1079 bp, Homo sapiens
agttatcagttcctctattcattgttgtatgctaccttataattattagttaacgtaagggataagtattgtaaaagttgaccaccaggaactctgtgttttcagtttatcattcataataaatagttgaaatcaggaactctcagaaagttattaattaaagaatcatttaagataacttatctaaatataaaatcttcatttatatagatcactagtatatataatcatttgccctgagtatatatatttcatcaggtcgaatattatcctgtgattttgactttttcagttttccagtaattccaatgaatataagtagtctcactccaaaaatctcacttaaaaaaaattaaaaatagccaccatgttttttacagttttctgaaccaatttgtgaaaactccttcgaagaatttggcagtaaaggtggcaactctcctttcctgagctaactcttttctttaaagataaaaaatttttttaactaattatttttggaatgcttttagataaataactgaataataagaatttgtatttgtacttaaaattataagttttgagttaatatggaaacactattccttttactgcccccataggaatagcttcatggcttttaatgctctgtctgtaattgttggaaaaaataagtcagggaccagtggtacctaagacacacattttcatcccttttatcatatgttaagtcttgatctcccttcctatggctgtctttacttcgcttgccctctgttagctctatctggttcactgcccttggtgggtctctctatgtctgtttattgactctgggtctctttctcatctggcttagcctctatgccatgtctttatggcttccagtttccccgacctgaagactctgtccttccagccatggaatcacatccccccagcccaaatgtttctgtcttctcctgcctgactgtggtgtgcctgggctcacttgcccttcacttccctttgatgtgggctttgtgtctctctcaagccacaagctcactgtctgctctcccctacacattctgtgtgcccccatgtaaaccctctca

SEQ ID NO: 116474 - DNA, 1022 bp, Homo sapiens
agatctttcataggatatgtgtctctgagttccaactcaatgatatgacaggcagtcaaggatgttgtgtgtcctagagaccttagaaaaaaatacttcatgcaaagattttagttggttcttgtgttagatagactctggactgtgggaaaacatgcaagatggcatcctgtgcaaaggagacagagcaatttaaggagcaacagcaggaatggatctgaagatgttcacagggaacaaaggcaagactggactgcctattgaaagggaagaggtgaagagatgagcaggttaggagcagttgggctctaggaagtttaaggatagcactgatttccagcctaaaggctttgtatttgagtcactaggtaagaagagagagtgacatttgttagctttctggttttgactttcacagttctcagccaagtgagcagtggcatctcgttataactgatagcagaaatgggtttgctgtggccatgggtgctggagaatgggtaaaagtttggaacacaaactactttatgttaacaatcacaagtgatagctaatcactgagtacttaaagttgaaaatatgtgtacatatttgaagaaaataatttggagaatagttcagattctaggtatagaactattgttataattaaacgtcactgtcattaatacctaaacttcaactgagcttcactatcattacagctgaattttataagtctataagccagggttcaaccacagagacagaaccactagaagatgtatatgctactatacacacacacagagacagacatatacacacatatactcatgcacatatgtatatatgtgtgtgttcctaaatattatacaattgattttcattatttatgctagttatataatgtgaagtcactgaaaacactgaattagcaaataatcattgctcctagatgaaatacaaggccaggttcctgtgagcttctggtcacatttttgtcagccaatcaatatgtaaacttggtttatgtgtgtttc

SEQ ID NO: 116475 - DNA, 1050 bp, Homo sapiens
tttttcaaacagtcgccttcccctccccacccccaaccacatcacgtattttgtagagcatgtgtcttctttctcaactcccagattgtcaatcacttaatgtttgcttttttttttccttttctttttcttttaaacctatcttacacatgctttttttgttgttgagggagcttgcacgtggcagcatggtctaggcaggaaaggaaaaggaagttattactgctctcttctggccgcctgcaataataaatcataacttgcctttccctaactggtggctggagacttgtcttcataaacgcatgtgacccaagaagtttcagtttacataccctatcccttggtgttcttgcctatggagagccttttccttcctgaaattaaacaaagattgcaagaattgaagctagggcttcaaagcacaggaaaagagaatgttgtcttatcctgttgctacagtggagatccagctggccatgtttacctaaccagggtgtgagactgcttgtccatctgtgaggggctcagcacagtgctaaggcttgctcttaaattttgaacttagaaaccttttgaaatacctcttgtgtgttttcctacatagttatttttagacagtttatacgtttggggtatatgctgaaattgctaagcattgaacagaaggaaactttataagccttacctgtttgccagggtagcattcaacatcgtgttatatatacgatgatcaaattatttcccattcaagccagagcactgtaacagggaaaggagactctattattaattatgccagtttaatagtcataagccaagactgttctgggcaaactggaatctatagtcatcttatttgtacttgattatttcctttacaatatttaatcgaaaccaaatcactttacaaaatcagggaagtaggggtggagatgggagtagaagctgtatgatacttcaaaactggtatcctatcagtatgaattttgatgtcactgaagagcacatagataccacatctaaaaggaaggttacattttagaaatt

SEQ ID NO: 116476 - DNA, 1062 bp, Homo sapiens
caaggttttttcttgcattgattggcctgtccaaggcagcctgatgtgttcttgcattgatcactttgtcttttcttggaagacagtgttacactgagttcatctcaaacattctagggagaaggtaaaactttactgcagatgtctcaattttattcagatgtttcttttgagtataggccctttttgcaaggataagtattgcttttttttccccctaatttggatgtttctgcagtttgagtgcactgaagactagattatatttgaaaaagctacgttaaagaaaattgctagagtatatgccagttatcttgtactatttttgtttttaaaacagtgtatcttgcttccagcttgaaaccattttctttaaagatgatctcttaaacgtagatgtaaactaaaatttactggtgtttgcaataggttaccacttgtctttactaactttatatacattatagattccttagtttcagtgggacatgcattgctttatgtgtttaagaaaatgaggagtttgattagtttcactatgaaacagtggtccaggatgattttcctggtgctattcattattataagtaatactaatatgaatagtacaaatttgtcaaatatggaaatgattaagcagctatatatcaattataggtgaaatatatttcgtaccataaaatagtagtctgttacttggtgacaatggaaatctgaacttgagcatttttcaaccaaatctgtgggaaattgagcaatgaatgttttacagcttagcactctttattggctggtccttaaatcaacatttatatgatctgccaaaaaacatatttgcctacacagctaattatcaagaaaatgcccattacctccaacctattagctatgcatttagtgaggaactggtaagacaaatgtaggattctgtcaagatgtaggacaatatcctcctccagaccagttttctgtttcatcaaagcctatgtgaatttacaaaaaggttacttttggcaaagatttagaaatgtgtcatggctgaatttgattattgtgtggttg

SEQ ID NO: 116477 - DNA, 1105 bp, Homo sapiens
atgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccaagtttaaaccttaactcttttactaactaaatttgttaattctccctactctgcatttaaatattgactgatttgggaattctacctaatcagttactccacattagacagtattacttttttcgttcaggtgtaagacttttataggctccttgttgctggcatgcccagctctcagtctgactgaaaagattgcttctgtatgacacacccttgtaggtatagtcttttcaataaaataagaaaatgactaaactaaattataatataactaaattatcatcataataatatccttacaatgttatatggcagtctatgaaataagtctagaaaactttccatttcatccccaatcggttcagcttcaccttttatttaataattagcttacgttcgcttgtttgcattttttaaacttttttatttctgagataaattttacatacttttatcaagatataatggagatttattaagatttattgaaatatgacttacatgccataaaattcatcctttaaataaaatatacagttcaaagtctttttgcatatttgcagacttgtacaactatcattactatctaattttacaacatttttatcaccccaaaagaaattccatacccattacccatttctccccatacttacaatcctgccagcagtgtatgagggttccactttctgcacatcctcatcagcacttattattatctgtctttttttatattagctatcctagtgggtgtgaagtggcatctcactgtagttttttttttttctttttcatttctctgatgaataatgatgttgagcctctttttatgtgctgttggccatttgtattttttggagaaatgtctactcaaatcctttgctcaattttaattgggttatcatttttatttttgatttttcataggtctttatatattggtacaaatctcttattgata

SEQ ID NO: 116478 - DNA, 1076 bp, Homo sapiens
gggtggcggaagcggggagggatagctttaggagatatacctaatgctaaatgacgagttaatgggtgcagcacaccagcatggcacatgtatacatgtgtaactaacctgcacattgtgcacatgtaccctaaaacttaaagtataataataataaaataaagtaaaaatacatgcaatgttacgtatgctgctgttcatatctctatgagaactgaaatttcaaccaacaaaattactacaatgaccagcaagatataatggataagtcatatcatacctcttgggccaggttttttcctctgtaaaatacataggaatgcaaataggcaggaggccatgatttctaaacttctgtcattccctgaaataatgaaataatttttatttaaatattcattcttctattcttaaaatgagctactttgctaagcattttcactcgttttaataaaggaaaaggaataccaggtttcattttatctgtcagtctgtctataacagtccctgaaatataaaaatacttaactgggtccatctgacaaaatgaatgaattccactttgcccttagtgttaatcttagagaacacactctcagaggggaaaaaaataaaaagaagaagaaccaatcaatgactaagaatccctaatatttaatgtaaacatacttaatagaaaatatactgatttaattttaaaaatttgcttgtaaatattggagattaaatttatttaagtaggatatttcataccacagtacagttgccttcacaaaacatatctagagggaatattttgctgagttagttacagtatgaaaaaatgttcatattgactccaaatgttaaatatatatggtattaatcttgcccattctgctacttgcaaataacagccattagatatgatttcaaaaagagtctaaattttaatttctagaacatgttcatcacaagtttgatggcgagttccagaaatacaccattacatccctgtaatgtagttaagaataaaaaaacttcactgctcacaggcaaccatagagcagaggacttagtgacattctctaatcagc

SEQ ID NO: 116479 - DNA, 1017 bp, Homo sapiens
cacgttataagtgcctagctgaaatgccacctcttcctctcactataaccgatgacccctccttactgagactcatggaatgtataatgattagctaatttacatggaatttaccaggtactgtcttgatatgtctcttgtatttttgtctaataatttaattaatattaccaattattttcatgcctctccactagatctccccataatcctttagatctttgagcgtgctttatatgttttggcattgcatgtcaatccttaaaagcagatatgtgctgctttttgcattagtacagagcatattatgagggagtcaggaactgatactagaatttaatcccttggatggagaacaaaacaacaagattaggcctaagtgatacctagataaaggaacctgcagcataggaatgaaggttattctgttatcaaactggagcataagaggacaactaaatcaaggaaggtcagttaatagaattttagagactatgtgtagagtataggcaaaagtgacttgatgctgatctgtctaatgttgggttggaagtgcttgaacatctctttcctaaagtgagacttatttgtagactctactgatgggaagtaaaggagaagaattagacccagcctctgaaagaaagcaaaaacagatgctaaggatagaggggaagagaattacatggacacaaaacgaaaagtccaaatgttaaagaaacatttacagaatagaaatcttagcaaagcctggaattgcacatagagatgcttaaatatttatcaattatttgttgacatccgtcaaaaatcttattctttaatatgtaagatagttggtgttgcctagttttctgattgatttttttcagcattcatgtgaatttttgcaatagtttagaaacagccaactctgataaactaaagctttctttccaaaaatatgtttttgatgttctgactggggtatgttcacagttctgaatctcttctgtgcaaatgccattgaagtcattt

SEQ ID NO: 116480 - DNA, 1050 bp, Homo sapiens
gattacttgtagattttcttagaatgggctcatacaggaatgaaggctaaacaaagacagcaagatatgtgaagttaaacagtgggcaaaaaggactatgtgcttccttttcacggtaaatcttataagtattcaaccaaactctactccataaagtcgtctgaagaaaaactcactctctcctaatcccagtcttaaaacaaaagacaaggtccattattacttcaacagcatagagaaaaggaaatgagaaggggacaagggttgctacagtttgacatggggcaattaatcttccagtaagcgttgtcaggcagaaatgaacacaaatggatcactcacattaaccagaggagtgtaggtagggattttaacaagcatttacgagagtccattttctcactaatgaagaggggaataaacgaaccagtgtaagctagcattatgtacttaaagttgtgtccttttggctaaagacgcctcttcacattcttgacatttctagtagagcctgtatgatctaagccagggctggaagggttgaaattctaaggttggcttagaactatgcatggcttacttcagagccctgtgtcactgtgttcattagtttaaaatccccattaacccttcccttccacataacaactatcttcaatattatttcacatcagaactgagatgggcatacagctttttttctactttaaacatttctaaaaaggaaatttaaaatagaattttaaaattaggattacctaatcattgtgtgtttttaaaagaccacatgtcaaaattgtctattcattaatttttgcccatgatagattattaatgaaaagaacattattaagtgcacatgaaagtaattctgttgctgctggctgatactagatgaacatatttttataatttacgtggtaaataatgtatttgatgtttaaattgcttaagagatagaaaaacatgatcattaggaagctagtttcctggctaaatagcacagatttaataattatcccatttgtttttaaactaaaaatatttcta

SEQ ID NO: 116481 - DNA, 1469 bp, Homo sapiens
acagaggaagtatgctaagtaatctgctaaggactcttaagagccaaatttctatcagtttctcaagagacattttgtgggactaagtctttaattcataaagttaattcagtaaattttgcaacagttgtatattgctgagcagtgaaacaaacccaaagagattttgcaagtgttgagagggaaagggatgaggtaacaatctatttcaaataggaaattcaagtcactcaactaagtatggttgaatatcacatattttaaatagactagctgacacagtggtgtgtggttttcccccccccagaggtagtatagaacttctaattggcatgttaagaacagatatagtaaaaattagttgaaactacttttaaggagtcatagtttatgctaagaagaatcttataaaaagaaattgtattaaagtgttgtttgcaagtgaattaaaagtgaaattgtagttttacttttgtgtgaaaagtattctttttgtattctcttttgtatgcatccatagagtgaactctgcatctcatatagggcttctatttaatagtgcttgccaagtctttatcactatagatctaaagcagttcggagcattgtttgatttgaagcagttccctgtgtataattgcactttgagtctttgcctctctttggctgaaaacctagcttattgcagctaagagaatctcacacaaaaaatgcaagttgtccttgtgcataaaagcagattctgcacttcaacaccttttcaaattaatatttgtgatgggtctattctctgcctctgagtttctgttctcttgctttgttcctgtgtttgatgtaatgtaagcaaggacaaaaaggagagctgggagagtgtgtgaaaatggtagttaagtgggcttaaggggtgcttcagcactttctgaaaggattcatgagtgaataggccttcagagtgcttagctgtagtgctgtaaatagacaggtccagcacaaagctgcagatgaaatgagcacatgcatatcaccccttgtgacatctggccaaccctggaatataatttcacttcttcagcctcaaccaaacatttcccgaatgctctggcggttaaaatcttttgtttggttaattgcaatgagtataatatacaagtctcttggaggtctgctgtggacgattggacaattgaaagatttaatgagatactgccagttactcataataaggtttcttttctgcttggtagtttctgaggttttgtgataacataaaactccttaatgttccagcaaaaagacaaaatgagaattggagtatacatttgtctggtgatatctttttgcttatttcaatcaagaaaagtgttgtagtttttttgatgatgttgctgctgttatgagttgtatattattgttgaggttctagttttttaaattttggagcctggaagatggtctttatgattatgtga

SEQ ID NO: 116482 - DNA, 1058 bp, Homo sapiens
ggagtaagctctgggtcacaaaaagcatggcaggagtagtttaatgaaaattataactttttgtttgttttgatccgggatattttggacactcctgcctagtgatatttgggaggaaatcaagtgatttcatttgagttatatggcttgcttttatacactaaattatcctactgtttatatgccaacctatactttccctttatgtattaggaacttgatgtaagatggaaaaagctttaaagtatgcaagcgctgatagactgaaaatctgatgctctaatcacttcttggaattttatttaattaatattgtgcggaatatggaagtttatactttctaaggaaaatgttaatgtattttttaatcatttattgtattgttcaatttaagagggaaaaaatgagcatatgtcgcagtagttgcaaaaacttgcaaacagtattaacccttgggctcacgtgtcattttgtattgggaaccataaaatagttgggattttacttttgaagaaaatgttaaaatgtaaactcattttagtcattgaaatgctagttaattccattttccttccttttaacatgaattaccttttttgaaattattagtattcctattagacttagcattcatctaacatgtttcaggttgtcttttgtccacaatgcttagtaccagaagtgttttggtttttggattttttcagattttgcagtatttgcatatacataatgagttttcttggggatgggacccaagtctaaacacaaaattcatttacatttcacatacaccttatacacatggcctgaaagtaactttatacagtgtttttagtaattttgtacatgaaataaagtttggacccatcacatgaagtcaggtgtggaaatctgcacttggggaattgtgcagtccacaaaagtctgtcatgtcagtactcaaaaagtttaggattttggagcattacggatttcagatttttggattagggatgctcaatctgtagtatctcttttgcttccaacttgatagttatgacaatggattttttatt

SEQ ID NO: 116483 - DNA, 1080 bp, Homo sapiens
aggcttttttaaaagtgtgcagatttcttggattttatttctgtaactcataatgtcttaaaattgtcataatgtcttatgagttacagaaacaaaattaatcattcactggagtatctcttattaggattattttcacagcagggacttatacagaagacccctactttattactctgactctttggctgactctcagaatcattggcagagtcaacgtcaagcagcagattgtgtgcctttaccatacacagtagcatcccaaaccatactttaaatttgaggttacccttacatgtgtgcatgcatgctcatatatctatataaaatacgtagacagcaagagagtaagcacctaaaatcttttgaaataaagtgttactatttgctaatactaatgtcaagggcagcaagggagaattatgcagcataagtacttggggagacaaggtagagcacttcacaggtcttcttttcttgtgtactgaagattcatttttcctcaaaaattttgctccgattcctggcttactaaaaatgctttaatcaattagcaaacttagcagagtctttttggggttagcagaaagtagggtaccagattatcttttcagttattgcatgtctaatgtaagtaagtcttaatgcactgaacatgtaaataattgtaagactttatttacatgttagcttaacattagcatatactaagaatttttttctgtcattttgaaaattttgcctcttaggcaaaattaggataaaaacaaatgttttatttgtgacactcaatatttgtgacactcaatatttttacaaattgctgtacatttttccacttttttttgaggcagagaaggcagtagttattatccccattatacagatgtggaaattcagacctcgagtattttaagggatttgcccaagatgtcataaatagtaaatggccaagatgaaagtttaaaccaaattttctgaattcaaatttagttcatactctttcaaccatctcatagcctctcctttttatgctggcaattaaaaaaaaatcactgatggtttatttgtcaaaaatat

SEQ ID NO: 116484 - DNA, 3611 bp, Homo sapiens
ttctgaacattttgggagcaagcaaattatgataaaatatcaaaattgatgagtttactgcagagtgtgaagaaccagagtaaattagaattctgctcactaagtgcctcagagcttattccaactgactcatcaaatgaaaaattcatcaattaatcctctgacaataacgatatatacacaaaaatcaatctagaattgatttttttagtctgaacatgaaaactaagctctgacttatacataatgtgaaatttctcttcatttcgactttattattgagtataacagctgaagtgttcatataattatttgttctgtgtcaactacaaaagtgtgattgtttgagaaagagtatatgtgctgtggagatgttctgaagcacaatccgagtgagctaataaagttgtcagatgcatgtaagaatacagctgataggaatccctagaaggcagccaatagagagggacactgatcactaagccctgatgggagaccacccaggacagttaacagtgagctgagtactgaggaagatcaaagaaagagaagtgtaacatacaatcactcagatctcagacacggattaaaaagaacattgtaggagtgtgatttctatgaaatgtgtttgtgtgtatgtgtgtgtgtgtgtgtgtgtgtgtggtgactaatgccacaaacaacatgaactgtagaaaggtgaaccttttcctattttgtctcatctacttgctagatataaatgctttagaatgcactaagcattgaaatgatcttcttgctttaattcaataattctgtgtacttcttcatagatttccaaagaagccttctttcaagcttttttctagttgttaagtttctttcttccatgtaacatatgtgaatatctcaagagaataatccaagacaaatattagtgggttttggtttcgattaaagaaatcttgacaaaatgtattccgatatattactacaaaggaaaacaatcgcaagggtctaattgaaatttacagtattctgagtctttttacctacaaatttagtggtttcaaaacctatattattgctgctagattcttaatttccataatatagattctactttgaattttttcagactgtattagaaagttctctgtattcctaaagagaacttaatattgctctaaatgctgtaagtcagcacactgtaacaaaaagaaacgtactcttccagtatacagtaatgttaaacaacaatgagaggattcaggggaaatgttaagctagagaacgctgtcagtattacttatcttacatgtagtaaattttgatgactctcttctgaatgtgaattcttgtaggaaatgaacattaaactgtttttatgttttatagatgttcaaaaaaaagctgaatacatatgattctgaagctattagaattttttcccctgtcacaatagcagtaagaaaattgcaatataaatgtcttcttgagtgcatagcatatgaaataatgtgttttttccctgtagtttaaaatgttaactgtattttaggtctcattctttgtatatgccttgacaattatgattgcttgattaaagaaagagcttttgtgctagttatgtgtcacaataccacatatattatatctgaacagtatttatcatgttctatttcggatcaggtcagatatgtcttgtgaagaactaaagtagtatagtatgtattgttaaaatcttttgttactaaaatatttatggcatgtttcttgctgtcttttttaagcaatgtggaaaatgcttattttacctaagtagtttacccaataaaatactctacatatttgtttaaagcaccttaaatagtttagatttttttctgaacatttttagaatcatactgtaaaaggacatatgttactgcatttaaaaaaatgttcatctatacttttttcagcattttggtctttatattcttttgtatcagatgtgtttttcaaggctttaagaagatcatatagttatataattgcccccccatggaaatatactttatcagagaataggtaataaagagtaatgtgtaaataagtatatcagtacatgtaagtttattttctgccctgtatgtctactacaaagttgtattttgttttgtcatttaattttattgtgataaatatataataaatgaatgaagtcagtgatatatatatatatggctagtatagaatagatgcacctgtattagcagacagctatgtcaatgtagttacaaatgtttgaatatatttaaaagtaaggaagttagatttttttataattcctatagttaatacttattctgtttatgtgcaatctttttcatcacaataaatttgtatagctaagaattagtcattttgttaataatagataattatctttctctgcaaaaatttttaaaaccctctttaagacttaaaatattgttatatacaattatataatatccagtagaaaaagaattacattggttttgttctttattctatattttaatttaagtaggggggctttcatattttcaacaaaaaaactgaaaattttaataggaaaaggaaaccttaatttttttcaagaggattattttaggcttttgaaaatagtaaattagttttatattatacctcctatagtttttacttaccaattctatttttaaatgttagactataactaatttatgggcagcagggggcagaggtgatcatggggaaataaaaaggtttgttttaggatagagcatgagagcttgattttagggaacatgagtttaatgctctgtagatataatacgtttgtagagatcaataacatttttttttcatttttcaagattgtccatttttacctttgttaattctggttcattcataaaataaaaataattgacaagttaatcatacatctcaattcaatttcatttattcagcggtgctattacttaagagttaactgttttgtacatactttgacattaattatctcttaaaattactaactgttattctccactgaagtgcacattaggaaagggaaacttattcatatgtccattaaatattttccatagcaaataacttcttgtgatatgtcattaagtaatgatttttcttaatattcaattattttgctatataattaaaatatatttgaaaatttataggtatacttcttattcacaatttctctatcagtgtggctttcttttatgaaggcctttcaaaaagcttttgttattttgtcagaaaaaaatttcagattctgaagtttgaaatgtaagacgtctcgttcattctagcagcattcttagaagataaattcccaacttcttcactcctaatttctttatacaatagctcttacattttttttaaacatggaggaaagtttggtttttagaaggacaattctgtaaagtttgaaaatgatgcttttaagtgaaataacacctcacattcattagaattctcctacttttgttttaataatctctttacctaaaaatggaatttattaggtaacataccctcaccttattagttttcagttgaaagtaacctttgtagaaattgtaaaa

SEQ ID NO: 116485 - DNA, 1010 bp, Homo sapiens
tggttagtgctcaaataatctagacttttttttatccttttctaaggaagtaagcaataggacagcaaaactgactggaaatcagtttttcattcggctcatgctccaagctgttctcttgtatagatgctatcgttattggctctagtatccgaggaggacaaagtaatgaaggaaagtgacaaggtcatagaggtagaaaaggggacgcttgcaagaatagagaagtaggaggttatatgagtcttagctgaacatgaccccttgctccctgtccttgatgctgatagttctgtgaagacagttcacagcactgggagagtaagagcatcaaaactgacttttctcctggccgacagaaaatcttgttgattagtttaaacacagaaggaggcttttccagcccctttgactatagaaactctacatatgggacccttttaggaagattaagtgtggggaatcagagcaatatgccacatctgctctcaccagccttagaattagggcaaggacttagcaccagaagtacagagaaaaaggagactatggggaaaataataaacgtaaagatgttattgaaaagaataacctaaaagcaaactccagagggagaagaaattatctctgaaagaactttgatacagttagttatgacagttgtttattaacttaaattttccaaagtaatatgtatgctaaatttttttttaaaaaaatggtcttcctttacatgaaaaataaatgcatagaagatcttagaggtgtggcagattacctttggaaaacacagctatattctaagatgttgtgttcagtaaggaatatgaagaagaaaaagaaatatgaagaattatttgcttgtctttattcttgtgaggcacttgaaagtatactatgaaattttaaattttttagcaagtatggtatttgggcaataaaatgcatttaatatttcttagaaaatatttaggatttttaagttttttttgtttatcatgggaatatgc

SEQ ID NO: 116486 - DNA, 1035 bp, Homo sapiens
taatagattaagacattacattttataacaatttaaactgtattattctatggggggaaatgctaagtgttcttttttttaatgaccataccttttgaaaattttgaaaattttcagttattgctaatgtaagattgatcaccttaatgaggtggtagttagtcaggagaaacattcagagcgattttacatttgacagtatccaaggtctacatttattttatactccttgagagcacagaatagagtctgtgcatgagtgatgattaagttatttctttcagtaagctaaagtggactaagaaaaagcagaggtcttctcagaagcctatattatgtaatactttaacaatgttgcatgcccagctatttttgaattacatattccctccccctgaccctccagctaaatcctccgggtagttactgaacaagtcattcaacactttagagttttgtggatctactcttatttgtttcttatttgctgtttgtttcctattcactacttggttctcctggctcttggttttctttctctatatcttctgccatcctgaaaacatttgttggtaatatatattggcaaatgagacaattattggttatgggataccctagctcttttggtgatattaagagctttttcagtggttacaaattggcactctctctgccattctctgtcttacaagtaggaatccaaatgacccatataccagtcttcattaagaatattcacttccatttatctggttatccattcagtatacatttcctgagggattgcaggaagcagtggcatatggtagttaaaacttgggcattaaatcatggatttaataccagtttctgtatgaaacatgccagttatttaacctttttttcttttgcttccttgctcccttcttcacacccttttgttttttcactttttcccttaagggtttgttagtggtttcaaaaatgatctatgaaagcatgttaatttttcatcgtgtagctacaagtagaataatcgaggttctctgaaga

SEQ ID NO: 116487 - DNA, 1022 bp, Homo sapiens
cgtattatcaagcatatttataatcgcctttgaaatgattttgaattccatgaaaatgcagtagtgggaaatttcacatcccctttccagtaagagatcttggatacatacactttatgagtaactggtggtcagctgtgattctagagataaagtattgatatgtttctagacctctgaatttgagactaattaaaaagtccaaaatcaatttgaatgtagattgcgctgaagtgagtgtcatttcttgtctggtcatgtaagcatcataaccctgctgattagtgaagatcaggttgagactgcagctgtctctgacaatgtgatgtttttacttgcaatacttgctagtctgtttatgaacactcttcaactgatatactcatgcctaggttaagaatgtatgtcaagtgacataactgctgactaccagtttgaatagaataattttgaatttatgtagttgataaattcatttcttttctgtttgattttgtcttgggaatgcttctgagaatttgtacctaaaagagtttatttctgaaagggtccagtttaagttttatttcctccagttttacaacaggtttaactttacatttatttttttttctgagttgtaagaaaaatgaaattttatgttgctttactttttttgtgagtaaatttcttttagcaatgttttttacttttctctagcatgaataagccaataattatactttcctaaagcaacttgctgcccttatacactctatgattctgttgttggcacacttgttttttctagtctcttgcatgcagaattttagatttttacagtataaaattataggcaagtagccagctgtcacattcttgaggtcagatacaactaccatatatgagatacactgttttggcttcatactacttgccagattgctaagcagatgttctaggctataattcaggaaactgggacctcttgaaacattccctgagagtcgcttttgacatctctgaatcatttatttaaaggt

SEQ ID NO: 116488 - DNA, 1046 bp, Homo sapiens
agtaatgccatctagctgcttatgaaaaattaatatttatgtagtctaaacagagtgtggagtatggcaaaagattcttgtttaagggctcagagaaaaaatatgaaaattacttggcacttttaaatatacctttgttcaaatgacttacagactttgatgctttttttgatagtcattgaaagtatttgtgaaaattaaagagatacttattaaaacaagctaccatttttcaacatatcagattggcaaattataaattacttgttaataaattgataatatcatatttaaatattagtgaaaatgtaaattggagtaatcattttagatggcaggttagtaatatcttccaaaatttaacatgtacactaatctttgaccttaaatttcattcgtaagaatttacaccagagcagtgcatgaagtatacatagggatgctcataacagcagtttataataacacaaaacattctaaccaactaaacatccaccagtagggaacattttattttatgatggcatattcatatcatggaagactatgtagttattaaaaataacaagttgtatgtgtatatatgtgtgttcataaatctggaatgatgtctaagagttaccagataaaaacagaaaaatgagctaatttgtttaaaaagtacacttacacatgtacacatctacagctacatacatacatggatacacattaatgttcctggaagtttatgcaagaaaccacgaagtttcttcttttagatttcattttcagtttttctctttatttttgttttattttttctttgagtaggttttactttaatatttaaaaagatattacttttataattaatatattttaaatagtcatgaaatatgattattgtgatcttgtagttattgacttaactatttctaagtgaacttaacatgtaataaatgtttgagtataaaactgcaagcagctcctttgaatgattattgggtttttttttcccttaaagagtggttgaatttaagccactgaaatttatatttcaaaaa

SEQ ID NO: 116489 - DNA, 1018 bp, Homo sapiens
cagcccagctcctaaaaaacattttggttaatagattttgaaacccttaaaatgctaaaagtagaatttcttaggttaactatatgtttttttttcccactttttgtggataggcaaagaatggaaagatactacttttgatctggttgctaatttcgacagtgtatattttagtagaattgaagtaacaaaaataaattgaagtttagactaaattaactcacataaaatattatgtttaaactgtttcggatttcaggttttaaatagtgaaatgaactttctctctgacacatttgtttgtagttagaacagatcctgtctatgtattttcggaagaacattatatgtaaaatgtgttcacaatttgatgaatatttgaaaatataacttagtaaagaaaatcggatgctttcaacatgcagtgctaggtgaaatattttatgtagttatgttgtccctgctatagatcacctaagcctttcctattctggaatattttattgttgtgtaaagatttcgcagggaaagtctatatggaaaaccatgccaaacatgtttgtttgaacaaactttgtggtgatatcccaaacaggagggaggaagtttgtcagtaacattacaatagtaagtcattttgttcttataagtaggaatagtgttttggggataacagcatttcactgtcttgatttttttcttcttaaaaaaatggcaattcatgattccttgaaaagaagcagctgatttctaagcatgcagcacacgtaaaaattttagtttatgtatttaattctccttatttcttaaaaaaatgaatatgaacattattatggtaattttcttcctggtgatttagaaacagatcacttttaaatctggataaagtgattttactactttgactttaccttttcatagtgttttcttcaagggttgctctgtggatggggaggtgttggttgagggaaagatgatggtattttaagatgcaggcagaggaagactaataaacagg

SEQ ID NO: 116490 - DNA, 1063 bp, Homo sapiens
ctccctaagcctcaatttcttcatctataaatcaatataataatagtaccacctaaatgggttgttattgaatgagataatgtttttacaacaggtagcatagcagctagactataggaggcactaaaaaagtagttatttttatttacaatgataatataatactaaatatacaataataatgaagagaaacatattaccaatattttttgtatttttatatttaaattactatcatgtcttgtcccatccaactaatatataattgttaacctctactgaatattttaattttgtgttaaaattgttttttacttctataattctatagtaaccatttaatactttgtaacagccattagttgttttttcatttatgtgtatgcctgatcagaagacatttatttattatttaattttatttaattacaggtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgtaagtacaatttcctgggtttttttttttggcattttatagtactgttttattatatgtttttatgtttcttcaaaaagtatatcctaagcataatcttatctttgggttgttattatttattttacttgtatgaaagattattctgcattattttgcagttacaaagaaacacaaagtggcatcttgagcatacaaagatttaaataatgtcttttgagtgaattatttttctaaaatatttttaatcctgtgaaatatgacagggttaatattttctaaaaatatttttaatcctgtgaaatatcaattatcaaactatcaaatatttatcaacattattgaaaataacttctgacaaaaatatcatgactgcttttgtaaacctttgcctacctaatttggtaaagttagaaactaaaggagatctgctactttg

SEQ ID NO: 116491 - DNA, 1020 bp, Homo sapiens
gacattctacctgtatttgaagacctagttgagaaatctcactgaaaccttctaaacctcttctagcccacagatagttttcatgtttccaaaatcattctagactttattgtctatatgaatccccagtggcagatttttagactgttgacatatttcaatctcgattgtttagcttcctgaaaagttgcttaacttcttaatatttatgcttttactcctcaggtaacctctaagcttcttgaggactgggcccatgttcatggcaatagctagagaggtctttatacatattaggccttaaaatattgttagtttgctttagattagagacatgaaggtcaagaagaataacttttgagtagttggggaccattagtagttacataatctgtatgtttgcatcatagtgacatctgaagaaaaaaatctaatgaaaaagataaactgttctgagaaagttattttaaatttttatcagacattctttgttgtactgtttatattattgtcaatatactttgaagtatagcaatattgtttgtttatcttcttagagggacagttaagacacataaaaactggggaaccatttgtttttaactaccgggaagatttacacagatggaaccagaaaagatacgaggctctaggagaggtatgtcacatatactactttaactttgtttttcccaattttaaatattcagaataaaagttttgaagatgcagcagtttatgcactctttctacaaaatgtgattccaaaaaggtttttgttttttttttttgttcctttttagtggttatgttagaagcatattctcagtttaaaagttcctgttcagtggctcacgcctgtaattacagcactctgggaggccgaggcaggtggatcacgaggtcaagagatccagaccagcctggctaacatggtgaaaccctgtctccactaaaaatacaaaaagtagctgggtgtggttgcatgcgcgtgtagtcccagctacttggaaggctgag

SEQ ID NO: 116492 - DNA, 1005 bp, Homo sapiens
tgaaataatttttgctagttagcgtgttttattttaacagttttccccctaaaaatggaataatatgctatattaatactatttacatttataagtttctttattcgtaaatgtttcagttatatataagatttgatgacttttgaaaagtcatattaatgtctgaaacttttaaatgaggttaataaggtacaaattaatagctgtctattttgaagggaagaagttaaatataatggtgtatagaatctgagttgtagttgtttttagaattatgattttcaaggtgcttatgttaatactgtgcttgatcataatatagtattttgggaattcaatttagtagcattatcagttaaagcaacacataaaaattaatagaacaaagaatactttaaattaaattaaattaaaatctttgttacaaactatgaaaatgaatataagtaaatttcatatcatttcttttctagatttattatctaggatagatttggatgaactaatgaaaaaagatgaaccgcctcttgattttcctgataccctggaaggatttgaatatgcttttaatgaaagtaagtgggttatctatctatctatctatctatctatctatctatctatctatagtatatgcaaaatttatttatcagtgctcatagaataataagacagatattatttgctacttttaaaggccaagtagaatgttttctgtattcttttgagaaatagtgacatccttgcatggtgaaattcttcattcaagtgaaagaaccaagtaacaagtaacaattttctgtagttgtcaagttacgtgaactaatggtcatgaatttgattcagcttatgcatttcaaccttgagcgttcaactccctggtatccaatttgaactcctaattaaattatagagaaagatgctactgtttcacatgttatttagaataaagtgtctggcaataattatctgtgacaatgttttaaagtagttttccatgatttt

SEQ ID NO: 116493 - DNA, 1079 bp, Homo sapiens
atgtttggaattatttcagaactttccagaagcctggcatctattgtatagtatataactaccattacaatagaaaccagaattgtgaaagagctcctttctattccctttcagttctgtgattttgtgtttggaatcttcgtttaaacttgctttattagaatatgtttgtatacttagttatctgcaaaaggtaagcactggaggcttacagcttactctgggatccctctgcagtgtgtgtgtgtgtgtgtgtgtgtgtgtgtgtgtgtgtgtgtgtgtgtataaacggttttaaaccaatagttattaaaatatatgagtatttttagtaaaaacaaaaccccttaaccacatcgagagctatgccacaggtttttaaaaagctgtccgaatttatcgatatccagatttcaggtatttatttaaagacaaaatagtacctgcggtcttctagcaaactgagtggataatatttcaaaggaacaaaaataaagacatttaaagttaagcataggcctttaaatatattcttagactaagcgatagtgctagttctttgtcagtccaggcagctttataattttctcactgctgatttgtgtaccaataaaggacacttgaaacaacatctgtttttcagtgaaaggaagtttaactctcatgcagaaaaagcagtattttcagcatttgtcacttaaacaaatagaaatgagtttaacaaaatgtttggttcagacaaagcaccaaataaatgttttatgcttgttttattcttattctaacatcaagtcctccctccagtggctgctgttacagcattttcctttttcaccttattttggaaaaacaaggaaaatcattattttttctcggaattgaagtccatttttacatcatgttgaaggactgagagataaccgtctgtgggaaactttcttttataattaaatgaacccatcctttagcaaccaaagggacagattattctgaattgaattctcagccttcatttttcgtttgcaaggtgcttataactgccccttagcccagcattttaaaaaatttaatttcttata

SEQ ID NO: 116494 - DNA, 1031 bp, Homo sapiens
gcagattaatgtactaattgatagctagtcttttttgttgttgttaatcagcagttagattatttgtgatctagtagagcacggtttcctatatattacttttaaagttgagtcatctgaaattttttaaaaacttgaagaaatgtatcagaaggacctcaatgaagacttttagattatatatcttaaatgactgagcaaacaacacaggtatataaaagtagaaggaaagatgaaatgaaaggttatagaaaaataatatacctgtgttcatgttttaagaagatgcaatacaggttttccccctatatttagaaaagagttcaattgaaaatatttaccttctaataagatttatcacagatttaaagagctgtgtcctttagaacattttaaacaatgaatttacccataacctgctacattgaggtatttgtagggctgtagagttaaaggatgtttcaattaggtataaaaagcaaaggagcatctaatagaacttaaactattagatatatattcatccataattatgtgtgtatatatgttcctactgttttctaggcatggtgaaagcattttggtagacatctttttagttgaaaatagaaaaatctaggacagaatccatatttgaggaactaagtataatatttgaattataagcatttaattaagttttttacttacagaactgaaatggaataacattatagaaatttacagataagatttcaagaaaatgtataacagaaaaatgaaagacacaaaaataagacttggagttatgtgttggcaaggaacataattacaagtagtgacattagagttagtcctagatagtcatgatatatcaggaaccatgctatccaaactttgctgtggcacaggaagatacatcatgatttttaaatgaagaaatttcaagcacaaggatatgtacatagatggtaaagacctaagagcagagggaaatatcatatttagaagttttatcatagctcaccgtagccttgacctctcaggctcaa

SEQ ID NO: 116495 - DNA, 1062 bp, Homo sapiens
ggggaagagagaaatacagaaagcaagtagactacttaggcaaatgagattttcagtaataaaagagaacagacttctattcctcaatctttctttccatcttcacctcatatttatctccaaacaaaaccatatttctacattgtttgtcaatatttgaatttatcaatttgaaaaaaatatttttaactcttcacaactcccacactaagcctaaggccaaatctttgttctgttgaatcccttttctccattcccacccattggccttttctttgccctgatgtgtttctcatgttggtttctcctctggcctatgtgcaacgtacctgccagatggacatttctgcattatgcacacttggtccatcttttatttttactactttcattagcttctgctttcctttagtaatagattcagatttattttccactctgcctttatcttctcttgattgccattttttgagccttcttttccttttccttgaccatcattccatcttgttgtctgatcccctgaacacttgtcacctggcactttctggcaacttccaaagccacccctctgaaactttcacttttcttctcttgtctttaaaaaaacttggctgctgtatttcattaatgaatatgaataggaagcaagttaatgtcactttaatattttgatttagattatcctcatcttgaccaaatgttgcatttcatgtgtataattcaaaatatttcagtgttgtctattttttcttattttgttttgttgtttgtttgttggttgttttttcctcaaaactcaggctaggccctcacatgaacgtagagaaaagagtttgcctgggcaatatgatttgaagggtgtcttaaagctcagtaactggtcacagttactcaagtacttattattctctgcctttcaattgaattgaggcattttaacttctaaaatgctaaaataatttcttaagccactaggagccatgaagacatcagacagggttatatttacaaggagggtaggaagaaatttggtttgattgaggcaagaataaagatggc

SEQ ID NO: 116496 - DNA, 1041 bp, Homo sapiens
aagtaattatctgacatatcctggaagcatgtaatgaagaaatcataaacctagaaacgaccccaagagttctagtctagcaaactacttcctagaaggaactacatctaaagtctcttatagagagtatttatttttatcttaaatatctgaaggaaagacatttctttaactgcccctgttaatctctcccagtactccatatggaaatattgtaattggtgtaaattttttagttgtcacatgtgtccctttttttctttttagaaagaaaatacagcattttttcatttatttgagcattccacaaatttataaaacaactaaattgaacgagataggtaggtaggtaggtagacagatctttaattgtcacagagagatgaatattaacttcttacaagtgaacacaagataaaaatttagagtagtggttcttacctctcttttgaaacaggaactcctttgaagttctaagaagagctctgcctagaaacatgtaacatacgtatctacctccagaacttgccaacactttcaggaggttcatggcccctggaagcctcctaggttgataagcactaatctggcaggaagaagccatccctgaaatattgggtgttcagtacatttcctcatatgttgaagaaggcaaattatcatcaaagctcaaataatatcaaacacgaatttattaataatactttaaaaatcagaagatgaaaattaaactatattgcctatgtaattatactgtaaatctgtgcagcataagagtgctatatttcacctgagaataagcattacatgattttaattttttctagcttttaacaaataaagttgagcagtgaatttacattttctaataaccttgcacagaatattcatatacaagaaaagatagtgattatcctaactgctataggagttagtgatgagatcagcccatagagctcagaaggctattctttgaggaaccccaataccagagatttaataatagagacatgaataggaaagagatgactgcattaaaat

SEQ ID NO: 116497 - DNA, 1104 bp, Homo sapiens
ttatcatcttatctgggaagaagtagaatttgacctgcaatttgaaggaagaaacttcatctagatgggtgaagatttacagggatagttgttagtgtagagcaaaagatgcgagcaaggagccaaagatgaaaaaaaagcatatcgcattttggagaccatgaacaaatcatttgttgaaatagaagaaatcaaggctagaaagatagattggaaccaggtcacagtgggccttatattccacagaaaggactattcccttgatgtcttgggctttgagcacagtgacagggtgaacaacttttctgaaatttgaattataaaaccataacaattgaagaaacatcagagggtgacaggggcataggtactattataggcagccaaaactaaagtgaggggaaaagtagatagttgcagcctgtcaggcacaagggaagaagcaatgtagttagaaaaatacggtactttaaatgaagttttctttttataattctctttcctttcaaaatccacaacctcccgcacctatcttttattttatgaaaaaggaagagttgatctaaagactatcagtggtaaataagggaatgtagagcatctagaagtttgtaaaaaatccacctgagaagatatgggtaacaagatatcatattacattatttatcagaatcttgagggaatgagtagcaagtgttggtgtttgtcagaattgcctgtagaggtgggtatagatacatgaacctaagccctacgcatcatgtacctattccagaatgcctggtaatgacgttcgggtatctctatttgtaatcagctctatagatgatttgaatgatttgaaaatgatgactatcatgtgttctttctatttttctctcttcacttgttattaaggcaattaatcacatggacaattacggaaagaaatgagggctgcaacatccacacttgaggattgatatcagtattgctcggtattgttatcaatcagtattgttaatgatatctttgataatttccctctaatatctctatattttcctcaaaataatcccttaaatattattggggtgaaaatagtttatctaagtaactttacca

SEQ ID NO: 116498 - DNA, 1026 bp, Homo sapiens
accaatattccttccgagcaatcactaccaggaaaagaggtaagtgaaggaaaaagaagtgttttataattcacatataatatcatcatatgcctgtgaatccattatgaatcaagatgtcttgagttttaccctttgctacaaaaaaataatttttcaattttggattgaaaattggcttataagtttttgatgagaattcactttagtggggatgctgtcttcatataaaatctattccatgggaggaatagagagatggaactcaagagatctttgttattatcctgactcagggcctgcacttagaggatgtgggctatagataattgtcgaatagcgagaaaatggagattaaaaaggaaaaggaaacaatcatctcaactggcctcatatttttgatccccatcctgtgattgtttggtcccaaaacctgttaccactctgctctgctctagattgtagagaattacactttccaggcccccttgctttcggattctgggacggtttagccaattaaaggcattgatggaagacctcatggaaggcattgatggagcataggagttgcagagaaatcagagcctttcttctcctctctctgtcttaaggaacatctctgataatggctgtgacacctttatctccaccctgagccctgttcccaccatgcagccttccctgcatgacttcagttctacctggcaggtctgcttgggctttagcttcgactggtagccccaggagctactcttccataacttagtcccttttctaaattcctccagccctaggggtggttgcggcctcctgctccattaatatctggcctgcttcacagtccatgtttgacttctcaaatcttccatcatgcaggtaaccaaaaccctacattaaaattcttccttttgaaaaatcttgagtggtttctgctttttgaatggaccctgactgatacactaggtaaatatttaaagagacaaaacaacacatagttttaacagagttttcgcctttaataat

SEQ ID NO: 116499 - DNA, 1919 bp, Homo sapiens
caacgaacatttatttctcacagtctggaggccgacaagttcaagatcaaggcaccggtagaattaaagtctggtgaaggcttaccttttggcttataaaggcagtcttctctctgtgtcctcatgtggtagaaggggcaagggagttctctgtggtctcttttttaaggacactaatcccattcatgagggctctgctcccatcacctatccctcccaaagccctacctccaaatgccaccaccttggggcttaggattttaacataagaattttggagtgacacaaacattcagtccacaacaggggaaatctgtgtcttttacacttagaactattaaaattctttgtctgaaattacattttctgaatatgaactgatttctctgcacagacatttatacaggagaaactgctagcagctttaagagttaaaccaatcattcctctgcatgccatacttgaaaatgagaaaataatccttagctttgagtaaaatgtttaaaagttattatggatttctagtcagaaattattttgcttctatcatttttaaaattgtatttctattcctctgtttatacatacatttttaaattgcttctagtcttaccaaaacactcataacattgatggttgggctatctaaatggagatctaaaattgcacatgtattgaataaaaagttatttaaaatgatgtagggtaagtaagtatgttgttgtctcaatcaaaaacaaaacctatcaatgtttgctttcacaactccttttcaacactgaagaaagacaggaagcccttgtctattatttagaaaagtataaattacgctatttctagtttagtctcttttgtaacaggacaataagaagtacccaagttagcaggtaagtgcaagtcagagatgagactctaatatggcttttgaaattatgatgccagtgaaataaaaaagactaagtaatatgaagttttgatacttagaattccataacttggtcttactgagctcatctagaataaatggctttatactgtttgtccttcaaggtagaaattaagttaaaattttagtgttagcattttcactggcaaaaggcacaacatagtgtaattattggagtggacaataatctattctgaaaagaagagaaattgcctccaaattttttgatgatcgttgtcagagaaagctatattgttaaattgttttatagtgccctcatacaccttttttcccaaaccgtactgaaatgaattataataatcattgttaacattctttttgtagtgcagtaaaacagtaatccttcagctatctgaagaggatgtacttttaatgggcatttttcttatagtttttcttagtcatgatcacaaaagccctgaagttcccagttatgatgtatggttctagttagtggaggctggaccctgaagagaaataggaaaatgcagcaatcacagcctctttaagatttaatagttaaatgtaatgtagaatcagtatgtaaaaatgtgacaaatctttgcttgaacttatggacaagctattactgcacagatttggttgaagctttacctccagttactttctccaaagagacatatgttgtctttattgagttcaagcagttagtcttaatatcactatttgattaaatatatgcaagttttggaagctttctatgtttatggacaagtgatcctctcaggctttgccttatttctgtgactcagagataacaaaatataaattctaagtcctttctattttttatgaaacctatttgtagggatttgagttacagaaaaatacatactttctttacatttatgaccataactaacaacagggctactaaataggaaatttagtgaaggtcactcagccatgaaccaatgtgagtttgttttta

SEQ ID NO: 116500 - DNA, 1865 bp, Homo sapiens
aatttcagttgaccaaattaatgtgatatatgaattttcaaattgtttaatattttgtcttaaaattttaattttcctccagaagctatatctcattgcagaagagagatgcatctgccaaattcggttatggcaaaatacaaagtcagttaatttaggaacattattattttgctcaaagcaaatagacttttattttaattgttaacacataaattttaaaatgcactttattagtgtacttattttctaaaatttttatattctctgaaaaaaaaatcctgcttacttgtaaagtcttttcaatacgaaagttttatatgtgctaaatatagtttataacagaagaaaagatccatatggttgaaaatgtgtgtaagttgctatggagtctttagggttgatattgaagtgttttctcattcatgagagaaaagtatgtgtgtcctctttaacaccagaatttgaagcattttccacaagtgtaggtgcatagattatttcccaagctcctttatctgaactttgatatgaaacaattattaagtgagcactgtccatatgccaaacactgcgctaatgacaacccattcctattatcccaatttcatgaacacagaaagaaacttagaaagattaacttgccctgatcatgttgtatgaaatcaggattgatacttagaagtcatatgcagatctttctatttctgggacccatgttctcaagcaccatgctattgggccttgtcttacaagtgtagaattaaatgatctgtcacctataaaagaaatttcaaacagcactgttcaagtgggctgtctgcagataaattcagttcagctttattgaccacctaccataagaaaggcatttagcagctaccatgttctgtgctagacacagtaaggggaagaaaactaaatgagtcactactgctactgccatatgagaactgctaaactaactcaacagataagctatgttgttcactaatatttgacccaatgataatgttttgtttattaaggaaatacatctttgagatgaccgacaatggctcgaatgggttgtattatattatctttaatctatgtctgtatctttatgctcacgaaatctttgctattttacctgaaattatagaaaggacaatccttaagtaacaacaacatttattggctcagacattgatgtgcattatctcttttaatccttctaacctaccaaacaaggtagataccattatttattatctccattttacagtgaggaaactaagacatagagatgttaagtaatttgctctaggacatagagtgaagccaggattcaaacttatctgtctgactcagagcccttcctgtattactataatctactgactgaaaaataggatatttttaaatttaaaaacatttctctgaatcctctgtatacttcttcaactttagtggtcattgttttcttcttctccaaactatttaaataatttaaaataaatttaatttatttaaatttaaataatttaaaataaatttaatttatttaaatttaaataatcctaatttaaatgtatatgatttaaatgattataatttctatttagtgactttaagcaggctttgtatgtatactgtagtcttaatgagctaatgtcttacctttccatgcttataccttaatgagctaaggcagtttggacctattcaatctttagttgcttctgattttgtacttaggttgaggattggttgttcttccctgaatgacctgtaaattttccatcattcatctatcatctatctgtctatctatctatctatctgtctaatgtgattacttattaatatgtataagactttac

SEQ ID NO: 116501 - DNA, 1053 bp, Homo sapiens
ctttcatgttatatatttatgtattttatgacgcagtttctaacacaaaggaacttacaaatgaaaatagtgttacttaaatagattaacaagacatttacctaaatttcagagatggttatagttttaaaaattgaaatatttttaaaaaggtaaaccatttccttcacaatggcatttaggctccatcagaataaaacaagtcactgaactctgatgcttttgttctggattgcttatttttatttatgaaccattcatacttaattttttgcctaacctagtcaaaaataaatcatatttaaaagtaaaacagtgattaaaacattgtattttgcattaaaaaatagttattaggtcaaaactcagatgttagtgttaaaaagaaaatacaatatggaacataggatataatttttaaattaaaaatattttattgcccatatattaaaacgaacctagagcagaacgtcttcaagtgaccattgatcttcacaagggaccaaataaggaagtagctctatgtgctgtatactacatttagaatcaagtctatttttcatcaaattcaattatgtttttattatactccagagaataaacataatagtatagggtatatatattttttaaaataaaatactgaataataactgtggttcagaagagtataaatcatttatgcactcatttattgccttctaacagaatagcttttagaaaattgtatgtcatgacgaatcagttatgccacacttacactgcagtagttgaattacccttggcatttttgtattctaacagttctatttatctcccagtagtgtacattgaataagtaatgaacatctgtatggtataggttttcctccatagttttaaaagaaaaaaacaacattagtaattcattttaaaatatgatattttttccttatacttgaatttttaaagtagcagtgaccctgacatctatttatgaattccttctctcttcttaatatcatcaggttttatgagccacagggtctattgcctccccaaagcagtgattca

SEQ ID NO: 116502 - DNA, 1046 bp, Homo sapiens
ccaggatggtctcaatctcctgacctcgtgatccacccgcctcggcctcccaaagtgctgggaatacaggcgtgagccaccgcgcccggccctcagctttcaaacaatacagaagtgcgaaaattaggtcacacctcatgaaatttaaataatgaaacattctacctagctttataataccctagttctccaactgctatatttcattgtgcctgtaaataggaattactatttttggtttagtatcacaacttgaggtgaatttctgcccacccctatccctggccattgtgggggaactgacatgttttattatttattcttgctcctcagaatggattgggatgatgaatattctcataattcttttgacctacattgtttgttaaactcatttcctggagacttggagtttgagcagatcttcagtgacattgatgaaaagattgaacaaaatgctgcaaggtaaatattgttaattatttaaaacaagttgttttcacatttcacttatatgaaatttacctggtctatttgtatcctgctcttagataattttaggttttaattatcattaactttcccccaaaatattgattagacccccctctcacttaaagtttacatgattgtctttatctgagtagtatttttaagactagaaaatagaagcactatcttgaaataggcaattaaagtttattgaattggcactaatgttttcttagagcttgtcaatgttgatgtcctggattttcattaatatggttagagtgtaaggccctgattgcttgagttactaaaaacagaacattaaaataaattatttttgcataatattggtcattttatgattctttctcacttaagtaggaggctagagactttatagagagttgttatgctagattagtcatcacctatcccaaaaagtcgtgttaccaaatactgggggaaacagtgacagctcaatggtttctcattaatacgtgttctttggtagaaaggactctgttttcatatgtagttgtggaccctataatcag

SEQ ID NO: 116503 - DNA, 1104 bp, Homo sapiens
ccttacactctaaccatattaatgaaaatccaggacatcaacattgacaagctctaagaaaacattagtgccaattcaataaactttaattgcctatttcaagatagtgcttctattttctagtcttaaaaatactactcagataaagacaatcatgtaaactttaagtgagaggggggtctaatcaatattttgggggaaagttaatgataattaaaacctaaaattatctaagagcaggatacaaatagaccaggtaaatttcatataagtgaaatgtgaaaacaacttgttttaaataattaacaatatttaccttgcagcattttgttcaatcttttcatcaatgtcactgaagatctgctcaaactccaagtctccaggaaatgagtttaacaaacaatgtaggtcaaaagaattatgagaatattcatcatcccaatccattctgaggagcaagaataaataataaaacatgtcagttcccccacaatggccagggataggggtgggcagaaattcacctcaagttgtgatactaaaccaaaaatagtaattcctatttacaggcacaatgaaatatagcagttggagaactagggtattataaagctaggtagaatgtttcattatttaaatttcatgaggtgtgacctaattttcgcacttctgtattgtttgaaagctgagggccgggcgcggtggctcacgcctgtattcccagcactttgggaggccgaggcgggtggatcacgaggtcaggagattgagaccatcctggctaacatgatgaaacccggtctctactaaatgtacaaaaaactagtcaggcgtgatggtgggcgcctgtagtcccagctacttgggaggctgaggcagaagaatggtgtgaacccagatggagcttgcagtgagccgcgattgcgccactgcactgcagcctgggcgacagagcaagactctgtctcaaaaaaaaaaaaaaaaaaaagaaagctgaacaaaacagcagccctcagagactacttaagcatcctgcagcttctcactatagcgaagaactgtactggaagtgacagagcccacagaccactgtgaacaagggtg

SEQ ID NO: 116504 - DNA, 1234 bp, Homo sapiens
acccaaacattaatcaatttttcaaatatctacttattttcctaatcaccatactaattctagtcaccgccaacaacctatttcaactcttcatcggctgagagggcgtaggaatcatgtctttcctactcatcggttgatggtatgctcgaacagatgccaacacagcagccatcccagcaatcctatacaaccgtattggcgacattggcttcatcctagccctagcatgattcctcctacactccaactcatgagaaccacaagaaatactcctcctaaacactaaccctgactttattccactactaggtttcctcttagcagcagcaggaaaatcagctcaattaggtcttcatccctgactcccctcagccatagaaggccctacccccatctcagccctacttcactcaagccccatagttgtagctggggtctttctactcaaccgcttccaccccttagcagaaaataacccaccaatccaaactctcacactatgcctaggcgccaccaccaccctgttcgcagcagtctgtgctcttacacaaaatgacatcaaaaaaatcgtagccttctctacttcaagccaattaggactcatggtagtcacaatcggcatcaaccaaccatacctagcattcctacacatctgtacccatgctttcttcaaagccatattatttatatgctccggatccattattcataacctcaacaatgaacaagacattcgaaaaataggaggactactcaaaattatacccctcacttcaacctccctcaccattggcagcctggcacttgcaggaatgcccttcctcacgggcttctattccatagacctcatcatcaaaaccgcaaatatatcatacaccaacgcctgagccctatctattactctcatcgccacttccctaacaagcgccaatagcactcgaataattctcctcaccctaacaggccaacctcgtttcccaaccctaaccaacatcaacgaaaacaaccctaccctgctaagccccatcaaacgcctaacaatcggaagcctattcgcaggatttctcatcaccagcaacattttccccacatccatcccccaaatgacaatcccacttcacttaaaactcacagccctaggcatcaccttcctaggacttctgacagccctagacctcaactacttaaccaacaaactcaaaataaaaaacccactgtgtacatttcactt

SEQ ID NO: 116505 - DNA, 1616 bp, Homo sapiens
ggaagttgaataatttatgaaggggaggggccagcattgattcgggaggatcctattggtgcgggggctttatacgattacgggcattgattggtggtagttactggttgaaccttgtttgttggtgtatatattgtaattgagagtgctcggggtaacaggttatgtgattaggaggagggttaggaggagtgggaagaagaaagaggaagtaaagtttgattatgcctttttgagttgaggtgatgatggaggcggaggtttggtactgtgaggttgttttaggtattagtttttctagtcaagttaggtctaataaaagtagggataaattttggcttatgggaaggcttaggtgggggattgtgcggtgaataatacagggatagaatccgagtatgttggaaaagtgaaatgtacacagtgggttttttattttgagtttgttggttaagtagttgaggtctagggctgtcagaagtcctaggaaggtgatgcctagggctgtgagttttaagtgaagtgggattgtcatttgggggatggatgtggggaaaatgttgctggtgatgagaaatcctgcgaataggcttccgattgttaggcgtttgatggggcttagcagggtagggttgttttcgttgatgttggttagggttgggaaacgaggttggcctgttagggtgaggagaattattcgagtgctattggcgcttgttagggaagtggcgatgagagtaatagatagggctcaggcgttggtgtatgatatatttgcggttttgatgatgaggtctatggaatagaagcccgtgaggaagggcattcctgcaagtgccaggctgccaatggtgagggaggttgaagtgaggggtataattttgagtagtcctcctatttttcgaatgtcttgttcattgttgaggttatgaataatggatccggagcatataaataatatggctttgaagaaagcatgggtacagatgtgtaggaatgctaggtatggttggttgatgccgattgtgactaccatgagtcctaattggcttgaagtagagaaggctacgatttttttgatgtcattttgtgtaagagcacagactgctgcgaacagggtggtggtggcgcctaggcatagtgtgagagtttggattggtgggttattttctgctaaggggtggaagcggttgagtagaaagaccccagctacaactatggggcttgagtgaagtagggctgagatgggggtagggccttctatggctgaggggagtcagggatgaagacctaattgagctgattttcctgctgctgctaagaggaaacctagtagtggaataaagtcagggttagtgtttaggaggagtatttcttgtggttctcatgagttggagtgtaggaggaatcatgctagggctaggatgaagccaatgtcgccaatacggttgtataggattgctgggatggctgctgtgttggcatctgttcgagcataccatcaaccgatgagtaggaaagacatgattcctacgccctctcagccgatgaagagttgaaataggttgttggcggtgactagaattagtatggtgattaggaaaataagtagatat

SEQ ID NO: 116506 - DNA, 1025 bp, Homo sapiens
gctgaaatataaaccccaggaacacagaccctcccttcagcgaaaagtgtatgtgtgtatgtttgtgtttaaaggcctatagcagtcagagataggatcactgccgttttagcagtttaaaaaaaaaaaattctactagagaggaaagaatgacacaattttcttcgtcacaggaaagtgggcctggggtatcccagccaccttcgcagacgctaagttatggaaagcagccaaaattctggtatcaggatgaggcgtccccatgggttctatggaaacgagagacgcggggggcctagcgccttccaggcggcgggccgagcggcagagctgcgcaagcagaagcgggggaagtggctcagcccagtactgcagaggggcgctcggtggcagtccccgcagcggcacgggcgaagcgtcgcggggtctgcagctgcagcccaccaactccggcgccgagcgcgaagtcgggagagctggaacgaactgcagctggagaaagcgcgagagccagacaccgctgccgctcaccccagccgcttccttcctagcctcacagccgggaggcagaaacttcggaggtaccgcccggcgaagaaacatccccacagagacagaatacactgtgtcttcctagctgagcccctttaccttcccggtgtctgggatgcttccttcggtggcagcggcggcaggggcgacgactgccgctgcagcactcaactgcttcacgaatccgggctctgggaaacaatttcccgccgcgcgctaggcagccccggaagcgatagtaccatttccgggtggttgtcagtgacgctccggagccgtcgccagggtggtaatacctggtgcagagcttgagtctggccagcgggtcaggctcttgctagatcagcaccggaggtggaagactggtaagtgattttactgggttttctcctgcgcctgatattaatggctggccggggctctgtgcagcattatggccagcccgagaagtgagtgggcgagggtggaaccag

SEQ ID NO: 116507 - DNA, 1043 bp, Homo sapiens
ggctggggtgagcggcagcggtgtctggctctcgcgctttctccagctgcagttcgttccagctctcccgacttcgcgctcggcgccggagttggtgggctgcagctgcagaccccgcgacgcttcgcccgtgccgctgcggggactgccaccgagcgcccctctgcagtactgggctgagccacttcccccgcttctgcttgcgcagctctgccgctcggcccgccgcctggaaggcgctaggccccccgcgtctctcgtttccatagaacccatggggacgcctcatcctgataccagaattttggctgctttccataacttagcgtctgcgaaggtggctgggataccccaggcccactttcctgtgacgaagaaaattgtgtcattctttcctctctagtagaattttttttttttaaactgctaaaacggcagtgatcctatctctgactgctataggcctttaaacacaaacatacacacatacacttttcgctgaagggagggtctgtgttcctggggtttatatttcagctgcctgaaggctggaaacaagactgagtggctattttaagatttcttccacttccaaagcctcagattaaatattgacaaaaaaaaaattggtccgtctcgggtacttcatatcattatttgactcaggagttagatggagcttgattttggaggcgccagcctcttttttgacgaatgactttattaaaaaattttgttgttgttgttgaaatattgggaatgaacatttgaactgaatttacaatgtatgtgtgacagacaatgcaccttgtggactttttggtttatgttattccgttgtgcctcaattcttggaaatacctgtggatgtgcaagatgttctcattattggaaagtttgattacgtatattgcaggtgttcaatacctaagttgctagtatgaggtgaatttatattaaagagtatatttctttattttcttttcttacctttccttccttcctttgctttctttctttctttgacagagccttgctctgtt

SEQ ID NO: 116508 - DNA, 1060 bp, Homo sapiens
ttttggactggcaccaactacaaaggaatttcaggcatcaagaataggcccatgtgggagatattttgggaaactccataccacagagacagttgcttgctatgcataaaggccaactctgtttatagtcattgtctccttagttgtattttattgttcaaggtaagtaactaatttttgttaattatagataagattttaataattactacaaaaggacattttctcataaccaagaatgtcatataattttaatttttttgacagtaaaaataaaacttaactgtcagaagtcatgctctcttttttgctttttttttccctccttttttttggtgttaagatagtatcttctgtatgaatgctccaaggaacaccccctattagttctagaaagatctataatttttctaaaaataaccactggtacaattatattatggtatatttactttccttcttgtgctgcaagacttctagaagttagctcttgatcctccctacctcagacatatcacttacactaaacttgactgtactttaaaggatttttaattgtctgggttattgatatatgttaaaccaattatagtgctctttttggcctcattaacatatcaggtttattgtattcttaatcctgcagggtcagaaagaaccatcaaaccatgaattttataaataaatcaatcagtatatctatacatgtttatatctattcctacatatatagttttcctgtgtaactgcatgaattagatcctgtaatacaggtcattcacttgtcatatcatgtgctgtaaaaaagcattgctaaatgtattataaactgttgtttcaagtagataattttattctagaaaactgttacaaaactgtgctagttattttgggccgtcactgggattcctgattctgttaaagtttagctagtagctcagtttttctgataaatttgtgactagaatgtcctgtattctgatttgtctttaaacatatccatattttatggataatgtttgaatcaggacattctgttttttcacctttgtttcctact

SEQ ID NO: 116509 - DNA, 1050 bp, Homo sapiens
taattttatttttttattttgtaaaatgtatttcttaacatagatcaaggctaatttttttttaagtagttcaaggctaaaattttttgaaagctaactttttaggagtgtttgcaactggttccatattttatggtccagaattactttcttgggagtacgttacctttgaggatagccgcttccttagacttctttcattatcttttggtttattgacatgacttttccttagggaatactttaatattcttggtccctaaaagcctttcctttatcaagaaatggataggtagaaaaactactatgatttcttaaatatctactctgaacaatttataatttaagaaattgcagccgtgttctctgtgatcctcaattgcccaaagaaattagtccctattagaaaagtccattcgtactcctaagaaataattaatttagataatttgactaaagaaactcaaattttctaatacttttataccatttacatttttatttagagttttggaggctggaaaggcaaatgttattttaccaaaaagttcaccaagtggaataactcatgtgattgccagtaatgcaagaattaaagctgagaaagaaaaagataactttaaggctccattttatccaattcagtatctaggggattttcttttagaggtaagtaaaataaatagtaaacattttattttgtttcatgtgttcattttataaaataccaacatagtaaaatatatattaaagttgtgttctaaattttgaaactacattggtagtaatttaaatgacactttttaaaggcagtggctctcaattacttaaatattcatgaatacttcctgtagatttgaaagaagcttactagttaagtttaacattaagtattttaatgtcagtataaataaagtagtagaatatatagtattatatagtattgtatgagaatttgggggttatttttcctttggaaaagagagctatttctaagggtttagaaatactgtcctgtcctattcccctacatcctcctccttacttggt

SEQ ID NO: 116510 - DNA, 1051 bp, Homo sapiens
gaatgcagtttgggttccttggcaagagaaattttgttgtttgagatagagctacattaagataattgttgtttattgctattcaagtaagagtattgtgtaaccttttcctctctatgtggggtatacttgcaagtgagaagtcttaccaggaaaaaactgaaaaataatccaagaagaagtctgtctataattgatgatttgtaaaatctagattgtaactttagcttggacagggactagataaaatatttttgttcttggttattcataaaaatgacttgttagtagatgaacaaagcattaccttttcttgagatatacagaaatcactttattattcaggacctttactatcatgattttttccctgaaagatttttatcagtgtttaacatcctttgatttaagagggtgcattttacctacttgtttgactaacaaagtattatagttaaagttgagtaccataaaacgtacataatattgaaaatacacttagatgattgcctaaaccatttttacatacatacagaaagaaattcagaatgatgaagattcccaaaccaattctgtttggactgaacatagcaatgaagaaacaaacaaagatttcaggaaagatgcaggatttcttgaaatgaaaggtgccttaagagagaccatgtatagaacccaggtaaactttataggctgaaaaacatacatttctgatgtttcttatagaattgtttaagaggcaaagtatggtggaaaaaatagattttggaatcagaaggctggtgtttgaaccatgtgtttatagtctgtgacttgaacatgttaggaaattgtcctatgtctctgggaactcttgttgaagtaatgtttgtatgcatatagaaatacacagagttccttatacatagtgcgttctcaacacatggtaattacttatgtaattaccatgtttaggtaacttacttatgtttaggtaacatcgtgtgtcttataaagcatttttcttacctgagagcacaatatataattcatgtaaattcaagtatttata

SEQ ID NO: 116511 - DNA, 1431 bp, Homo sapiens
ttaaaataatttagttttgaataaacatggcaaaagaataaaatagaaattttgtaagataaatggaaatcattaaaatacatctacagtcatgtacacataatgatgttttggtcaacaacggaccccatatatgatagtatcttatagtcccataagataataataccatatttttactgtatcctttctatgtttagatacactaatactcagcattgtgttgcagttgcctatagcatttaatactgtaacatgtcataaagatttgtaacttaggagcgatagaccataccatatagactaggtgtgtagtagactataccatctaggtttgtgtaggtagactctgatgttcgcacaatgacgaaatcaactaacgatgtacttctcaaaacatatccccatcgttaagcagtgcatgactgtatatatgtcttcttgagttctttttaggactcaaattatgtatgtaaaattcaagtagaaatatccttttttaaaaatagctattttggtataatgattaaacaacatgatttgtaatactcattaatcggaattcagcacataggtaaactaaagcatatatgttaacgtactataaagctttgtgaactgaaaacaattatgttctgctttatcttacataattcagagggttctttactctatttaaccttgtatgtatattttacaaaatctatgttcctggatgggtttttcttttgtgacttgtgttgattgtgttaaggctatatttaatccacagtcttaactaaattatgtttacaaacacgcagaaagaaatgcaaaatcatgaagatgttaatgttggttctattttgattcaacatcacaaaaaagaaaaattcagtggttccagtaaagatttgaaatttgttaaaatgagaaatacctttggaagccatacatatgaaaatcaggtacaactttccaaattaaaaataatttatttttaatatatatagtgtttatagaacagttttctttagcttttaaaaaatatataaaaatgagttatgtatccaatagctagattaagaaatagagcattaccagtttttaagacctgctgtattattttcttttttcttttttttttttgagatggagtcttgctctgttaccaggctggaatgcactggcacaatcttagctcactgcaacctctgcctcctgggttcaagcaattctcctgcctcagcctcccaagtagctgggactacaggcacacaccaccacgcctggctaatttttgtaattttttcagtagagactgggtttcaccatgttggccaggatggtcttgatctcttgaccttgtaatctgcccacctccgcctcccaaagtacttggattacaggcgtgagccactgcgcccagcctgctatatcattttctaatgc

SEQ ID NO: 116512 - DNA, 1045 bp, Homo sapiens
atgagattttctgttgtacgtacttctttatttttatttctattttttgagatggagtttcactctagttgctcaggctggagtgcaatggcgcaatctcagctcgccacaacctccgccttccaggttcaagcgattcacctgcctcagcctcccaagtagctgggattacaggcatgtgccaccacgcctggctaattttgtatttttagtggaaatgggatttctccatgttggtcaggctggtctctaactcccgacctcaggtgatccgcccgccttggcctcccaaagtgcagagattacaggcatgagccaccgcgcccggccgtacttctttattttttaatgtgtatgaaagtatgaaagtcactcttgagtttatttggattttgtaacatatgtcattgatgttgagatttaattgtggtctaaatacatgtagaaggaaattaagaaaaaagatgaagatattcagaggagttatactttgaggagaaaacgcaagaaaggaaaagaaagcaattgcaagaaaggcgttgaacatgaaaaaataaaaagtaccttaagaaggcacatatataatagagatcaggtaaagtttgtaagctaagctatagctttcttttttattttttggctgttctctgatataatctagatatataatgctacatgttttaagaaaaaatcttgagtcaatctggtgtaatattcatagttaatattccagttaactttggttcacagtaaatgtacttgtacatgcatatacaaagaaatctgagttaataatcaaggtattcagtgaattttgttttgcctgaatgtgatgaataagaaaaagaaactggaaaagactatttcttaaaatgaaaaaatctttaaaactacatgtgtgtatagttgggtaatactttctaatgtaaattttattttgctcttttgtatagtacagaccatttttaatgagatgtcttgtttttaaaattgaatgcttcttgggtaaattttttctggagtatgactttttttttttttaacg

SEQ ID NO: 116513 - DNA, 1033 bp, Homo sapiens
gaaagtaatcttgggtaagaaagaggaggattctggcgagtattataaattgagaggttagctggtcatttaaatcaaaaggacttaatgaaatctataatctttgttctcatcagtgaaataaagagcacaaagggagagtacctgctagtcattaaatattataataacttgaaaaattgagaaattagatctatttattaagaattaagtactcatgagatatttgacattgtttaatttttgaaggaagaaatatattcataaaattttgttgaactttctattttaagaaaattttattaaaattccagcagtattctagaaggagaaatattttgttcacaaatgacttagtgaattgcttgtatgttatagatttttgggttcatgtttttcaggtcttgccttttcaatgaaagcttttgtcatcaaatttcagaaaatattggctccaaggtgctccacctgacgctactcaaatttttctttaatttaattgaaagtgaagtacaacatctgagtcaaaagtaagttctaatcgcaagaataacacttttctaaattttggttgtttttatgcaccattttttttttacaattattataaatatatttctaaaaagtcaccttattttctattttaagatagatttgtttttaaaacatatttccagatattctcagtgggagtaaaggtttatatgcccttttaaaaaatttcctcagttcacttccactgttcatttggatggataatagtgttttcattttttaggattttaaaaaaattctttagtaattgaatgctaagtaaaaaactacaccaattttaaacactgagcctacaatggtaagttttgctcctgctctaaaacttgcagatagattactgtgtatatatacattgtcagtgactttattgaactggggccattttttatattttgtcctttattataattgttataatctttatattttatgatctatgttcaaaaattgctagcattttttttgacaggagagatgt

SEQ ID NO: 116514 - DNA, 1447 bp, Homo sapiens
taacaaaaatgcttatgtagtttctcgtcaaatacttcctcagatccattttctcttctctacgttttaaattaccattaaacttacgttataccttttcttcatattctttgtgtttttcaccttgtatctccctccctttctctctctctccctctttctctccctctaccatttcccctgtcctcctctttctccctcttcccccgccccatatagattttttttttctgtacttgccacattctggatagtattttcgtccagtttttagttcattagttctttcttcagctatgtccagtatattgttaaacatgaccattgcatttaaattttttgtgttttttccagttaaaagactttttaactgttccaaaccactatgacttgtttttatgagtttcaaggttttcttttgtctttaacatggcaatgacatttattatctatgcttgattattccatatctgaagtctttatgggtctgtttctgttgttgtttttgctgtttccttctcttgtgcttttttattttctcttgcaagcttattattcactatatgcttttaaattgcatttgagaagttatttgtagaaacaatacgtgataaagaccagagtatcttcccccagaaagaatttctgttgaacttctgccaagtgcctgggtgtaccactagttaaggactattctaatccaatgtctatgtttgggggactctgggtagttcaaatgaagtaaagggctacatatacatttagttttgcttctgattcactcttaccatgaggatgaagcccttcactttttcatcctatgagcaattagcttttggccatgactttttttttttttaatcttttcttcccttgtgctccagaaaccacagttctgtattctagattcttccttaaaatcagtgaaagtcctcagggcgaagtcaggtatctgagtagctcccttgagtacctcactagattttggcctagcacttcctcataatttgttctcttttttttctgaaatgttttgcttattttatttaacatttttagttttagttttcttctctaagtgggttcaattgaggccgggtgcagtggttcctgcctgtaatcccagcactttgatatgctgaagtggaaggattgcttgcggccaggagctcaagaccagtctgagcaacatagtgagacccccatctctaccaaaaaaacaaaacaaaaccaaaaataaaacagatgtagtggtgtgcacatgtattagttttaactacttgagaggctgccctgggaggattgcttgagcccagaagttggaggctgcagtgagctatgattgcgccgcagcattccagcctgggtgacagagtgagaccttgtctcttaaaaaaaaaaaaaaaaaaaaaaaattcatctgaattacctaggccttcattagaaa

SEQ ID NO: 116515 - DNA, 1082 bp, Homo sapiens
ttcttactaatctatttctaaagcttatatatccactaatactggaaggaatagcatcgttgatgtattgttaaagtggcagtgagtatagtccatagcacactgtcttggccctattattgttatgagtgtgctagttaagattatggtataaaaggatctaagaacctgagttgaaagtgtcttttcatataaaaacttactattatggctatgtagtagtgtgcatgtttagctaatgacatgaaaagaacaacaactttggcaggatcttttttatcatagtaaaaaagctatagttattcctcgaaatcactgcaagacctcttctgtttaataacattaatatcaaggtaaatttaatattaagcaatatattaatattctattgtgattttaactgtatgtaccacatatttatataaggaaggagggaaagtcccaactggttgattttttttttttttttttttttaaatgttgtttttggttgttggaaagctggattgtgtttttatataaggcttcactttgtgggctaacatccttctttcctgcccagagtcttaaagcctgggtggtctaaagtgatcttgatttactatacccttgagatggagaatactttcagaaatcaaaatttaccaacctcttgcttctttcctgagtactgtcactgctgatattcagatacatattatgttggaaggaacattttgtggatgcatatgtgcatatggacataatcagtttactagtttaaatatatattttcactgttctgttttatattctcttgataacagtgagaagtaaggattaactaacttgctcagagtgatcaagcaagatactggctttacagagaatggagttgatttcctgcagtgttttctggagactagcactagaccctagtcctgccgatcacaccaggggaggtgttggtgctactgatgtggtcagacctgctgctggtttcccatgccatatagccgcaactgcaaggcttaaactcagctgtcctatcaaggcaggagactgggtgggattgacagccacctgtgaagactcacctgcta

SEQ ID NO: 116516 - DNA, 1043 bp, Homo sapiens
atattaatatctatctttagatattaatatctttagatattagtcaaattctgttttgcaacaatcctttaaggatgtttttattccttattttgttttctgttgaagaaagacttgttttctgttcaaggcattatcagaatggaaattacaaaataccagttgtatgtaaatcatacatataaaatgtgcaaatgaatcatacctgttgggcataagactaatcaaaagagctttcctaaatgaggatcaaaattgaattagaaaaaaataattatttttaagaaggtgtttttctggttgttcacatggtattgactttgacacaaaactagttttcttaatattttattatgttcaaccaagatagagtggcaaccatagtgatgcaaccaagaaaatataaccaaatgtaatagtgaaatgaatcaaataatttctctttactgctgtttttgtagttgagaaaataatgcaatattatttttcaacaggtatattcctatttaccagccttggggaaaactggtgtgcttgggtctggaaagattcaggtgtcaaagaaaataggacagcggccttgttttgactctcagagaaccttactaatgctgaatggtactaaacaaaaacaagtcgaagggctgccagagttactgtaagtgatgctgatatcccagctgtgctttgttttggagtacagctctttctctgatgcatttcttgaacttaatggttatctgtgatactgtctgaattatactgattagatcaaaactcaattttagatctatttgatcaacattttctgtttctgtaattcaaggtacatgctttctaagtgcttcccaaaagaaataaaactgctcatcaaattattgatgaattattgatgaaatacagttccacacaatttttgccctatgatttgaatgactactttgccataatatagatgggatttcagaatgcatggtcatatgagatatcctgtatcattatagtagtttccccaaaatgagaaacctctaaaagtataaggt

SEQ ID NO: 116517 - DNA, 1822 bp, Homo sapiens
agaggaagagaattgagatatagtagagaaaaacttcaaaagctttttatgcatgtaaaaaaatgtttttgtagaagttagagataatctgtaaaactgaacactgtaaaaatgtgctacttagtattttatagtaagaacaaattagattcagtatttcattttgtttcctaagcagtcatttatagtaatttttttaaaattccccttaaataatcacttatatcttattaatcttggttgtaacagtgatggatatagacaattttagccagaaggcattaattgcgtctctcctagaaaaaaccttgtcatttctatttgttactcttgttcagctttaaatggtactagggattttttttttttttacatccgtgtgtgtgtctgtgtgtgtgtgtgtgtgtggtgtgtttatattaagattcctccatttctccctctctctgctgttgtagccaagccagacagcctattgagaagcagcaaaccatctgttaatggatttgaagttctgaattatacttgagtgtgtagaggcactcatgcttagccagaaacattcatttgaattaagctataaatgctgtataaaaaagagccatacatttaatgtaggttcatgaataaatttaagagagggcaattgcactctaaacttttattgctgcaaaacccagtatttttggtgttctctgatcatttgggggttttatagcaggattgaagctttaaaccttgaactaggggagacaatgcctgtgttaaaccttttacagtagaatttcattgctgaattgctgatagaacagaagcagtatggattggtgggggtccttccccttcccaccccccacccccgcctttttaaatgcaggggatgtttaaaccagtcaaaagaagaactcaataaataaatttctggcatggggccagatctcctagttcatgccctttgattattttttttagttgatatcttgtcttctctggaataatctattaattttttatggcaggagaaacagccctgcatagagcttgcataaataaccaagtggagaaattgattcttcttctctctttgccaggaatagacatcaatgttaaaggtaagttttaaatctttgtggtctagtccaatgtcttaatatttgtgatattaaacagttttatatcacattaagaaaaattatttaagtaaatttacctaaggtatcttaaaagtataagaaaaatttcttagcaaagccaagaaatttctcatatattgatttataactaatggtataaaaacattttttggtgtccatattttgataatacccaacattaatattttaaaattgtttttattttaattttttaaggtagaaatatgattacaccctagacatttttatcacagcattctttttgtatatgaagcacctagaaagtcacactgatgagaaaagtagaacatcagtacttttctaccaaaagtcctacttctgctgttttaaaacttgccttgatttctaatttagacaatgctggctggacgcctttgcatgaagcctgtaactatggcaacacagtgtgtgtccaggaaattttgcaacgttgtccagaggtagatctgctcactcaagtggacggggtgactcctttgcatgatgcactgtcaaacggacatgtagaaattggcaagctgctactacagcatgggggtgagtgtgtttatgctaaatgggttttgataaattatccagttttttgatgaatcctgcagaggtagatagcattttatgtttaaaatctgtaaggaaagatgccttta

SEQ ID NO: 116518 - DNA, 1035 bp, Homo sapiens
agaaggggaaagaaataaatagttaaaattttaactatacatattctgttttcagcctgtgaatgtagtagtttctaaaagcaatgaagatttccctgaatatcacttttgtgcctcaagctagttcttattcctctgttaatgtcattggttgctcacccctccagaggtattttcatataagagtcagagtttcaggaaaaaggtcttatttgtttaaaccaaatctgtttttctccaagtgacatatagtttttaagaatatgcacacaatccctcatcaatctctgaaccaccaaaaaaaaaaaaaaaaggagtgctgattatacgtgggaaagattattttcttttgtatttaatacagtgaatgtgtagtcagcattaccattgaactaaacatctgaaatttgatacagtgaaacaaattagtcatctgttaatggttactatccactagatacatctgaggttgtagaatatcaggcttatagacatttgagtacacattgtcagcacagaacataaaagtctcacataaggtataattgaaagttatttcaaacagttatctcatcaataaactttctgtagtaacatcatgttcatggaacattatgtttttagcaacaaacagtgatggtatgcagacagaagcatgtcattttaaacatgatacattaaataaagcatgttgaggtcaaagcctttctgtagaaagggaatttaattgacattcaagcatagtatataaacagatcaaaatagttctattataagaaatagtatttaacaacttatctctaaaataaaaatactttaaaaatcagcttcaatgagattacatttattgttaaagaatcttcctttagagtgaaatatacatttcttttagcttttctatagtttttccagtataacccccacttttaccccatccaagtttattattaataaagtagtgcaaagcattgtctgctgcaatttcaactgagtgtagtcccctaccaagtcagggaagtaagacattctcaacca

SEQ ID NO: 116519 - DNA, 1037 bp, Homo sapiens
tcacaatagtgtttcaacttatatctagttatctggtttcattgtgaaatttatttttctcctcctcaaatatattgcataattctatattgcaagagagaaatttaaaatattttattctttctgaatgctttgatgagagacttgtgtgattttttttcagtcttgttaccaaattgaaggtaaagatcacagatgagattttaaatcttctctgaaagtagcctatttgagggacctaacagcggccccctgctgccctcctccctcctagcactttgtatctctcttatgcatgtctagtcactcctgaccacagacctatcaaacctcaaggccttagggcacaacccatttgttattcactggggcctttcacagagtcgtttctcaacacatttttattaaaggcataaagcagcaaaccattaatttgaagttccccctttttagaactcctcctcattagtaaaatgaaagaacttgcaggtggtaaattccttttcagttcaccctgaagttttactaatggaataagtaaaattaaacctctgatagttaaacagaaagcagagcctttaaaagaagggccagttaagtttgggacatgattcctggccagataattcattattttgatatgacggtgggaggggtatattgtgagggttgaatttccaggcagcaaattctacttatatgccaggaacatctggcagattgagaccctcatgtcctcccaaggcacctccaaggtatctctatacaggaccaaatttggtagaatttacacatgaatttttctgagatctagaagacaaaagaaaaaaaattacttgggactttctctaggaaagaaactcttctgagtcctggtaattccctcagaattatgactcaaggcagatggctgcaccacagcacctattccatgtccttccctttgagaaattagatgagcctttcaaattaatcctctttgatgttagctcagcttgacactgctgccattagcctcttcaaaataaaagcagtca

SEQ ID NO: 116520 - DNA, 1026 bp, Homo sapiens
tattgttttccctaatggctgtaccaatttattgtcccacatacagtgcacgagggttcccttttctctacatcctcaccaacacctgttatcatttgagtttttatatatctgttggctatttgtatatcttcttggaaaaacatctattcaggtcctttgcccattttttttatcaggttatttgtgtttttggctattgagttgttgagttccttatatgtttttggatactagttccccatcagatatatggtttgcaaatattttctcccatttcataggttctttcattttgctgattgtttcctttgctgtgcagaaactttttaatttgatgtaatctcacttgtttacttttgttgcctgtgcttttggtgttatatccaaaaagtcattgtcaaaactaatgtcaaggggcttttctcctatgttttctaagagcaggtgttgataataggaaggaaacaacaggaaatttaagggcagtaggacccttaactattcaagactgtttaaatggtgtttgtacttaaagtaaaaactacctgagcatattttaacatatgcctcaagtctgtagcgtggatctggattgcagattctccagtgctcaatcatcctatatttgtgggaagagaagtctgacatttcccaaaggattaagtaatattgtttgatatggaataaagtgccatgtatattgagcttctttaggaggatagttttatttatctttttggatttctgtcaaaataaatgcaaggggagggaggcccagtgctccactggttccttgaacagaggtgaatttactgtgaaacaatggctcttaagcttcaggggctcctgcttgcgtgagctctagccatgtatttacaagatcattgtcatatttacagaagtaagacattttaaacataattgatgaatgccattgattaagaccactgcctcttttcactcccacttcccttgatgtcgggtggtgctgaagtggctgtggacaaagagaagttgagttgg

SEQ ID NO: 116521 - DNA, 1865 bp, Homo sapiens
gctgtaatggctattgggtttgctttgatggccaggacttttggaggaaacatccttcactggacagtagcatcagcatcttgtgcacctccagtcaatgcccataatgttgcttcagctgttagcctccttctccagagacaattgaaagaaatgcttttaaaatagaggaatagttccacattatagtttgttgcaggagaaatctatattttgtacttccctctgcttttgtccattgctagaattattgcaagccaaggtatttcttctcatacatagtaaaagaatcttttttaagctcaagtatttttagatactaatctgaatcagagttgtatgccagtgcaccatggaacttgtctttcttttcccataaagataaaaagctctgtttacttgtattaataccatttatcaagtacagtgcctgttatgtatcagacactagtattagatggtttacatatatttagagaaacagtgtagcataatgtttaagaacaagttctctgttcttgtgagttcaaatccttgctctatcttttactggcaatatgaccttacataagttatctaacctctctgtgcctcggtaataggcatctggtagattaaatgcattaatctatggaaagtactttgagctatctctaatatctgatgatagctcaataaatgttttttctaatgcctcagtagcctacaagataggtattgttatccccattttaagataaggaaattgagattctgaaattaaggaatatatccaaagtcacactgctaatgaatggtggcactgggtttaaactctggcttgttaggccacaagacccttcaagacttctcagcatagaagtttgggttatttttctcttttctcagtgcatcttttgagactgttgaggaagacctggtttatgacgtagtgctgagttcatcaatgatttctgatttgtaaacatcacatttgtatttgtaaatatcttctgaaaggaagtagcaaaactctacaaaagaacagagagttatggaaatttagtctatggagtcacatttttataactgtatatcaagggaacgatttgacataatattaaacccttaacacaagtgtgtgtaactctaatctgaagagggaaatgcctaattaggtagaggccaaaacagcctaatgtttttcctggcaaccatccttcctctctcaaggagggctccccaccctctctgcattggagaagatgcagcatgtttattttatggcatggaaggagactcaagaaagcatttgtaactattcttcactgtgttgcataatataccttgtcaagtttacactgtaggttggggtcctctttgataaatggaaaactaatggtgggtcttgaagtaatactagtagaacttcaagttgattactgacaccgtctgccagcaggaactcccaaggaacactgaaaccttcaaatgattacactccctctcctactttactgctgcacgtctccccatactcgcccaggactcttctgctgttctttcagtgttaggtgtcttcagtgttaggttgttcttggtctctacttctcactgtagtcttcatgtccccaacccctatcccacctaaccaaggcaatgccttcctccccagtaattccagtaaccatttctctgctggtgacttccaaagctaaatccccagttcagatctttctctcatgctccaggcccagctctctcactaaccactggacatctccatttggatgtcccatagatgcctcaaaatcaattagtttaaaacatctcattatcccctctctgctgtattatttccctcctttcccacccaaatttgcttc

SEQ ID NO: 116522 - DNA, 1036 bp, Homo sapiens
agccaggtgtggtggtgggcgcctgtaatcccagctgcttggaaggctgaggtgggagaatctctcaaacccaggaggtggaggttgcagtgagccaccaagatcagacgattacactccagcctgggtgacagagagagattccgtccaaaaaaaaaaaaaaaaaaagcaatcagaatgttggcatctatactaatttgaatgaattgtgcatctctctgatgttagcttcgtttaaacaatttatatctgcaaaagtgactgaaagattgcacagagtcacttttcctagtatagtttgatgttgccttttcaagactgccgcccttggattacttggcttcaatgaatcaaaatatagatattgttaataaacaaaatactgacgttcctgtatgtgatttcccataggtgctggtaaacaatgccaaaactcatggagatacaagagcattggaactgaatcagagattgtcctcacaataacattggattattttatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaaaccagaatgaaaggaaaaccattattgccttggttgcttaacattatttgtaaaccattattttctgcatcttgcatggtgcacaatagaatatcttttactgtaatcccttacaataaagccttaatagccattttctatgtaatatgcaaaagtagattagcacaatgcacaattttcttttgttaaaaatcaaattcaaagatttaattcttgctatgaattctaaagttcggcaaaccaattcatcataaaatccaaataatcttgtaacctatttatctagtgattcatctccaattctgttgaaaaagcataatataaatgttgatgagac

SEQ ID NO: 116523 - DNA, 1048 bp, Homo sapiens
acaaaaatgtgtatagtgaacatttcagtcattctcatttcaattcaacattctctaagagggatttctagtaacttatgacctaacaagctattttctgataccaatttacgtatatgaatctgaaagttttacatgctggtagggaaaatttgtcaagatacatgtttaagtgggagtgagggcaaactgcagagcaggatgtatgatataattctaatggagtgttcatatatgtggtatgaatttttaagaatgtatatctctaaatataccatgtgtgtttgtgcatatgcttaaagcatgaagatgtaattatatggaaacatatataagaaatataatggcagttatttggagaaggggactgggggttttaaaggatagtagaggagaatttttcattttatatcttttgatagtgtttggatttttttgtcgttccttattattttgtaattaaaagttaaattgttattcttttggttttacatggttagaagaaattatcctagacagccctaaagtaactcttgtttttaccatagtaatccatgagaatgttagttactcactttaactaggcatttgacaatgaaatgtagaattaggcctttttttttgctttggtgccattactgtagagcacatttaagagattcttatgtcagggactatttctgttcatttttgcttccttgctctgtcagtctgccttgtgcatagggggttctctataaatggttttgagtgaatggacaaataataataatgtggccaactaattgtagttcactattttattttgtttgccccatatttgtatataacaaaggtctttatgaccttggtaactggtgagccacagaagctgcacatagtacctataacatgcccttcaatatgtgaactggagaagtagacactcttttagcataacttattactttttacttttcagtattatttattgatttttgttgatgctgggaaattaaatctgacctggaatagaacaaattaataatagttttaacaatagcaaact

SEQ ID NO: 116524 - DNA, 1039 bp, Homo sapiens
gggacaagaggaaaattttgataatgctgaatatgttcattatcatggttgtggtgatggttcactgatatacatgtcaaatatcatcagattgtatagtttgaaaatgtgcagcttattttacatcaattatatcatagtaaatctttacatgttttcagcaaattattttatttttctttagaagtcacaattatatgaggctttgagttatttagccacaaatactcctgccatgaaacttttcagaaacctgccacttgtcaggatagtctatggtacatgtggcacatgtaactttgaaaaactgtgtatggatgataagcccaacggtaattttttagcaaccagttactcctctaagaacacattataaattgcagaagaaagtaacattgacattttttgtttacagttaaagacgaaaaattctttgaaaattacaaccagtcccttgaaaagtggtctctctcacaagctgtcactggtctaatagacacaggaagaatatctgaagctgaaactctctgcacaaaggtattttatggaatgtgcattgaaactcatggattcttatcttactgggaaaataacttcaaaaatggaatgtatgaggctagatgcggtggctcactcctgtattcctggcactttgggagactgagatgggaggatcacttgaggccacgagtttgagacgagcctaggcaacatagcgagaggctgtctctacaaaaaattaaaaaattaaccggtcctggtgacacatgcctgtagttcctgctactcgagaggctgaggcaggagaattgcttgagcccaggaatttgacgttgcagtgagccatgatcacaccactacactccagcctgggcaacagaatgagatcctgtctggaaaaaaaaaaaaaaaaaaaaaaagaggaatgcatgttgtttaaagagcaggtagtggtggtgatgacaattatgatgataacaactaaaatttattgattactgtacttgccacaaaccagtcactgcatttagcattttgt

SEQ ID NO: 116525 - DNA, 1026 bp, Homo sapiens
tttaaagttatagatttcaaattgacctaatgaaaacactgtgatgctacatgtatttttcttatttttagtattgagttgattattgaagcaatgatgagcttcacggtgccttgaactttatttattttactagagtatgtaagttttaaaaatactatgtattttcatatagtaagccatgttagtttatctttgtgatctctctcagtctttatattttatattgttagaaaatgtgtacatttcgttggtaaaattatataacttttgaaccttcaaatgaatattttgaaagtagagttggtcacagtagaaaagatttcctttcacaagattattagtcttttcaaacaacaataataaattgatacttttaagaagtttaggagttgtgaatgtggtaaaactgaacctttccagtgatttagtggaaaggtcttatcaatcttaattttttctttttcatgaaagtttctgcatttgtataaatcatcaatattttctgttctagggaggtgttgtagcaggaaatgtggctcatattctggactcaaatcatggaaaggttagtttgtcctagtacaaaggaaatgttgaatttattaaataatattgatgaaggaataatagttttcatagtcttagggattatgtcatatcaaatagagtcttttagtcagtttgaaagagagggagctatcaggaaaattggctaacatcttttctcttatttagaaggcattactgtacactgcggtaaatcagttggctatgggaagcagttcagcagaagatgaaaaaaatactgcactaaagaccattcagaaggcagctctcctttctccaggtgcatataatatctatttcattaattccaattctttttttttctaaatacatattttgtaagtgggggaaaaatcttgcacacaatatatattttattggcattgtttataccagacaaaaatgtgtgtaatttagatcttctacaacaggagtttgggtgattaaagtactttg

SEQ ID NO: 116526 - DNA, 2100 bp, Homo sapiens
acaaagatcattttgaatattatgtttctgtaaaatcttcatatttggtttgtcacttgtttatgagtgttctttcctcccccaaattcagatttttgtactgccaaataggaatcaggatactttgttactagtctgagtctgttacctactgatttttttttctttttttaccttagcatatcacttttctggattttaattttctcacctgaaaaagaaggggattagactgagtggcctcgaagttcttgcctggttgagaaattataatgaattagtaagcagtcagttgcttatcagaaaattattaatcagggtttagagatcttttgttgtattttagactcttgggcctaattctagttaattggtgaagcaagcagagctagaaaggcaaactcctgttcccattcactgtggtagcatttgggagcagtggcgttactgtgctagcctctgtgtcagccattgaacccagggagtccaagaatttgcattctaactgctcccaagtgatgattatgaggctggtccaagggacctcacttcgcgtagtactgctctagctcagtagatcttagatgattatcagaatcactttttaatttttattttaaaagtatttttggttttaaaaataatttattttagcaggtaactggaagatttagttaaaataataacaatagaagtgaaaaacttaggttaactttgcttttaagctcagctagtaaacctttggttcttctagacagtttcattttgtattattattgttactgtcttttaaacacattaagagtctgtttttttccttttataggctcttattgctgaggcagttggaagttatgacaccatggatctcttcaggcacactacagaactaaatatgcatgtaagaatctgaacattcttcttgaggattcattaatgagaaaagtgttatccttgttaagggaatgaatagatattgggctaggcatagtggcttatgcctgtaatcccagtgatttgggatgccaaggcaggaggattgcttgaggccagcctggacaatatagcaagaccctgtctcttaaaaaaaaaaattaaaaattagccaggtatgatggtgtatacctgtagtcctagctactcaggaggctgaggcaggaggattgagtcctggagtttcaggatacagtgagctatgatcatgccattgcactccagcctgggcaacagagcaagattctgtctctaagaaaaggaaaaagaaaatgaatagatagtggtattagatgttaatgacatcagttgtttttattctttattctttcttagaaacagattagttttctcgaattaaagaactaccatttttcttttttctacaactttcaagagctggtgaagaaatgatgtttagatttaatagatatagtagcagtcatatattaatagaatagaaactgagactctaggaaaaagatagacatgagataaggagtaggcatggtagacatttctagattatttatgaaaatgttgtagaattcatttttttttttggtctgacctttggcaatggtgctgaggaagggaaagccagcccatcaggcaaggctctgttttctgcattttatcccgtttgattcttctcgttaggattggagcaaataatttcaatatgttcttcgctgtgttttatcatagtgacccttcatttaaaggtacttttaacaattgacttaaagaacactgagatgtgatatttattgtattgaagtgcattgttttacttcttattataatttttattgacacatttattatcctatgtctgcttaacgttggcttttttaaagactgaaggagcattaggttatgcgtattgggtctgcacaacattgcaagataaaagcaacagagaaacagagctgtaccagtacaacatcctccagatgaatgctattccagcagcacaagttattttgaataaatatgtaggtaaggtacctgttatataatagcaagatatttgagcaactattgaaataatttaaataatttttaaaattaattcatgtcaaattaaatattggtattctttaa

SEQ ID NO: 116527 - DNA, 1076 bp, Homo sapiens
ttaatttaaataaaacaatgtcttaataagctatggatgtggttttattgtagcatgggatagtttttgcccatgagcttactttttaaaaataggaaaaataagactgtttcctgccatacatagattgttgagaaaatagtataaagcagtatgtaataaaaagttattttttgtagcagaaaaaaaagcatccaagttaatgtgtccaaattagatatttttgaagtttcctgattgcttaatgcagaattatgttgttgatcactccttctctggtagcaggtatacacatgtctaggacttcattggttaggacttcattggttgtgagttcttatcctcccagttaagctaaaaggggaatagatagccttatttaatcattgccttcaaacctatggctatctaatggatggatgattggttggttaaaagttctgcagatgacaaggtagaacccttttttgctagggttcagaactcctaacctggggagaaatctgttgcacccaggagtgttccagaactgtgtagttaaaacactgctttaagcattgctaattatgcttaaacagtgaaattttatgttcatacatatttatgatgagaggtttgacttattttatgctttttaaacataagcggtttaataagtttataaaatgacttgctgtaatattttttgcctttttttcctagcaagctcatgaggctttcaaaatggctcaatcccttgatccatcttatttaatgtgctggattggacaagtaagaaatataacatatagttactaataagcttgttgatatcaataactgactaatatgcataacagtgataataatggtaacggatagcatttgagggcttactttgtgccagtcactgtgcttagctctttgtatacactatttcagttaatctatcaatcatcaattctttgagatatggttgatgttatactctctttatagttgtggaaatagaaactcagagctcctaagtgtcattcctaaggccacgtagcttgtaaggatttaactctgacttggggggcctttgaacacttacc

SEQ ID NO: 116528 - DNA, 1042 bp, Homo sapiens
gcaccatctaaagtgaatgttcatgttttaggagtccttctaggtcagaaagaaggaaaacaagtattaaagaaaaatgagctcctccaccttggaggaaggtaatttgcaaagattgccagttaataacatttgaattgaattaaggcattgtaacaaaaaacattcacttttatattcccgtaggtgttatggtcgtgcattaaaactgatgtctacatctaatacatggtgtgaccttggaattaattattatcgccaagcacaacatctagcagaaacaggcagcaacatgaatgatcttaaggagttgctggagaaatctttacatgtatggtataaataaattttttataaaccttttcaaaaacataatgcttttctcgaagttgttttggatgaagtaaatagtgttttcacataaaaccacatatatcttgatatacatgctgctattccaagaaataaaaattaatctaatttaacttcttttcagtgtctgaaaaaagcagtgagactcgacagtaataatcacttatactggaatgctcttggtgtggttgcatgttacagtggtgagaattgagtaacacttcaatatttttagaagattgtgtatttcaaacaaagttcagtttcatcaggttttgtatttttcaggtattggaaattatgcccttgctcagcactgtttcatcaaatcaatccagtcagaacaaattgtgagtattctatgtgtctatgaaaaagaacttcaaaatttagtattactaattttctgagactttcaactagacaaggggcctattttaagaaaaaaaatgttatgttttttagaatgctgttgcatggaccaacttgggagtgttatacctcacaaatgaaaacattgaggtaaatatgttgcctgtctgtcatatttaaaacaaagaatgttttctatattattgtctcctcaatagctcagcttcttgtggagaaatgtttttgcacatcgttatctagccagtatgctctccagtatgctagttaattgatgata

SEQ ID NO: 116529 - DNA, 1087 bp, Homo sapiens
taattttgtaaaactctttcctcaagagaaggagaactcacatttaagaaatctttactaggaactttaggtaatcactatttcatttaattcttatagtatagcttgctatacagattttaatataaaaagatcatatcttgtttcacaatagttaataagtagtaatatcatggagagtaacatatagataatatccacattttttgtagccaaagttttagcaggtaagtaacttgcccaaagtcaaggaaattcttgggttctgtagataacttttttataacttctagtgcatgtttactccaacagaattcttccatttgaatttcttattgagtgaatgtaggatcatgctttaagataattttataacacaccgttaagttttattttctggaaagtgctttaaaataacaccaataactttatttgaagttcattttaagtgtttattttatatgttttaataacagtgacaaacttacctgattttaggtttgggtgaatgccatcttatgatggcaaaagcagctctagttgattatcttgatggaaaagccgtagactacatagaaaaagcactggaatattttacttggttcgtattattcttattatttattgtttatttttgtaatattaaaatgaagccaaatttagaagatcattttatgtattctgctagatatagcaattgctcagaatgtcaaacataaagaataacagacaagccaattctataacatacatgttgtattaattttgcacttggggaaacagatataatttcttctgctcttagtagtggctggcatcctagatgcataggaaagaataggaaggaaggagcagtctgctagtggaacagcagctctgacaccatgtgttagtgttctctttcagtaggcctggaaatgagtatctttaattggaaccgattgggaaatagggcttcaggtgctcaatatgctgtacattcagtggtaagagccaattgtaggattattagtaggtcttgaaggtaaggggaaatgacaatctgattgctcctgaggagaaactgtgaaggaaaaaagtgatgtgt

SEQ ID NO: 116530 - DNA, 1034 bp, Homo sapiens
ttaggaccatgcttttctgtgttcgttcgttaattaaagcaaacattgctgtggttgtgttgaaggagatttatagcagttctttacaattattttctagatttctgatgcagataatatcccaggacttttggttctcaaaagcttggcctatcggaacaaaggttcatttgatgaagctgcaaaggttggcttttttattcaaactgagcattttttgagttaaaagcatttttatttggctatagaattgacaggtgtctactttatagattatggaagaccttctctcttcttaccctgacctagctgaagttcatgcccttgaggctttgattcatttcaccaaaaaggactatctacaagcagaaaaatggtaaggatatataaattgctcatagaaccatttacatcttagttctttatatttctgaaaaattcaaaatgagtaggcttgatgaagatttgatttttcatgaatttgatctttgtaggctttaagttttagtattttaaagaaatgtatttagcatgtagtacagtagctataaaaaattatatgatgggtttcaaatctaattagctgatcttggccgggcgtggtggctcacacctgtaatctcagtactttgggaggccaaggcaggtgatctcttgagcgcaggaattcaagaccagcctgggcaacacgatgaaaccccatctctactaaaaatacaaaaagtagctgggcgtggtggcacatgcctgtagtccctgcttctcaggaggctgaggcacgagaattgcttgaacctggggggtggaggttgcagtgagccaggaccattccactgtactccagcctggatgacagagcaagactcggactcaaaaaataaaaaaaaaaatctaatcagctgatcataatgttcactaagcagatgtaatgttcagtatagtctgaacacttagcacatggtagtgctaaaaggccactgtgcttttttaagatcctcttcttcaaaaacaaatcacttttttccttatgataa

SEQ ID NO: 116531 - DNA, 1056 bp, Homo sapiens
ccttaatttcttatatttgttacaggtgctttggttgtgggctaacctttattgtttagcaaatatagatagccattgtcgttttttaggatattcagttttattatatgttgtgtgaagatagaggttttaaattcagatatgttctgttttaaattcaggtctttccataaggaagtcagggaagaatttatatttagctttgagttattcttcatgtatattgttttggaaatttatgcttattgtatctgcaatttattatatgtcatccttaaaaaagaaaaaataaacagaagtgatatggctgtcttcatttggatacccttaattttgtcagctctgaagatcgtagataatcttggtgcgtctggtaacagtctttatcagaggaatctttgtcttcatttgaaagcagaggctttgattaaactctcagattatgactcttcagaggaagcaattcgtacgcttgatcaggtagacttgtcaagtttttttcttcaactctagttagtttccaatcaaccaggcaacaaccattctctgcctaccacaaaatttacttatatggattttgtgttagaggtatgaattcaccacatctgcacttttataagtcattcatacatttgggaacttctaaagttatttgtttgctttttgattaaggacttatagtactcatcatataagactatttcgttagttctagacttcattctcgtttcttccttttgccctcttaggttattactacttgattattattaatttgagattccaaattttttccttcaggaagtgttctgcagatttgacaagaataattaaggacactgttagcttcatggtagagaatgtttatttgtttcattcaaagaaagattcatatttcataatgaaaccgatttcttagtgttttgagttaaagcaatttgaaagtccatagtgaaaaaaactataactggtaaattatgaattatagcattatgccctaaagatttttgtcaggtaaagactattactggtctaaattaaaattgagtttttaaa

SEQ ID NO: 116532 - DNA, 1034 bp, Homo sapiens
tatttaaattaaatgttaatattttctgcatttgctggtctatttaaattttgaatttctggagtcagcatgtggtgaagaatgcataagaatataaaggcagattttgagatttaagaatatgggtttgggcatttagaaactcgatatatgtatactaataacctttccttttaattccaggaaatcttactgatgaggggcagcagtattgttgtagattagtggaaatggattcaaaaagtggtccaggcctcattggcttaggcattaaagcattacaagacaaaaagtatgaagatgctgttaggaacctaacagaaggtaaatgtacagtgtatggcatgtaacgtgaagtataattattattcagtcagtaggcatttatctttgagcctttctttaaggaatgtctatctaaggtggaagggaaaaaatgtacctgcataccttggactctgcttaggtttgaactctgactctgcttatcactaatttcaagacctcagaagagttaaacttactgtgtgtcagtgttttcatttgtaaaataggtatatctatatagaaagagagaaaaaagaaaagaaagaaagcaaagcaaaaagtaaattgggagggagagggagggagggagggagggaggaaggcagacatgtagatatatatgcattaggaacttaggctttaacttagtcttactaggtatgatgtttctggaagaacctacattcaaattatagatctgaatggtaaatacaagccaggtaggtggttgaagggaatgggaagaacattttaggcagagatgaatctgtgaaatagcctgagctaagaggaaaactgttgttcagagaactgcaggtagttcaccagggtttgagaatgaagtgtatgtacaggaggggacaagaagtgagattgtagaagggcctagcaagacttggtaaggagtttgcacagtatcctgacaacagtggggaatcagtaaaagatttttagcaggggaattttataatctgatttgtcttttt

SEQ ID NO: 116533 - DNA, 1971 bp, Homo sapiens
catgctcttgtatcttcatgtactttgtttgggaggaagagagaactgatgacaactagcttgctgggagttgggtaacctgtagctgtggaagtcttgtgtccagggctggtattccaccagttaacaagaggttggctgtattggtttttccaccagcctctttccttttggtcagtatctgtgctgaatagatttttttttttaataacctgaatttcatgccctactctcttgaggtgaacaaattcacagaagtcagtcactgaaatagaaatattagtacgtacaccagtgtggtagtgattgtcaattattgtggagctttactaatccatttaatttttttcactttgttgctaaatgagtatatacatgagaatgctttgtatgtgaatgaccctcacatgtgtcatagtgaaaaaagggttgaaaactactgctaaagataactgtgaaggaaaattccttggtagaaaatgaccattgcacctatctcagttctcctcattttaactctcctttaaagtcctcttttacttttttttttttcctggtgtctgaattaaaaaatgctgttactggccgggcgcggtggctcacacctgtaatcccagcactttgggaggccgaggcaggcggatcacgaggtcaggagatcgagaccatcctggctaacacggtgaaaccgcgtctctactaaaaatacaaaaaattagccgggcgcggtggcgggcgcctgtaatcccagctactcaggaggctgaggcaggagaatcgcgtgaacccgggaggcggaggttgcagtgagccgagatagcgccactgcactccggcctgggcgaaagagcgagactcctcaaaaaaaaaaaaaaaaaaaaaaaattgctgttaccttcagctctggttttggtagaagcagatgccctttgccttactttaactgagtcaaagatagacttaggagagtactttttactaccataagaagaaagagaacataaaaagtatagtgagtggagtataaagtcttaaactaacatggtgtgcaggacagattgtatagaaggtggactagctccagtacactaggtgacagtaggtttgaatgaacgaggagtatgatagtgaagatagaaaggaacagatgaatgaaaaaatgaaagtgatttcttagacggagagacaaaaatcaattttaactttcacctctcctgaaaagttggcccaatatggcatgatgatttgtatgaaatgtaggttattgagaggagatgttaatggggcagttaatgagaaatgcccatcagtggtttgcagatgagagatcaatactaagcgtagacatatggtttggaagtcatttgcatgtaggtgaaaatgacgtggaatggttaccatcagaggaggactaaagggaaaaatactgagaactgtactttgggcagtgctggctggcttggagggaaagagatgaaaaagagaaagggagtaagtgaaggaagagaagggatgaggtcagagaagaaggtggactctgacgagaagcaacacaagacgacagggaaagagcatttcagaagtgagattattatggtctgtcttgacagattgagccaactgagtttatgattgtgaggctttttattaaggctatctttttaaatgaaagtgattgaattagagcttagattacagtgatggggaaagaataggaaaaagcaggtatacaaaggaaagtggactaagtgcattagggagtagtaggatgagaaagtgaagcccgcagaggggatagtaagcttttagaggggtgggagaagaactgcaatagctgcctggcaggagtggtgtaagaagaaatagttagtaggtgagatagttaacattatgagagtgttgcactgaggctgaggaggatgaggtacatcaagcacaaggagcatacttaggaagtcttgtgattttttt

SEQ ID NO: 116534 - DNA, 1676 bp, Homo sapiens
actggtactagagaagcttttgggagctggcaggctctgattggtgagtgacgatggtaggtaaaactagacttagagtcatggcagctactggggaaaactggtcttagggttacagcaggccctctcagcagccgggcttttggaaaatttaaatcttggagcaggtgctatgaggcctgagtgccttttccccctggtgctccctttactctgacttaggtgacaagaatgacccaatttgtgtaatcagtgtgttcacagatagaatggagcttgtactgcatattagggacagattattaggagtgttgtgtggaaacactcaagtctaataatatgactcgcttaactcatggaaatgttcttattttctctggaataatgtaaaaccttaagaggctaatttcattttggctactggttttgtttttctttccctagaacatacttgctaactgcttcaagctgttttattttacctttagcaagtagctgttatttctgaaagcaattatctctacatataatttttattccagttggcaggtgttgtttaaacatcattgccactatttattttgaacatatttggtataatcgcactggggtgaatctactttcctagtcttaatcttgagaaaaatccatgtgtctaatatggggaaactatcatggtgaaggaaaatatgagagttggattaagtgaaatgagatggagaacagctttgtgaatttgaccagtagcagtatggagacaggcaggatgattgagtagttattgttctttttatacccagtattctcaaagagcatggggaggcatttggtggaggtgtcagtatccctcgggcagctttaaaagaaaccacctgttatttcaaagccattatggtcactcctacagtccaactccttcccctgaggaaactgaaaccagataggttaaatggcattctgaagtttgccctgttaagtggtagatatagatttcctgactcatgctagactttctgttattgttagttcatttgcttcgaaaatttactaacctactcttttaattttttttaaatcagacagtgttaaagcaagagaaaaataactataatgcctgggtttttattggcgttgctgcagctgaactagaacaacctgatcaggcccagagtgcctataaaaaagctgctgaattagagccagaccaattactagcttggcaggtatgtagaaattttttttttctgtattatggaaatggatttttttttgcatttttcaaaatacaggtttcaacattaaactaagcatttaaacctacatttgccccatgtaagaaaaaatttaaatttattggttttctaaacctaaaagttagtttagaaaaaaagtggtgcaaaggatgttgtttaacactatttaatatcctacctaatggattatttctaatgtgagcactcaaatataaatctctaccttagttatatgtgcatataaaagacttctccacaatattattctttatgcttacctgaggaaaaagaaatgttttttaatgtttcctaaaaataaaataatataaaaatgttaatgtttctatctttgagtgcaagttaaattcttttttcttacttagtggccttaatgtttttacttagattctccaactttttcac

SEQ ID NO: 116535 - DNA, 1641 bp, Homo sapiens
tctttttatggctgaaattagtatacaacccttttgcattatccattgcttccattcaagtttaaacattgtttttctttagaaaaagtacaggtaataaacctacagtaatccttattgtgaagaaagttaatatcttgatttatgtttcacagaaactagcattaaaacaatgctttcttaaactttcatatcacagtcactgaaattatttgtgttagtgttttatctgtgacttgggcttattctactggatctagctttgtatagagtgggagagttggattgagattggtatgtgttttgagtcctgatcaacaagatcatttgtattttagccaaaatatatagagaatgaatgtaaataaaatataactcaatttcaacacttattaattgatcatctataatttaagatactaggtcctggggatgcggcagtgaaaaaaaaaattcttgcctgcatggaacttagcttcttgtggggttgggacccagaaaataaacaggataaataagtagaatatatagtatattaaatgtgacaaatgctttcaagaaaaataaagcaatggaaggggttccggaaataatgggttgttgagagtagggggatggcaagattaaaatgttaaatagcatgtcaaaggaaggtttcattgaggaagtgacatttgagtacagatctgaagaggttaaggaataaactgtgtatattctagagggaagactgttccagagagaaggagtcttttccttttccagggtcccttttcagatggctaagtttgttggaacatttacgattgggtaggtattactgtagatttactcaggctttctgccttgacagaatgtccagcaaggaagtgaagactgctctaaaaagtgctagagatgcaatcagaaacaaagaatacaaagaagctttgaaacactgtaaggtaaccagtatttttttcttccacaatgaaagtatgttacccatttataaacattgttgatttgtaatatgtgaattatttcctgtccaaacagcaaaagtggtaaggccatttagtagaaccattagaatggttggacttttaacctctagttagcaggataaactacctctgccaaacttaactttctctgtattggtaacttaacaaaaccaagttcttaaaacctgaatatcccataaatatcttttgatggttgtatcgtggaatgctactgtatcttaaagttttcattgtttaatggcatgttagtgttctatttctatttggtttgtggatgagaggaccaagattataaagcttatttttatgctgatgggtatgattccattcagagggagaaattggactcgggggagagacagagggtagtggtaggagtgaagtcatcagtaggtgagagacacactgggatccagagcttgagggagccctttaatccttcttccatcttagcaggagagaagataggtgcccatccatacagtgttgggcttatagatttggtgttgggaaaagctttcttctctaatggcttctattttcttggcaaagtataagatgagactgggagaagacttggttattggttaggaggtttgagatagcagaaggtatgaaatagtttctttctttg

SEQ ID NO: 116536 - DNA, 1039 bp, Homo sapiens
atattgtggaagaatattaaagacatctccctctcttgcaagagagctagatgtttctttgacgtgttagaaatccttacaatgaagggaaatatccaaaatagaggagtatggggttacgtggaatcattttgggtagtaggtttttaccctcggaaggaaaatgggtttaagtggtacctagtagatggttggatctcaataagggtttgtttagaaaattggtgaatggacgtttccctttcccctcaaaaataaaaataaaaattaaaaaaaaaggaagtagtagtttttagggttgaaaaggggcagattattttgtctttttacaaattaaacttctgaaacttacgtacatatatgtgtgtatgcatgagtgagagaggacctcagtgctagcgtattgtgttaaatgttgcatcaaatgaagaaggaattggaagagaatagagggttccattgtagcatgaagaattgtaattacatatggagacatacagatactgaaggacatttaatattagaattgattaccaagagaaaaatggtgtttgtttctatatagtggtctttaaaaacaacctacttaaaaattactaatggcttcctatttgctgctgtatttaacttcacacttgtctgtttgactttcaggatctgtaatctgaggctctatttacctacccaacctaattttcttctgtttaataagtcccttctgatccattcagcctggctttctcactgtttcctatacttgccacaactcattcccacttctgtcactttgctaatgcatttgcctctgagtagagcaattttccttcttcactccatttttaagtcttgtcatcttctattaatagaagccattaataacatcacaccacacacctttccttctctaaattcctattgcacttccactcattacccttagtttagcatttgattattgaatgacttatatgtcttaagtctttctcttgatttagattatattctttatatattttttatatcgtgcacagcaaatagc

SEQ ID NO: 116537 - DNA, 1067 bp, Homo sapiens
ctgagttaatccaaggagtggcaactaattaggttgtattaaaagcctgcttgttgtaatagtttctcagccatattttctcatgtaatactctctgattgaaaagaaagtactttggttcctaaacatagaatataaatctgtgtcctattccttctctcaaaatctgagttctaccacacatactgctggtgttataaacccgtaaaattccacctctgcaacaatactaatagtcacatatagtaagagttagctatgatttaagcaaaatgagacgccagtgtcagattgttttgatggtgtgatgaatacaaaacttcctattttagggtttcccatctgttagaattaattagaatctgttagatgtaattctgctgaaattatggtttttttatttttatcaaaatatattgaatatctacaaagaaaaatgaatttttattatagctatttaaatttatttacctgcattcagaagtcagggtataaaatttttctattttagcttatatatgggtggttagtcattttgtatgaattgcaatttctcttaagtggagtattatgttttagtataaaatattttttatttgtgagttggtatctggatttttaaaacacttttctcaattgatagatcacttcagagatacctatttcaacagaaacttaaaaagcaagcttcctagaaatgcccaggactgctttctcaccaattatgtcagctacatatacttaagagcttgattgagaaaaatcaagcagtcagataaaataaagatttagagaaagtgaattaattgagaaagtgaattaactgaattatttaatttataaatgagtaataaagaaaatatctctggtttataatggatatgaaattcgtatcactattagcttagatagctcagattatagttaaaattgttcttttaataaagaaaagatagagctggaaacaatttaaaacctgaaacttcagcaacacatgaagtatacatggtaggtagatttttgaaactataaatgtttagtgataaaaggaaattatagtagctttg

SEQ ID NO: 116538 - DNA, 1014 bp, Homo sapiens
tactgtcccattattccctatccaagaagatgctaaatcaaacttgtacactatctgtcctgcttccagcccttcttcaaaggtgggatttccataatcctcagccaactttatgagcatgatctggtgattgcttagagatttgggagaaaaagtagcagagaagaagagttctgactgctcttatcacttcctgttgcacagaaactgtgggtcagaggtgataccaatctttttatcatctgagacatgtaaagtgctcatatccaactgatctttcttttctcattcaaggcactaaggggaagattttttcccctattctctggtagaaacctagaaaacaagccggcatgatctccagataagcagctttgagcaagagttcccatgggtattatattttcttcttcctctagtcagctgaagagcaagcagtagacagaccactgtcaactttagacttaacttgagaacagtaggtaatattcagatgttaagaagcatagtgacaaactcttatagggtagagtggttataaacttaatgtgatagaataaaacatgaactgaaagttttaatcggtttatcatgatttctattgtaggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttggtaagtaatgtagttctgtaaatatttatttgtaataatgctggagaatgcaactgaagttgtcagtgagtcagtctttcagttagtagtcagaggtcctgctgacttgtttataaccctgagcaactcattcaactgtgagtcaaatctgtactctgaagaatgaagagattgtttttcat

SEQ ID NO: 116539 - DNA, 1099 bp, Homo sapiens
agtggaagtatcaaaagaattgaagcaaatactgtaacagttatgttcctttaaataatagagaatataaaatattgtaataatatgtatcataaaatagttgtatgtgagcatttgatggtgctcgatgagttacttgtatttgatgggattgtttggatgtatttaatgggagtatttggagtatttaacgggatgtaaaccctggatgtacctgattttgttactgttttattttaataggtaatatatatacagggtaaaagcttcaaatggtacaaaagggttaacagtgatcgtgaagtctctgtcctttccctcttccctgccatccagttccccctccaagaagcaagtaccgaaaccacctgcttacgcatttttagagattggccacaaatttataaacaaatgtatatattcctttccccctacacaaacggtaacatactgcacacattgttctgcatgttgcttctttttccttttttttttcacttaacagtagatatctagaggtgaaattactgagtcaagactatatttagcaaaattacactagatactacaaattacctctaaagaaggtatactaactgataatctcaccatcaatgcatgtcttcttatcctttgccaacctaacagataaaaatgttctatttttatttttctttttatgagtaacgtagagcatattttcatgtatttaacagccactggaatctgctttaccatggcctttcctatttctattctttgcctatttttctgttggttgttggtctttgttttgtattacaggtgtgctttagatattagctttttgtaagagatcctgcaaatatcttctttccagtttgtcattgtcatttgtcttttgactttgttctggtattttttgatatgtagaaatttttattttcatgtaagcaaatttatgaatctttgtacaccataagtatatacaattatgatttgtcaattaaaaatattagtacaaaatttacagatctttgcttttgtggcttttgggattttgtatcatatttagaatggccttctccacttgtcatttttttttttgagacggagtctc

SEQ ID NO: 116540 - DNA, 1027 bp, Homo sapiens
ctgtgaaatgctacagtattactatatttgaagaaggtgtggatgatgaaatatcttcctaaagttagaatatttatttgaagttgacaactgatttgtaattttgttaaatatttgtagacaagtgtgtgtttaatatcttgagcattccacagcaaactttttttaaaaaaatatttttagagacagggtctcactctgttgcccaggctggagtacagtggtatgatcatagctcactgaagcctcaaactcctgggctcaagtgatcctcctccctcagcctcccaggcagccaaccctacaggcaagtaccaacccacctgggtaattttttaaaaacatttttatgtagagctgggtctcagtatgttgcctaggctggtcttgaattcttggcaattgattttcccacccaggcctcccaaagtgctgggattacaggtgtgagccactggcctgagtcattattttgattcaagggcaggatcaaacctataatccttaagcctgttcctaaaaataatattgagatatttcttagtcttgatttttttcccaccttttaatttctatatttggccaaaaggatattaaagagtggaataggagacaaactttagaaatacagggaaaagagagtagtaatggttatattctgaatataagctcttacttggatactaatcagtatttgatttctaggagggtggatgtatagggagtaagtgaacttacaaagagaaaagggtacagggtaggcacaactctttatagaacaaccaaagtttcaggacagtttcctaagaacctcgagttttcttcatgtattatttattgtttagtacacagacgtgaccagcattggaatttatgtggcctcattgcctgcctttttttttccaggttaccacctatttgcaattcaaggagaatataagacagagaagaaagctgtgaatgaatttcatttgattagcaatagattggacactctactgatcttgcctctctacaacctctcttc

SEQ ID NO: 116541 - DNA, 1066 bp, Homo sapiens
ccctggaactgatttacaaggggtgggagaatttgattttcttcataattctagaaatctttggagtattttctctttggcatagtttgagaagagatgtgttgttgttgccttgaagttgaaatgaggtagctgtgtttcccttccctagttctcttctatagatccttagccttaccctggatccttgccttatatacttggcacttttaaaacaaatgtgctgcagattcattagatgtagcacattatttagtgtgtctttctctctctttcccatccgtttttttggtgtggtacattattatttcatttcacgtttctatatcttttactgtttattaaaaatattccacaaaaagcagtgaggtagtttaatagatttacagttttctttgcagggtttgaagctctgatttggattacaaattaagtatttatagtcttcacatcctcaatcccacagagttaaggatgcccagacccattttttcataacattttcccttaaaggtcctccccttccccggatacctctccagtaactctggaattttgaactatttggaattcaaaaagcagctacttttgatttattctctcagagttaaatggctgcttaatattggccccacttttgtttagttttttatctcatttgtcttccttgttatacttacgcactctgttatacttggatactttgaacttgaacgctgtaacagatgcagttggaactgaatgagctgtgtggtttgggatttggcagtttgagagttctgctgggaagctttcccatttttctgcactgtgtcccacttcccttctgcccccttgcaccctctaccaagttcaaccctttgcctttgttgtttatagtccatattttgccttttttttttttttttggttcttttacctcccttcaaaaatactgtacacatcccagttttgatagggtattcatgacaaaaaattctgcagttcttgttactctgagtgtacttgtgggaaatgagtggctgggagggtatggggaactgggggaggcactgatgagaagaag

SEQ ID NO: 116542 - DNA, 1370 bp, Homo sapiens
aagtcagcaattgtattattttgacatatgagaggtattaggctgatgctgagccctagaaaactctttttgatgatctgaaggtctacctgattgggaaggatagattgttcacatgaagatgtgggcttgggagcaggatttttaggtagataacaatgagtgagctggaaacactgacagtgctgcctaaaagaaaggattgcttattccatggctgatagattcattgggttcaggctgcttcagccattgctgctgtgcatattattgtcagatatcttagggccaactcaggattcagtttgatttggtggtattttacagatcttcttagtggtatttcctagtaaagctatttttaaaattttatttttacacattattctaaaaacttttaaattgaggtattgcgaagtaaaggacataaggtttactgatcttagagtgcagctaaatgcatttttacctatgtatacagccacgcaacccacatacatcaaggtatagaacatttgcagcacttgagaaggctccctcatgctcttcccagttaataacgctcctcctcagaggtaactgctattctgacttctaacaacacagattagttttacctatttctgaacttcatacaaatgaaattatatggtatgtagtagtgccttaggttaggctaatttcagttagcataatacttttgagatttgtccatgttgtgtttatctgtagtttgttctttttattactatatattagtccattgtatgaatatgccataatttatttatccattcttcttttgaggatgcttaggtcgttacccaggagcgggattgttgggtcagagggcaggtatatatatagcattagtagatacaagtaaggcaggcatgacctacccgtgaccccatatcccctctacttccctatctttctttttatttctggtcatgattcataaaagagttatctgcacttcctgagtccatttcctattcattcttcagtccgctacagtctgactttgactttcacaagtgcaccaagtttgttctccctcagggtctccagttgctgtggtctgaatttgttccccaaagttcatgtgatggcacagtgttgggcagtgagactttaggaggtaattagggcaagaggactctgccctcgtaaatggattgatgctattatctttaaagtgggttaattatcatgggagtgggctcctgataaaaggatgagtttggcccccttctgccctctgtcttgtgagctctcttgtacttctgccttccaccatgggacgatgcagcaggaaggtctcaccagatgctagcaccttgatattggacatctcagcctccaga

SEQ ID NO: 116543 - DNA, 1054 bp, Homo sapiens
caaatctcacgttgaattgtcataatccccatgtgtcatgggagggacctggtgggaggtggttgaatcatgggagcgggtttttcctgtgctattctcatgatagtgagtaagtctcatgagatctgatggttttataaaagggcagttctggtcatgctctcttgcctgctgccatgtaagatgtaactttgctcctcctccaccttccatcatgatcatgaggcctccccagccatgtggaactatgagtccattaaacttccttttctttataaattacccagtctcaggtatgtctttgttagcagcatgagaacagactaatacaaccactttatgatattttctatagagatgagaatgataatcagtggaatctgattatcagttatcacacactcaactatacatggaagtgactataaaccacaaatagttcattaagcctaaggttaaattccctttggcaacatcccccaaatgcccacagttactccagagctgcctgatacaagatgaagtgatttggagtggaaagagacaatagtcttgactaaatatcttagtttgcaaattttacaaaagaatatgaccatgtgaagatatattgctcaggttcttcctggggcttggaaaggatccacaagaaaagagtcttgaagcttgagcttcatcagctttatggtaaattggcctctggtgtgctattcctggtttgtctctttctgaaataaattctctcagaatagttatcctagaatacaagtcagatcatggcgctcaatgctttgaattctttgagaactttcttctttgcctcttattttgcaaaatttcaaacctaagaaagttgacaagaataagacattgaaccctagattttataaacacacacacacacacttttttttggctgaactatttgagagtgaattgtaaacattatgagatttctttattcctaattactttagcatgtatcatctaagaacaaggccgttatcttattaagcctaatacaatcatcaatcaagaaatctaacatactatt

SEQ ID NO: 116544 - DNA, 2477 bp, Homo sapiens
gctgtgttgcctaggctggtctgaactcgggcctaagcaatcctcctgccacaggctcccaagtagctaggattataggcatgcatgaccacatctgccttctaatctcttttaatctggagcagtacgcccagtgggtttggggggagggaccgtgtctgtcataatatgaacatttttaatgagcccaggccctttagtttgcataattccttcatttatgataaatgtgcttgcaaaatagtgatgtttctatcgttcttcctatacttattggttgatattcttctgtaaatggagctttcctttttctctgctcccaaatttttctcttagaattattatgattcatggatttctattttaaattcagtattttgtgatctgttctgattattcttttggatgctcacattgctccatatttgcttgcagggagtcatttcaagctacctctaatcagtttttagccccttccttattttctggcacaagatattccaggctcagactttgcctatcccagtcctagaatcagccatttcttcaggaactctggttccttctagggggcaatgatatttagaaaccaaggtctgggctctaggatgctcatgactttaggtgtctttacttctgcgccctttaattggctagagctagggattatactttttatttaaattatgggcactgatgcccttatttcaatctggtattcgtatctcatttcaataactttttcttgtaaaatctttacctgaaatacaagatccttcatgaggtagcctctgactgtttctataatcttgcagggcacaatcccctgccttatgtatcagtcacactgaactacttgaaaaacttaatgtctttctttaggtctaggaaagtcttaactgtgtgacttcagatatcaccatccatccattttctctattctcttcttttgggacttttgttagactgatgttggaacttctggatctcttctctgattattttatctttcttttatatttcttattgctttatttctttgtgttgcattatgggagagttccttggccttttcttctggttcacacattagttctgctgggtctgttctgctattctgccttattaaattttttatttcaaaagcttttcataccagatctctaatggctgttttcataagttcttgttccaatcttaaggatgcaaacttttatttaaaaaaactctcagaccaggcgcagtggctcatgcctgtaatcccagcacttcgggaggccgaggcgggcggatcatgaggtcaggagatcaagaccatcctggctaacacagtgaaaccctgtctctactaaaagtacaaaaattagccaggcatgctggcgggcgcctgtagtcccagctactcgggaggctgaggcaggagaatggcgtgaacctgggaggcggaggttgctgtgagccaagattgcgccactacactccagcctgggggacagagcgagactccatctcaaaaaataaaaaaataaaaaataaataaaaaaaactctcaggataattaatgatgcttaataattcagttttgatttttctattaagtttggttttaagatggcattataagtcgttctacttgatgagattttattttatggtatggatacttcttaaacattggggaattcttaatttgcctacttttgcagttgactttccttgttggattgatgccttcctctttctctgcccagctgctgtctggggatgggggtgtaagtaggaaaacacccaggatcaacaggcttggctgcttccactggggttctcccactcatccccagtcatttgcctttgggccgcctcctccttgttgctccctgcattgttgagcagggagcactctaggtgtggctgcagtgtgagcctgtactcagagcttcaggaggcctcttcggtcctgtactgcctgccttcattctctcaagcactcctagtttctgggctgatgaggtttcccctctagtttttgagtgttgctgtgtattcagtccttcctgcctccctccctgtctttctccctccctctctttctccttcccccttccttctttcctcccctcttccctccttccctcccttcttctcctcccccccatttttttttttttttgagacagcatgtcactctgttgcccaggctggagtgcagtggcacagtctcagctcatggcaacctccacctcaggttcaagtgattctcctgcctcagcctcctaagtagctgcaattataggtatgaaccaccatgcctgggtaatttttgtatttttagtagaggtggagtttcatcatagtggccaggctggtctcgaactcctgacctcaagttatccacctgcctcagcctcccaaagtgctgggattacaggcatgagacaatgcacctggcccctctcccccttccttctttccttcct

SEQ ID NO: 116545 - DNA, 1036 bp, Homo sapiens
gtaaaatagaatggcattggcaaacatatggatggagatgataatgttagaatgaaaggagcattgaaaatctgcatttaagggtcagagttgaagagctgtgcaatactacccttagacctaggccagagagaaagccgcctgccttccagctttagagagctccatctgtccgtcctccagttgcacccctccccacagggcacaagtcagtggagccaagggttgtgcccacctggagctggtggacttcattcctttctagacctgcgctgtccagtatggcaaccactagctacatgtggctatttatatttaaatgaattgaaataaaaccaagtaaaattcagttcttcaagcatatgaaccatattttaggtgctctatggctacatgtggctagtggctactgtattatataatgcatatattacagaacatttccatcaacacagaaaggtctatggaatagtgctaggactatgctcccaaatccagtaccccagaattctccggccactggtcctgggtctgtttcggcctgtgcaggccattttcctgggacagtcctcctgatggtggaccacattgctggtatatgcacccctaggcctgcggggtggccaaagggtgagtctttatggggaatgggggaggggacagtggacagagctttgatgtccacttgtgtgcacagagctctttaaagctctgtgttagagcaggaggtgagaagagaatgggtggtcttagggctcaggaattagggatcagctctccctttgctgtatgaacctctgaagaatctgagaatttaaatataaatcttgcctgccaggcttttatgatgatgtatttgtcaaaacagaagtatagaatatcttttatataacagtttgttttcttgatttacagcgtttaaatatttaggtgtgtggtgggtgggcctccatttggacttttgccccaggccttgcaagctagggcacaggcctgaagctacgtaaatgcacctgagagagatttttagtttgta

SEQ ID NO: 116546 - DNA, 1062 bp, Homo sapiens
gacacacaagtaagaagaaatgttattttattgttccgtacgtcattagtgggtttttcatttgctctataaaatgtaaataaacatagtatttgtgtgtctgtgttataacattctacagttcctgaataattagtttatatatgtttataaattaggttaagcagtagtagaaaatcgctgtttttgtgcatcaaaaaatggttaaatattggctgtttcttatgctttaacctaataatattttaaaatattatacaattatatttaaagtaaacatgaaattgttgggtctgtaaacctgaaaggagtttattatttttattttctttttcaaaacagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtatcttgtcaagtggttctggttacttacaatctcataagctttggaaatgaaatgtgcctgtgacactcaagggtactggttagttttacagtggtctttacctaccatctgagattaagattatacatgaaatattatttgctttatatataagaattggtccaagctttctgttttccttacaaatgtacttgcctcatcttttccctatcaatttcattttattgtggtaaaatacatagaacataaattttaccatcttaaccatttttaagaacacagttcagtggaattaaacacattcataatgttgtgtaactatcaccaccatccgtgtccataattctttgc

SEQ ID NO: 116547 - DNA, 1051 bp, Homo sapiens
cttccatgtgtatgacggttatgttgtgtataggatctcagaatgactttataggaccaggatttgtatgatcctgttttgcctctctgttttgcttatggataccattctggaatgttttcttctgccttaggaggaagaataatatcatttttcccccctcaccgaagattttaaacttcccaccatagtagattagagtaagaagtagatgtcatttattcttattactgctgatgttatatgtttatttcttagggataaagctttcagagttccctagctaggcaagcagaggattagcattctgaccagggctctcaggctctgagattcagcagggggaatgggtggagacgtcagaatttaaagtgaataaaatatgatatttcaataaaaatcataactaagtctttccaaattagggaacaacatagactttaggcaagattgtggtcctaatgaatcctagtatttaaaatgacttattatttcatcatcatttgggtaacactacctgaaaatattcaggcttgttttgtttatccactgtaaatagactaaaatttaaaaaaaaaaaaaaaaagagaaagaaagcaaagcaaagaaaaaagggtggagggtatggaaagggaggccagcccttgacttccaggagggttggcacacaggggatacctgaagaccacagaaaggataaagcactgaggtctgagttagacagagaggctgctcccggagccactagctccagccaggcgcgacaggacagacgagttatcaagggtgagagtctccggaacgccagatcaaaaacccaggaaactctttataggttctagtgggctctgctgtgagtaggaaggacaattaggattataagattggagatgaagatggaggtgaaccagctgggcccggtggctcacacctgtaatcctagcattttgggaggtcaaggtaggcggattgcctgaggttaagagtttgagaccagcctgggaaaaatggcaaaaccctgtctctacaaaaaatcagctgggcgtggtgg

SEQ ID NO: 116548 - DNA, 1017 bp, Homo sapiens
tctaatttaatagtagaattgtgtagcagcgaacaatagtcatttacttttaaaaatatttcctcagaaagatgcacattacttttaactttggtcatctgccaagacagggaaatggaaactttccaatgtaccttccgacaagccacggccagccctgtgtgcagtgtgagcctgggacgctgaaagtagggcagcaagagtgaccttgagatacagaaaaacaactgggaaaaaagctaacaagaggacacagactttatatcatgctttcgtcattttagagagacctataactggctctaagccccttatatgatcacaccttgatttatttgttgcctaaataaagatccaaagtgtctatctaaagacaactttcataaattactcattataggtaggacacgcctagtcagggataaagctcctggtgattacagaattctctcattagcttctaggagaaaactgtctgttgatgaagacatttactaaaagtgtttggtacgctctatccataccagagaaacacaggaatagataattttgtacaatcatctaagaagcttctcatttcaacagaaaagactacatccattgttaagaagaaatatgattggtaaattaaaaaatatttccacctttctaaaattagcttttaaaaaaaaagtctagtttatggagatcgaatcagtttctgcattctgaaagaaggagaatgatgccgctggagatggctgaatgctgtcttccagatgacttcctggcactggggtcacctgtgatttagggttgattggactcacactgagcagactctgcaagatggagataaggtgggggcaaaccattccagtgaccattataacaacctagggcactgcttttcataaccagaaaaagaattggtaatctgaaggttatatggtgaacatatgagagtagtgtctagtggtgtttgatccagggcctggtgagttctggtagatgtcttccgtcctataacatagtgtt

SEQ ID NO: 116549 - DNA, 1610 bp, Homo sapiens
cctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaacgaagtgtcctgtaattattttaccttggatgttgaaatactgaaatgatttggagaatgctgccttgtatttctcaagcataattatgcttcatagataattttcattatgtgtaaaatatctagaatgttgctgatactatagctgactaatatgtgtggtgagataaagaaatttatattatctttaaaagtcaagaccagaatttatctcagcaaaataactgcctttatttagaaaaatgctttgataattaaacatagaa

SEQ ID NO: 116550 - DNA, 2689 bp, Homo sapiens
caacctccgcctcccgggttcatgcgattctcctgcctcagcctcctgagtagctgggattacaggcacacatcaccatacccggctaattttttgtgtttttagtagagacggggtttcactatgttggccacactggtcttgaactcctgacctcgtgatctgcccaccttggcctcccaaagtgctgggattagcagcactggcatgagccaccacgcccggccctctgtgaatcttttcaagtcccacattagcttctcttggcatcttggctaccagtaacttagacacagtgctgatgcatttgttctcaacttgagctgaactttgaatattctctctattctcttttccagttgtctttatagaggacagtttttaaaagagcgtttttgtctggaagcctaagtgcttcttgccacctagttactagagggggttgttcgttacaggtaagatgctttggataaaaggctgctgtgaaaatcactctttcttacacctgtaagtttttccttctcctcccaaggatagagttcatttaaatcagccttgtcaaaggagtgccaggagggtctctaggggtctcgtggccacctgagcttcagaactctgcagctgagaacagctgtaaggggacactagggaccgtcagcaaagccacctttttctccaccctcctccttccctcctctttctctgcccctgttgacaaatctttattgctgtggtagccaattatcatccacccctcccttccttaactcaccctccccacctgctcctcccttctcttcactccctcctcttgactgagtgaatgaccctggctcccctcttctgttagcatgcacatcttaccattttccccttgtctttggttaaaaatgacctgacatatagatggtgacaaggccaggtcagaaatagggacctaaaagcatgaaaaattggggaggatagaaaatgctttgtggtattgggggaaagaacggaacatggagttctctaccctgggcctgagttccagttgtgacattcacctacctttgacccagggcaatttgcctaaacccctagatcttctttctttcatccctggtaatgtaggataatgcctgtgaagtttaaacactgtcacattgaccatgagggacaatcataaagcaacagcgattgtcatgtgtgtccctacaaatccactttttgggggctgtttgccttcagagatgaaatttctggcggttcccagaattcctcagagacagctacttttaaataagtcctgtattcacttttagcaagggcctcatttcagtaactcacaagtccagtcatgtaacagccacagttctgaaatacatttagaactgaatattctcccctcgtccagcttaggcctgctttagtctggaagccaagtgctttttgccatcctccccactcctcccaccacccagcatttcccaggatgaaagggtgggaaggtagggaggagagacaaggagcatgagagggctgattgaatgacagctttgaagtccttggccttggtttcctttgggcattgtcaaagcccaccctggttgcctcggactcctctgacctctcctatggctggcccttgcagtggccttcagcatctgcctccaatagcatactgccgtcacttcaggcaagaagctagtaagcttactgcccatttaaaaatgatcataccaacatgccaactcgaggtgtcccatctggtcgctcacccacactcccaccccagtcatagaccaatcagcacttttgggctggtatccgtgagtgtagtgacttccaaatgcatccttgactctgctagacctttattttcaggcacaagtcacataccagccctgtgtgtcccccaagcttgaggtgtcacaaattactttttctaagtactctttatgaagctgttctctttagccttgtggcaagagggaagctcactgccaaccctctatagaaaccctgatttctaacatgagctgacttttctacttccaccccttacatcagtgaggagccagaagtgaagggagaaaaactggctttttttttttactactcctctctgtgagtcctgcaatatagggttcagaatctgagttacactacagtgtggaagttgtggatgtagatggcacatcttgtgacttcaaccaaagctgtcagcaagtcctgcatgaaaccctcttatatatatttgtgagttcctcagtcatagaagccatgcatatttgttctgcaaatatttacatagactttgtgctaggtggtgggaatacaccattgaacaagagaaatgcaaatgacacaacttgattccagttgtggtaaatgctccaaaataaaaggttggctgtgagaattaataataaggggacgtggcacagtgaggcagtggggtcaggcttccccaagaggtggctaaagctaatatttgttgaggggagagctccataaagagcatggtagacaggccccaaggtaagacggactttaggctcactgaatgtatgtgtatccaaatcacttctcattaacaaaagctatttagggccttgcttttttgttgctgaacttgttccttcaatggcttgtttgcctttactacccattgctggggagatgaagcccagacatgattccctcc

SEQ ID NO: 116551 - DNA, 1019 bp, Homo sapiens
ccaaaagcctatctcagaaacagactccagcttaggggtatccagtctgagaagacataagggcattctcccagctgaatccttaacctccagtttctaaaaatcttctgaaggaataatggaggaggaagggaagaaagcctcaatcaaacattggtattaaaaacccagagtgagtaatgtgggcggttcctctggtcatatttacaagaagcctcaaggatgagtgagtttcacaacatgacggtcgggagccctccccagtcccttctcccactggacctttaacaggctcctgtcctcagctgtaaaatgaaaatatgcttttcttactgaggcgtggaggggtttcagtattgtttataaaagcacatgggaattctgtgaaaaaaatcgttctttacagattatcggctgaatgcaagaaggagtgtttcttgaagcattactttccatatgagaatgaactcattttgactgattgcaaaggggacaaaggcagtagctagaggtttcaaggtgaggtgtttggggcttgttttattgaatgctgggtgtacatgtacctgctctactggttttacctttctgagactgggacagaaagctgacagtggtagtggcagtaggaggctctgatatgattgcttaattctcaagttggggatcagatgattctgccaggtgcaatggtggagatgtgtcatttcaactcctgcttgcctcattcaactgaccaacctggctggtttttcttactgtaattaaatggttggtacaatgtgagcatttgtagatggacaataagaacttcacgtctgtctaggactataaatgtagaagtgtgctccctgcagatgagcccacataattggccagcatgtttgagttctacagctggggcttctagaagcatgctgactgcccttccatacttgctgaattccaaataggcttacagaatcccattgtggagtacatggatagcatgatctaccttaccagtctcgctgcctctt

SEQ ID NO: 116552 - DNA, 1829 bp, Homo sapiens
ttcaattttgtttactgtcttttgctttacaaacagcactacagtgaataatcttgtatatgtgtcattcactggggagcaagtgtgtccataggataagtagaattgctgagtcgattttgcatttactattttgatagctgttgccacattgccttccataaagattgtttcaagttacattcccacagtcaatatttcctatactcttgctgaatgcatgttatctatttgtattgccacacacaaaagaagttgttctcttctgatttctaatatttaattttgtagaatgttcatgaagaagtcttacaagaatatcagaagataaagcaggtaggtatcatcactgttgattttctgacctgtggttgaaaaatgttgtaaattctgcaatctcattcctcttttttttttttttttttcatctgcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcat

SEQ ID NO: 116553 - DNA, 1457 bp, Homo sapiens
actgatgctctaggaaaatggtcttctcttaccagttaagagtaatttacatcccaaagtaaaacagatttatggcattttattaagaaagtaagttggactaatagtacaacactggcttttgttcaacatagtatgacatttaaatgtttgaaaagaactagagaaatatgcctttttttggtctaaccctcattttacagaatggttggtaatttcccttttgtgtttcatgtatttgcttggtcagaaatatgaggaaagggatagaggaagcaagcctgaggcactttgttgaagatgtctgctagcagcatatctgaaaggccaagcaacagactgcctctcataaagcagtaggtccagagagagctttgactttcagcactcacggactgcgtgacattctcctggtttcacattacccattgagtccttctgtctctctgtgacttgtaacagatgggttagcatccaccattagtgtggtagtgaattatcttggatagagaaaggttcaggaaactagatctgtgtaaatactgttttctttttacttagttgcattttagttccattgccaccatgtctttaccacatttactctccttcgttgaagctctcaaactctgtgtaataattttacctggaagatgtttggaggagtgacctggcagccaaccagtggcagagtggcattaaacattagtgacacatgcatggatctaatctctaaatatttggtttaaatctcagacttgtgcaatcatgtttattgggtagctactctccatttatcttttttcttattagaaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcaggtaaatggatttgtaactagatgggctgactttcatattttaccttctttctttccctgccctgctcaacctcagccatcacagtggcctttagagtaagtactcttgcagaccagcctcgctgctgctttaggaaactaaatatttgaaatagttcttgaaaataaattaacatagtaaacctgtatttctaccagtggaaaaaaaccttgtgccactataatgtatcacatattgagaaaaataccaaacacaactaaataggaaaaaaagttggatcttgagattcagctaactatttgattaattacactgccaacttagactacagctcataggtctggtgctatcccaaaacagtgctatttcaagtatttttctttaaacctcaatctgagatagaatagggaagatacaaacataggaaataaagagggcttaatacacagagatttggggtttaagtaaagaa

SEQ ID NO: 116554 - DNA, 1122 bp, Homo sapiens
atgttgagatctacatcagagttccaagtgttctcagagttggagacctggagaagcagacttagtctctttgaattctttactgaggatatagtaactttcagaaccagttgcgataattacaaagttaggaaagctctagacccacatcccctgcattttttggaatttatctggtgtctatggcagaagggaagccaggtgacctgcacttgatgcctttctctttaagactcagactatcgtaaaagcatgttcttttacccaagcatgaatttataggtgagcagcatgcactcagagtctatgtattaatatttgtttagggtactttgtcctttaaaatattaaaccgagaaattacctaacattcacttttatatgttttgccagtgggcatgattagggtttgagttatcagtttaaccctactttcaatgataaaaaattaccctgataaagaatctaaacatatcctctggacatggtgcatttaagcaaatggcatactgagggatttacatactttcactgtgtagccacaatgtttagcacttcttttgtccttaaaaaaaaaaaaatctgtttagtgttatgagtgctagagattataggaatataaatcgacattcaataataccttattttaaattactttaaaccaatgggaaaactttctaccaaattccactgtctgcatacaaaaaagggaggcaataaaaatacagtgaccaaagcagtcggctacctgactctattgtctcatccgccttgtttgaatcccatgaaaagtagatgttgatgtaaaatttgtatctcccattgtctggctgcatctgccaccacaatctttgaattgctgggcagatgccacaactgttgttgaaagaatagaagactgaccttgggttaagatggaattcctttattgtgcagacactgcagtagccagggtgctttaaatgcctggcgtcggttctgctggcgctggtcatagggcctctattgttcatgttcaattgtattccttgctcactgttgcttattgagatggaagaatagaatttgaggaaaagtgttccagatgtttctaatctattttagaattacaggcatttgata

SEQ ID NO: 116555 - DNA, 1194 bp, Homo sapiens
gctttctcttctcatttaatataactaggtcaaccacagccagcaatggagggtgactgcctctgtttaatactctcctgagtggtataatccacataaatcagcatagtctctcttggaacttagggtaaagctgtatgattagaaagaattcagtaagcacttcaagaaacatttgccagattctgctttttgacattaaacatgaaaatgtatttcacatttggttttgtgttgttgttgttctggtttagtttttgtttgggttttttgtttgtttgttttttgcttaagcatgaagaaagcgtgtaatattacaaccctggtaatattaatagtaagtaaggttacttagttgtttaaccagccatgcatgtattgaatttatttaattttagtgcaaactggctcacttttctccttttccctcccctagaaacggcttttggattcagagtttattgatcctttaatgaataaaaaagcccgaatatctcacctgacgaacagagtaccaccaacactaaatggtcatttgaatcccaccagtgaaaaatctgctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggtattttacctttagatgaaccagaagtgcatgctatcatgagtttgaaattacacagtttataattagtaatttctttagcaaatgacgtttcatttaattattaatcttagtgttgtgcttttgagcagtttttttttttttttttcattttacagcagttgttttccatctctttttggccaac

SEQ ID NO: 116556 - DNA, 2102 bp, Homo sapiens
aggaatcctctgctttaagtggagagatcagggaaccttttctcagatggctgcattttagactgcatttagactgcatttaagacttctacggcaagaatggcttggaggggcaggagtagaggagagagactacttaaagagcctaatattttgtgataagacttgctaacggttaggtgtagggagacaatgaggggaagaacggaatctgtgattatagctaggtttttggctgagcaattgaatggatattgagccattgactgagatgcggaaggatggaaaagaagtaggattaagggggagaagaggatcaggaattctgtcttatatagactccatttggaagatgtctattagacatatccaagtggagatagatgtcagtagatagttatatgtaagggtgtggttgtcagaggatagttggggctagagttataaatttaggaattagcagcatatatattgggtattgaaagtcttcaaacttaatgaaatcatcttaggaggaaatgaacagaatgaggaaaacagagcagaaaacaggcactaagtactttagcatttcaacatatagaggattgagaaacagagacttaaaaaacaaaggtcctaggccaggcgccgtggctcacccctgtaatcccagcgctttaggaggccgaggtggggggatcacgaggtcaggaattcgagactagcctggccaacatggtgaaacacatggtgaaactctgtctctactaaaaatacaaaaattagctgggcatggtgacaggcgcctataatcccagctactcaggaggctgaggcaggagaattgcctgtatctgggaggcagaggttgcagtgagctgagatcatgccactgcactccagcctgggcgacagagcaagactctgtctcggaaaaaaaaaaaaaaaaaaaaaaaaaaggtcctaagagaggcggaaaccaggagaatgtcctattacaaaaacctagaaaatggattgctgtgggggtgggggtgtcaatgtgtgtagtgctgggggtaaaagaaaatggaagcattgccagtggggcgtagtggctcacacctataatcccagcactttaggaggccaagggaagattgcttgagcccgggagtttgagaccagtctacacaatatggtgaaaccccatctctacaaaaaatacaaaatacaaaaactagccgggcatagtggtgtccacctgtagtcccagctactcaggaggctgaggtgggagtaccacctgagcccaagaagtcaaggctgcagtgagccatgttcctgccactggactccagcctgggtgacagagtgagaccttgtctcaaaaaatgaaaaagagtaagaagaaagaaaaaagaaaattgatggattgtgtttattccacctcaagaaatctgggtgtatactatattaacttatttgcaaatttgaattttgcaaatttgaattttaagataaacctattttctccttaatagaaacattactgttagaatagtgttcagctaagttgtgagaagcataaactatcatatttgttagtacttttaaaagacacagaaagaatgatctattccagtaggaagtcataagcaagagtaattttctcctagccttaaaaattaattacttttggtttggcacgtgaacctgtatgtttgtgtagttagttaatggctaagccgcgaaactctaggaattgcagttaagggataagaaaagattacacttcggaataaactggctgactaataacagtaatttgggggttctctaggcatatgttttcatttattggtttggggaatttcaaggactttgagtaagtggttcttcaggagaactggcagatataaggagcaagcgtggttatccaaagaaagacagacaaggttatcagaattgatactatttatgaagacagtgtttggttgatgactgaaaggaaagtttgtaacccaacatttgggcactgtttggtttctacttaatacaagtgatcaaggatttttattgtgactcaaaagtaatggactcaattgcccagaagtaaataaggatgttggtaatacagt

SEQ ID NO: 116557 - DNA, 1031 bp, Homo sapiens
ttaagatataagttatcaagtctgttgttacagtttgtgttactagttattatctttctgtagcaaaatgaccaaaatacatgcattatacatattatttccaagaaatgattttattaaaataatttctaattcaaattttagaccatttatttaaaatgctttctgtttgcatgccttcttaaagattgaaataaagtggcctttattattatttcctctagaaatgaagaggtacctaaatcagaattgtggaaactgaggtgctcatattgtaacccacaaatgtgtaacaatgtcatttccactggactttagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtgaggacagctggagagaggtccttcctgcttaccttcttgttaaaatgttcatttaaaaaagcttgttgtcattattatcattattattgagatagagaaattttaggattattttgatcagtggtatgtgaaatacaactcctgaatattaagttaaatcatctcattttaagcacttaattaaaaactagttgaaatgtgagcattgtctttatttgggaccaacaaattttgttctcaaattccattaaaaagaaagtaagaagtgtttgttatctgtttttagtgttgaatacactaaagtattgccttaatttgtattgattattgtcggtgaaattgtgcaatgtattctattggcctttgattggtataagccagaacattttttgcctactaaatagtttaaaatgtatcttgccccacatactttgtgctgcccttattact

SEQ ID NO: 116558 - DNA, 1424 bp, Homo sapiens
ccccaagtaaaactctagttctgtcttcacttgatcaggctcttactttcttgccaaacatcatacttatatcccttttaagggcaaagttagcctcccttatttgtcttctccatacctgctttggggaagcatggggataaacccagtagaccttggagacctcctgagataaggatcagaggtgaatcagaggtacagaggaggtagggcacctgaaaacagtggcagtactgttagtttctctttttatttttatttgccttgctgcttgaattcatcctaaatgaccagtcctagtgtgtgtagcttagctaacaaacattctctgcccatcccccttcccagaaagaaagaagggcttcactgttagcttggtttggaaaagagttaaacaaatttcttttttgcaagacttgttaagggggagggagtgtggaatttatagcattttctaaacttgtgaacttgactctatttttaaaaaatatttcctattaaaattttaaggaatgctaatgtttgttaacgctgttgcaactgggaaatggtggattaaatggtttccctttgccacattagaaatttcagtgtgtattcacactggcagcctggcaacgtggggaagtatggactgtgttgattcctgctcctctgcttacttgctctctcgctgtcattcatttagtcatcaaatactgatttaaggcatgctagtggacaaagcagccactgccctgccctcatagagcttatagcctaacacaaagcaacagcaaacattaggcatttgttcataaaacctttcccacaaagacttacaggcaggaaaattaggtattaatcaaatcacagaacctcccaaatgctaagtgaggattttaccctttgagcatatcccattaaaagcctcagttttctcatctgtgaaaggggacggtacctgccttttcaggtgaaacctagtgagataatgtgtatgcagctcttagcacagtgtcccccacataattggtgcataagtttccagctgatgtaagaaaaatacagaaaccccaatctaaatctatctctgaaactctaattataacttaagtttttgttatcattaggcagtgtccccttaatgttgagttcctttgttgtgtaatagtttgatatttgcaattggttttgtacagatagtaaagaaacataccagccagtagaggtttcagtttgagagcattcatcttttttcccttactggaggtaggatggaatcaaaacacacaggccttctgaccaggcctggggagcccagcatggacagaattactattcagtaaagctcctgccccagtgagctgttttcaccccagaccacagcttataggagctgcttttacccacccattatttctagttgttagtcttgttcctaa

SEQ ID NO: 116559 - DNA, 1039 bp, Homo sapiens
ctgaaactgcttccccaagggagctgtgacctccctgcccccaaaatccagtggatgtgttattggttccttattattctggacttgttgccagtgttgcacactgttgaccactctctcctgcttgaagcgtctgttccagtggcttacattacacagtactcttctggtttccttcctacctctgtagctgtggcttttcagtctcatgtggtcttcttttcttccttttgcttaaatactagtgttcttcacagttggttccctcctgagaccccttctctcctcattccttcaaggtcaccatctccaacactgaacttatgttctttgtcccagtcctgtctcccaacctgtccttcatcttgtgttcagtgtttcagtacatagcagcttccatatacctcgtgacctgggcatgatctttaacttttttcccccacctctctctgagtgtggctaactactgaccacgttttgtcagttccacttcctcactatctctggaagctgtgtactattctacactctcactgccctactctggttcatgccatcactgcttgcctgtaatccttcagtagcatcctaagtggcctcttttctttccttctggtgtcccccttcctctcaatctatcctccatccagattgagctttctgcaatacaaatgagttattttctctcccctgatttcagcctctcgttatcctttggataaggtccaaaacctgtaacacatgaccctcagagccctttgtgatgtatttctcattccctcttcagcttcagctgtaattgtccttcccaactttctttggacaatttgaaaaccttctttttgctcttcctggccctgcacagattagttgtcctccctgaacactttcattcttcttcccccttgcccagtcatctttctagatcacctcaggcatcacctcctctgggaagtccaggtgagattacctttctgggagtcctctgctccctggaatttgtcacactgtgttatgatttccagtttgtccatccttg

SEQ ID NO: 116560 - DNA, 1124 bp, Homo sapiens
cattttgatatcaaattgaacaatgtccccttaggaattttattaaggagcttaatcctctcttcaaaagcattcatatcattgtaagtaatatggctttactcttacattataaataccctgtgtggttatttctaccttccttgtttggaaaggatttaaggtcacttacaaaactatgtatgatgcagtaagagaatagaaacacttattgtgaaaatattggggcaaatgtatcccctctgtataatccaaggtgccttataaaatgaggtagtaagggtataaattgaagtctgccactaggaaaacaaaagcactagcttttgttctcaggctttcacttcacagcctggcaagctgacctgtccataatctggcttcaccttttccattcaatttaatttccattttccttatggatcttttctctctgaccacagtgcatgctcttcaaggtcagaggctttcttatgccctttttctaatttcacagtgctgactgagctcaaaatacatgcttattgactcaacctggagataaaagggtaaaaacagatgctcagtaaataaatgttcaacaaatacaaattaactagtcttcttatctatatttttaaacttccttgattctcacttttctcatatataaaatgaaatcaatgtcacagtcaaaattgcctttcaaaaattccttaagtctacccattttcagacttagtgaaaaatatatagtctaggacctatagtgtataataatgcacacttaagcgaaggaaatggtgagctaggctagagaaagactaagggagcatttatatacatttgtctaaaatatttaaactttcagggtaactcggttgagaagggatgagtgaagaattctagagagtaccttcttgcctacagcgtttagctccgtttgttttgcataaagatctgttttctgacttcgcatgaggggcagtatgttcagcttattctcactatgtaaattacttagtaaataataggaagagatgttgaaatacaaactttctgccaccagaccttcactctattgcagtcattttctcccactctcccccctctctcccacttcctctgaggattaccttcccctc

SEQ ID NO: 116561 - DNA, 1028 bp, Homo sapiens
aaaatagggggaaaaaaactgtacaattcaaccttttaaaaatgcaatttaggctgggcgcagtggctcacgcctgtaatcccagcactttgggaggccaaggccagcagatcacgaggtcaggagatcaagaccgtctgggctagcacagtgaaaccctgtgtctactaaaaatacaaaaaattagccgggcgtggtggcgggtgcctgtagtcccagctacttgggaggctgaggcaggagaatggtgtgaaccaggaggcggagcttgcagtgagttgagatcgtgccactgcactccagcctgggcgacagagagattacgtctcaaaaaaaaaaaatgcaatttagagtctaccagatgggatggtcttacattctctgataggtatggaagtactgctatattcccaaacctgagctatgcagtagggaaaactttagatctaaaccgaagctggagcctcataggaagatgaaatatcatatggagatgagacctctttaaaaccacttttaaaatttctccaaccaggttctgcagatctagatgaagggttaggggagaagatggatggaagttaaatgagtcatgcctagggaggggatttcattcaggtgtccacacctttcttacctatctaggcatatcccttctctgtcagcagaaccctgctcttcccagagaaacaaaagcagacattagtgagtactgttataccagtatgcaggtagccttatgttctcttgtgcctgacgcaagcattcctttggctcctgtttgcctctactgctgtaggattaagaagttgccaatatatgtatgccaactaggcgctgagcgtgcacacccagtaagacagcctgatgaatacctacctacagagtaaattaagacttgttcacaaagttacagcactttagaactggggaaagttttgggaattaaagagtaacgttagggccctcaaaagatatttataaaatagataaaaacacagaaacttgtgccaggagttgtctctaat

SEQ ID NO: 116562 - DNA, 1022 bp, Homo sapiens
tcctacctgcgtgtaacactatgggtatatttgagcagtacgcagacacggcaggggcaggcatcagggcaaatagtgttcactttgggaccaaagggtgactcttgatgcacgtcatgagtttctttgcagctatggagctgaagtggagcttagaggttagggaacaaagggacatggagcccaggccaatcagagttctacattgccttttcttggtagtttcagagcagcatcaatgcagatggtatggtctgagctaagcccaggccaatcagagttctacattgccttttcttggtagtttcagagcagcatcaatgcagatggtatggtctgagctaatctgaagcttttcaagagcaagatgttttcaggcaaattttacatccttaaaatttcaaaagggtttgtagacttagtgcatctaatttcttgaagatgtattaattagacacaaagttaattgtatcaatatccaagtatactcttaagaatgaaatgggtatataaggtagcacttatgtttatggctggtaaggctgtgtaacaatttggccaatggacaggaaagcaggagacttattggaaagagcaggtaatatatgacaattagggcaggttggtgagagggaagctttagaactaaactatggcaacttcagagcagaccagaacctgtgggactgttgaaggccagagctagggtgggtctgagaccttgtctaatctagagccattcaggcagagtttcagaggaacctgtggatatgcgtcagtcccctctgatatgcaggagcctattccattgtgtatctacacagttcttttttccaaaatggttataaagcattttcttaaaaactagccttcaggttcatgaaatacgaggaggaggaagtgaaaatgtactgactgctactggtagacctagggtcagctttgaggactgaggtaaccaccacaggaaataagttttgaggtctgattttgaaacaatattggaagaccattcctttgtg

SEQ ID NO: 116563 - DNA, 1063 bp, Homo sapiens
ctctaatacttaactttttctattgccagtgaaggctaccctccccttcctactcctccacccttcagcattggtttgcacatctgggctgatgtgagaggcttttttttttttctcccctcaacccataatgtttgggcctaaagtcataactgcaggtctagtttaaaaaatagcacatgtggctttcaggttgaggtttctattttctgttctgattctagactattctgtccctaaactgtggagcctgaatagtacatgcaaatatatttctctagcttaaagtatattttctagattttaaggaagtcacagaatcaagagtctagaaataatttgagaacaacagagaattctaatgtttaaatgtttgcagtaagtttgtatctaagctaatatatagtctatatatagtcaaataatagattttagataaaattaagagatggactggcttcctgggatgccggaggggaggtgggttctgaggccatacaaattgggaaactattcagtatgaaaagacccacagcaaagaaagttattttgtttaacttggcatttcctaaatttatttgaggaaagaacccctctttcacataaggaaacttttcagcatgcttcagaaatgctggtggaaagaaagcaaacacttcagttctaggcctggctcaggcattaatccaccttttcatttaacaaatatgcattgagtgactactttgtgccacgcaccacttgaggtgctgacaatatattcagggaacacaacagacaaaagcctctgtccttgcagagcttatattctagtgaagggagaaagactataaacataatatgttagtattacaaggtaatgagtgtttcagacagccatggagcaggctcggatttgtagtacaggggttgtcaatctaagtatgactctaacttgaacaaatcactaagcctcattgtccctaatctataaaaaagaaattatagatgatcttggcccgctcagctatatgagtccactttaacaccaggaattgtcatgtcaaaccatggtactgctggt

SEQ ID NO: 116564 - DNA, 1087 bp, Homo sapiens
agacaagcctgaccaacatggtgaaaccatgtctctactaaaaatacaaaaattagccggatgtggtggtgcacacctgtaatcccagctactcgggaggctgaggcaggagaatcgcttgaacccaggcggcagaggttgcagtgagccaagatcgagccgctgcactccagcctgggcgacagagcgagactctgtctcaaaaaaaaaaaaaaatgaggaagaccatggtccttgcctccaaagaactcacagtctggtgggagagaaaggcaaataaatgagtacttagcatatacaatgtagtgaaggcagcaatagcgatgagcgcctagaggtgaggggaccatggagactcagaaagcgggcttctaaacgcacctcactgagaaagcaaaggctcctgagggaaggactcctaagctgaactcacattaagttagcatgagctaaggcaagaagtggggacacagagtagcgtgttccggcacccagcaagcacggtattgctgctggacatgaaatacaatgtggagatgaggcccagttaaactggtttagtagcaagagtgctgacaaggaaacatatatactgttaagaagcttacatctactactcataagtagtaggaagtcatgaagaaataaatgacccttgagactgacagagtcatattgacattttgtaagaatagttgttgataaaaactgaatgattataggatggcagctgaatgattagatgatgggattgagaatggttcaaaagtggaggtcgaaaaccaagttgtccaagcaaaaggtaatactgagccaaagcagaggaaagaatatacatttaagaaatgtttcggaaggaaaaagcagtaagtcttacgattatgtgtttgttgaggggtgtggagtagtgtgagaaagaggagtcaaatttcactcatcaggatgccagtaatctcagcactaaatgaatgatggcttattaactgggcaatgtgggagggtggaaagatttaggaacgagatgataatttagtttatatcagctttgtatatttaaattttggaagggactggttaataaaacaaa

SEQ ID NO: 116565 - DNA, 1026 bp, Homo sapiens
agccatatttatgaaggtagtaatactctactaatcaatacttagaagtttttgttatgactaatctgaatgctttttagtttttccttaatctagttatgttggtaatttataagtcagttttcagattaggaaagaaggtatttgagggtgttccatttccactgaatagtaagatgatgcttacttagatttccacagctgtttgaaagctctgtatttggctataacggaaaactttgttagggatgcttgatgttttgtgttttgtttctaaaggaagacagtgttttgttccttctttagaaaacttgaagaatagaataatgagtccaggattaatttgggataaagtcttttacttcataaattctgattctgtaaaaaaaaaaaaatctctaacctctttcaagaatatttaaggtaattggtcaaagggcaagtatcagtgataacctaaaatctagttattatttttatgcagcctttattgtttttctgattgaaaaacaaagtgaataaacatttgtaaagtgtataaaatacacataagaataaagatgagtaataaaagggtccctaatagtgaaaaacagttttattcaatttctttctagtcttttcttcttgctcacacttacatttttaaaattgcaggcttaatgtgtttattgcttttttatattcttttttcatttagcatgtatcatgagcattttcctatgttattaaataataaaagttgcttttaaatagctacctaacatttcattttatggatgcactatcatttagccattctcctattacatgtatggtttctgtataacaataatggtatgattaaaatccgtgtgcataaattattattgctatctttatttcctcaggatagattcctagatatggcatttattaggtcagaatacttttaaagttttcaataactgtcaccaaatcatttatcccatctgaatcccccacccccagaaagctgctgctgccttatattcccacagctgttcg

SEQ ID NO: 116566 - DNA, 1034 bp, Homo sapiens
aactctttcagtagagtcattaaacagagggttggatttttcttctcgtttttttatccccaaacttagcaaagccttcagagatattttgttaattatttattttactttgtggggggtgtggagaagattgggtttgaaaaacaaaattatacagtatttgaagttagtaggcaatttcagcccccttgaaaatgcttcctgcagattgtccttccctaccctacttggttcctggggaagcaaagatagctatcagcttgaaatacacagcaaagataaaaataaatcccccgcactgccataccttcttagataatatgccttccctccgacttctttcccttgatgttttggtttggctagcccactggttttgccaagggttgtgtttagtcagtcggctctgaatgttgccagctaacagctaccttgatactcttggctctgagtgtaattaataccagaagaatgttaaaattatatttctttataaaggtagttctgttttaatttttttaatattacagtggttaacatgcatagatatcatctaatatttttgctgaattacacctctttagccacctgttaatttactaaggtgttaataaaatagtaaattacctaatgttaaaaaaattttagtttttatatatacacacacacaacacgtacacacacactttttttttttttgagacggagtcttgctctgtcgcccaggctagagtgcacattttttaaaatctcattttacccaggagatgggctgcccctgggaactctggaaactgcatattttctcacacaataattgaatcatactttgaaactattgtaaattgactagagtactcggtctaggccaccccttgcccttgaagagctcagaatagcagagtgtgggagaataactttgattgtatgtttgtggtgcctgaggaaactatctcaaagtactcacggatcatacccttacacaggccccactgtgagctacagcaagacaagccccccaaagcatgagcaca

SEQ ID NO: 116567 - DNA, 1047 bp, Homo sapiens
gagcagtagggttctagggctgatgcttcccttaattctttctcctgggaaatgcaagtaaaggatattttctaaggaggcatcaagttatgccaaaaccctaaattatggggcaccaatatgtgcaggcttccaaactctccattctgacccttgcagtttttagcagtctaggagggagtatggttttctctagcatactagttgcccctgggccccaagcagcattgcaaagcaggcagtttatatttgaaatcttagaccaccttttctaaattttcctacctatgtccccctgtagctttcctgttccatgtgtccaagtgccctcagtttatctttgcctgctctactttctcttcctactttattccttgccttggtatagttcactgatggaagcaatttagatataaatgactgatgggtttaaatcttaatgggtgtttgaattttaacagataagctttttaacccaagcaaatggtgattggatttggtagagtagatgaggagtggaggtactatagactgagagctataggatggttgatcctaccttgcttattctgtctcaaccccccactcttttcattattctaactgggaacaaaatatatggactcagcattgttttagagcctgcagctgcattccatccacccctcccccccttctttttgcagagctctccccagctctttgggacttagtaaaaacaaagagtcattactggggagagagtgggttggcacagcccacagggaagacgcagggccaccgatgtgagggtcttctgtacactgctcctctgtttttctcgagagccatgataatttaatgttgccttgctgattgctttaaatcctctctgaagaagtatgcttacagatttttttcctatgtgaaatatgtttagggctttaaattaatagatttaaatttaaattttccacaaaggatacttttccttaatgagaaattttatttgtctttttacatcaaatatgactgaaattgtaccttaactgtcatgatactgtcata

SEQ ID NO: 116568 - DNA, 1034 bp, Homo sapiens
cctcaaagtaggccctagtgtctgttattcccctctttatgtccatgcgtactcaatgtttagctctcacttataaatgcaaacatacagtatttgtttttttgttcctgtgttagtttgcatagggtaatggcctccagctccatctatgttgctgcaaaggacatgatctcattctttttcgttgctgtgttgtattccatggtatatatgtaccaccttttcttaatccagtctacctttgatgggcatttaggttgattccatatcttcgctgtttctaaaaataactcgtgattttactcctcaaatctctatctacctaagtgttccctatctcagtaagtggcagaactctctatcaaattgcctagaaattgactagcaacccttgatttgtctcctgttttcttgacatatttgatctatcagcaagtactgtcaccttcaaaatatcctgaatctaaccccacccattactgctattccagtcccagttaccatcatctctcctcaggatcactgccataaacttcgaggtggccttcaagtttctacccttcccccataatccacagcagctagagtgatcttttcagaacattaaatatgatcaagtagtctcccagtttcaagtccccaatggctccctttgtaaaaaatgttttagatgccacattttattaatttctagttttaaaaaaaaaaacttcatcttccaatctaagcttattttaccacttctccttatacttctgctttagagttcatgatcccaggaaacaaatctttatttgcatttacagtcagatttgacatataagctaattatacaattataaggcccacattaaatctgggggaaaaaatggtggaatactatgcttcaagtgttgttgatttatttatttatttatttatttattttattttatttttgagacggagtctcgctctgtcccccaggctggagtgcagtggcacaatctcggcttactgcaagctccacctcctgggttcacgtcattctcctg

SEQ ID NO: 116569 - DNA, 1030 bp, Homo sapiens
tcagaccttctgtggtttctgtcctattgattaatgaaacgtaagtaactctatataacgttcctggatttacatttcaagttttattttgaaatagtgtaattcctaaagtccttgaaggagtgctttcaattacctcacattacctctatttctgttttggtgttttgattcctttatttcttttttattggcagttccttatgaaaaacaaaagaatcatgagtgcataaaacttttgctatacatacacattgtaatggactattatgagcgcttgtttcttgatccagggagataacctagtctggaagactttttcactcaactgtgagcttattcaagggtgtagccaggcttgaactttcttataagattcacagagatactttaagacttaaatatgcttagctagaaacaagtattagcatattttaagataacatttaatatcattgcttttggctccattattagaaaccatgatacctcaagagccagaaaaagtgtccatgtaataaaaagtcagctgagtatcttaagatgttttttctttaataaaaagttaagaggtagagttaaactaccaaatattcgtttgttcactcagcaaacatgtatttatcttctgacatttgccagggatagaactaggcattggagatagaaagctgaataagtcatgaatggtccctgccaagaaagtgcttgtcattttagtagaagcaggcaaatgtgaaaaaaaatgaacactataaagtctgtgttcaaagagatgtcttctttacctgccatcctctgctcagcccgttgtttccaccacacccgtgaggttatacctgccaaggtccctgttaaaatccggtggtcatctctttgtttccatcttaccagacctcagtggtattccattctcttgaccacttcttcctattagaaacactttcctgattttcctcctacctctctgcctattctttctcattctcctttgcctactttcctctgtttgactggcctctgaatgttg

SEQ ID NO: 116570 - DNA, 2090 bp, Homo sapiens
tacataaacagtcttgcatagttgtgtttgggggcaggggctactcctgctctatccctgaagatcagaaagcagatgcctttaagtgggattctgctaacactttctcttgtcaactccattggattgaaatacatttttctgcctttgttagtgtcttctaggaaagtgataatgtttttaaaatttgtacatatatattgccatttaatttttcataattttagatgctatttacaaagcataagttcttatttaagcctccaaaattattgtccttcatagtagctcccttcaatgtgttacttgaccttttgttaaatcactgagtccataggtcagagggtaagtgacttccttgccttatcctttttttctaccaggtgaactttttagcatttgattcattatagtttaagacacagaaaagactcatactctgcttttttctctttctttttttgcctgcccatattttgtatgtgttttcaataatctgccttataaatgcagaagactgttcttaagccaccacttgagcatccagacctgccagcacagcactgccaccactgttggacatgtttattaagtaaaacagtgaggtttgctttagcagattctatttgctccacttttaaaatgtagccaagtttaatttaaataaattaatcctactgacttttaacttagacccattttcagtctgtgcttgattttaaaatgctttttatcaagtaaagtcaagtttgtgccccatccttcagtgtttggaaagtttattcagatgcccagttgctcaatgcaacggagggtgttcctccctgagaaaagtagtagccagattgcctaaaaagatagacagggaagcttggcaccagaattgggaagagaaagaaagaacatatgtgaaggattggaacatgttcaagaaaagaatttaaaaggaaaggggcgtagaattcttggaatgacttacagaaaagcttaccaaggacaatcaccagattcagcctttccatttgctccatttgcacttgtgaaaaattacagaagctgtgttcataaggcttattaggtaattggtgataaagccagcagagagaggaaaatgagaatttcagctgaactaaggctaggtcacttttaacaatttgtgatgacccttttctctgcaacagagaagcttaggagcccggcactagatccagcccaccatttgctagattgggccaaatgtattttagattgtttgagaaaatgtccctaaaatgtgatattatggacattcctacactgaagatgaactaagtcttacaataaagaaaacaacatgtatataacccaacatctgactgtcctgcatacctcagctccatacagaatttcctataacttatgcacaaatttaccgcagttctggagtagaatataataaattaatgtccatgtctttagagcaaattaaagctggaaaacacagcataactcgggtcaggttaccagcgaggattgctatctctgtctttttttatctccttccttctttccttccttcctatttttttctgtggcagtactatggctcttgagagccaatgttaaatcttcaggaagaactggtttaagagttgccactaatactttgccagcaaagaccaaaactggcatttgcatggtttaattcaggatataagaaaagggaattttattaattaagctataagctccttgaagattcatgaataaaattatcaccttgaattgacctctacagaaagggcatttggctgctggtttcatagtaactagattgttaaacaaatggcatgagtttctttccttcacagggatcctatatgttattggtctaaaatccttgggtcttaaaggattttagcaagattttagcagacagaaactggatggggaccacatctccagcagaaacaatggcataggtaagcaaagaagagtggtagctagggcaagctccaagaattgccataaagaccctgttctgcttaacatgaagggcaagagaaaaatgtagttgagtttaagagagaaaaagtaggtcagagcagatt

SEQ ID NO: 116571 - DNA, 1064 bp, Homo sapiens
ggcggccagcccctattcaggagcagacccgaggagcagagaaagacttgacacacagtgggtgggaagaggcatctctgggggcagtaggtcagccagctaccttgggaaaacaacaggcaactgtacagttgattacagcaagattgacagtgtacacttgtggggaaagtgggcagatgaggaggtccacttggggaagggaaagcgaagtgacagtaattggtcatgatctgcatgaccactggaggccccagaagggagtgctttgttttcctacctttgtatggccttcatttctgcttcctataccctagtgttttcatatttgggattaagtttacagtgctctaaaagcccctgcatttatataccagtagcttccaggagacagaagatcaaaaattctttctctgccaacccaccacttagttcttaatttaaaaaaaaaaaattactttttaagaggtaccaaagtcgtcaatgtctttgtttgcttctgactgcttctagtactttttccatttctgtacatgcccatttatgggtctggttggtctctacagaggcagcaaagggaaaggaggaagactttttcccagatctctctaccttaaagcatggagccaagtagcttgtattagtcctaggattccttttctcctgcaaaactggtggtagaaacagtggcatgcgggggatggtacataagctgaccatccttaaccagctcctatcaggactcactgtcagctcagccatggaaacactttttaaggggtgtggacaagcaagcaggaattggagtgaaactgtcaacctcagttggatgaaaactgggaagaaaccaaaaaaatgagatagatacctttctggtgactgaatgtaccgttggtacttactgcaggctccacccacctgtgtgtcctcagtgcccctcctcctgactcagccagaccagtgtacctctatgggcacagtaagagttgctagcagtaggcatctggctgagcttttatcctccagtggaaggatattaatttggtctttcttgtcttccatcg

SEQ ID NO: 116572 - DNA, 1055 bp, Homo sapiens
atcctcagagacaggacacaggcgctccgcgtgtgggggtgggaccttgtattcccagggacttggggacacaggcgctccacgtatcaggggacacactgtgtgctcgaagggatggggactcgggcgcatggtgaggggcacacggtgtactcatagagatagggacttaggcagtccgtgtaagggggcggcgcacactggaacggcggggacactggcgcttcgcgtacggggggggaggggacacacctgcattcccagggactccgggacaccggcgcatcgcgttactggagacgcgccgcgtccaggacggacacaaaccaacacagtgccctggggagagacctgaggactcacgcacacttagcgctccccgggagcaagacatcgggttctggagagagaggttcacggacgctcaacgtacccgaaaaagctcccggcgtcttgggctgactctgggaagtgtaaacggggaacgagccagagccagaaggtgtggggaggatacaatgcatcccgggcagagactcgggcctctcacccctcgttttcgagagaagcccatggacacacacacacacatatacacacacacccctccagtacagagagaggctcagataggcgcacatacactgtaattggactacaaatccagacgctttcatgttggaaaaaaaatgggagagacagggaagcaccgagaagggacgcggtaaccagggtgcatggggaaacagtttatggacatgcagtactgtgggagaccggagtggatacatcgcgtgagggagggatatgccatatgggggaacctgtaacgttttacaggagaggagagagtcggaagggagatagaacccacggggcatcttacaaatagcccgttcggtactgaggaacacactccaaccggtctcgtacaacagacagaggggcagaaggacaccgagacacagattcacatagttattcagctaaaagtggggaaaagaattgacatctgttgagctcccactagtgccaggcactttaaatacatagag

SEQ ID NO: 116573 - DNA, 1026 bp, Homo sapiens
ccttaaatgtgggaaattcacactcagcttcatcactcctgtcagtgaactggtggcagtatccaaaagagcaaagtacatttctgaaaaaaatccaagtggttcatattaaagaataatgagtatcagatgcattagggctctatcatgtaatgttgctaacgtcccctataatattcactgaagacaaactgggaaaatacagagaaatagaaaaaagaaaactaaaatcacctacaattccacaccctaaaacaaccattactaagaactttatgtaccaattcatcccagccacaattatatatatataaatgcatgagattaaaattggggtcatgctacagataaaaatttgcatttatcctattaaacaaactcactgagaacaccttcctagacaaaataacttttaagcttttgccttctcttcagttacacatgacatatgctaagtaacattatcagttcaggatagaggatataagtaaaagaaagattgacactgcccaggatagagaaacaagagtatgaacaataaatatgtgtgttatttctgaatataatttttttagtcatcaataaattatttatggggaagagttgaaaaaggcaggatttaaaaattatttttggaaaaagtacaggatctcaaaaatgcttcagagagaattagtttaagtttactagtggtctttttgggagggctcaatgagtacttattgtatggattaatttaagaagagctatacatataaaagtatgaacatattccctataacctaaatcctttctctccctcatctaagacttattccaaagtcccatgttttttctatatttaaagctgcataggaattttaatttttaaaagtagaagtgtggcaaggcatggtggctcaagcctgttatcccagcactttgggatgctgagatgggtggatcaccttgggtcaggagtttgagaccagcctgaccaacatggtaaagtcctgtctctattaaaaatataaaaattagccaggc

SEQ ID NO: 116574 - DNA, 1030 bp, Homo sapiens
tttgctttgccagcctcacaatcatgtacgccaattcttagcaatgaatcttttaacacagatcccctagtagtgttttttctctggttgaaccatgagtgatacattcgtctaagtccacagctcaagtactaaccagaatgctatactcattctttgtatatggcaaattaggaatttgaacccaagtccagaactctgtgcacatgccactgaatcatacattatgtttatcataccctgccttatcctgttagtttttatattttgcaccctgcaagctgataagcattttgaaagcagacctcaggttctccttatctcctttctcctatactgcatcatgcacacaggacacagctctcttgtcaaaataatatttgtcatacctgcacacggcatatgtcatctacagtcttgtttttatactttctcaaatttatgtgctagtattattttatctttcctaacttttctttcacctttctattttaattcttaatatacaggcttttaagagttgagaactttggtcagtgttgctgtcccctctcttatcaattactagaaattgcccttgataatgtaaaaccttaatgggagaaagaggtgacattctctcagagtgctggatggtgatttggttatctgggtttttttttttttttttttttttttgagacggagtctccctctgtcacccaggctagagtgcagtggcacaatcttggtttactgcaagctctgcctcctgggttcacaccattctcctgcctcagcctcccaactagctgggactacaggcgcctgccaccacgcacagctaattttttgtatttttagtagagacagagtttcaccgtgttagccaggatggtctcgatctcctgaactcatgatccacctgccttggtctcccaaagtgctgggattacaggcgtgagccaccaaggccggccggttatctattttaatctgcaccacagttctttcacggctggacctctgacaaatattgacaagtaaaatt

SEQ ID NO: 116575 - DNA, 1068 bp, Homo sapiens
gacaactgtacatttatacctaaacgctgtttaaacaaaatacatagatgcccaaatatatgtcatattgttaaggattatgggttcatataacaaaaaaaatctaatttctatcataaacatgtgtcaaaaattgaggcagaaatttgagatcttgcctagagtgcaaataccgtacaacaaagtatttaaaacaagtaaaaaaatattatagtaaaagcacctagtgcagtgatctaccaggtgtgcacagccaaacactggacaaaacaatgttctggttttctccaggaatcctcccaagtactgaatgtagttcttagaaccatagttccccaatatgaacaggctggtctattcatgactctttcttttaattcacgacatacaatccaatgaggaagaagcaagaatggaataaagctctgtgtcagtcagggttcttccgagaaacagaaccaatatgtatattacacatatacaaagagacttagtttaaagaattgacttcatacgattgtgggggctgataagtccagaatttgtagggcaggtaatctggcagcctagaaactgaggcagtagttgatgtttcagtcttgtggaattccttcttctccaggaaacctctgttttctgctcttaagaccttcaactgattggatgaggggcccccacttatcaagggtagttgctttgtttaaagtcaactgattgtttgttaataatatctacaaaataccttcacagcaacacctagattagtgtttgactaaataaccgggattaactaacaatcatggttacctatgtggtaaccatgttggaggaaacaagtcaggaaatttttcagatgtaacccaatctgcccaagaatggctggggaaaggagatggaacagatgtcatctcttgtccttccctccagacatcctcaacaccacttccctactgcttgtgcagccacagggatgagcaaaagggaagttgtgctccagatatgctaggaattagatcactgctaggaaacctggatgtaagaggtcaatatctagatgattttatgatg

SEQ ID NO: 116576 - DNA, 1017 bp, Homo sapiens
tacactgaggccaggtggtcagatccctccagaacacaatgtccctcctctctctaggattgttaaaccatcataaaccgtgcttcagagtatttttattctctttttggtatttcaaatggcaactaaagtttactgtagtcataacagtcttgctgcattatatgaacatttttacttcccttgaatctttacaagttttctggaagagcatataaagcaataatttgcatattgagtatctcaatttacctgtttagacctaactccaaaaatttcttctcccactaagtgctacaatctaaaccgatggctcttggtttcatgaaagccaaataccctatgctatggagaacactgagtgaaataatggcacatagacaaagtattgataccaattgtttctaaatatttctaacttaatgtttctaaaatcagggtgaattttagtgtttctaaaattagggcaaatgataactgaaagctaatagtgggtatctgtagggagtgaaattctaatttctttcttgcctttttctgattttaatttttttctacagagagcatgtatttctttttaaaaaagctcttcctccctcctatggagaatatatttcttttataaataatccaggcagcattataaagaagatttgtccatacctttattatacttgtgggatcatgatcatactgtactaggtactttaaaaaaaatgtataactaataataaaagtaaaatgagcagagaacactctgcttttcattttggaagcagtaaagcaagatacacatataaagttactaaaataagtagaaatgaattttccttcttattccatagtttagacagtaagagaaaaatcttcattttcacctggcaaggcagtctggtgtcagaggacctagagtgtgaatgaatgagagatctgccttctgctgctcatgaatgggttatgtgagttcctcgtgccctgctttttctcagctgcaaaatggagataattatgcctagt

SEQ ID NO: 116577 - DNA, 1219 bp, Homo sapiens
tgttagcaccacacacctaatgataaaggcaaggtgattgtttatgggctaggccctgttctaagcacttttaatgaattaactcattgattcctcagaacaaccctattaggtaggcatggctgttacctccattttatagatggggaagctgaagcacagataagtaacttgtccaaggtgatactattcagtggtagacctgtaattagaatcaatttaatagcagtctggttccagagttcaaggcagcagacactcactcaataaaggcttgttgaattgcattacactgtgagtataccagctttagatgtggtcttcctgctttaagaaatggtgttctgaaggtgactaaggagaaagtcaaatcattgttacagttttctggtgtgtcttattgacctaaaacaatatcaaaacatatcacagatgtacaatgtttaatgggttcattctgaaaggacacctcgaatctgttacgaaattgtgaagtacccagactatttcaaagagcaagattttgtagaacaacaggaggaaatgaagacttcctgacatggtcatttctttctttttttttttttttagctttattgaggtatgatttacataaaataaatttctctttgaagtatacagtttaatgaattttggtaattgtagatagctattataacttttaccataatcaagatatagataaattatattattctagaaagtagcctttgtgcccctttgcattttatccgttctcctgacctctggctccaggtaaccattgatttgctttctgtcactctagttttaccttttccagattgtcatatacatggaatcatacaatatgatagtcttcttagtctggattgttttgcttaatataaagcttttgagatccatctgtattattgttttgatcagtagttttttctttcttattgataagtagtatttcatgtcatagatatactctgatttgtttacccactcaccagttgatggacatctgggttatttccagtatttggcaattatcaataatgctgctatgagtattcatgtaaaattctttgtgtggaaatatgttttcatttctcttgggtaaatacctagaagtgggtttgctgggtctgccatactgtttcccagagtggctatactgtgttgtactccccagcaatatattagagtctggttgttcttatccttggca

SEQ ID NO: 116578 - DNA, 1033 bp, Homo sapiens
cctgtgtttcctgaatctgggggacttggggactgacatatgaggcatctcaaggcagaggcaggggcagtggagagaagagatgctgtattgagaatggccagcccttccatagttgactgggtaaaaactgactctgaggaaggagcagactgggtcatcttggcagcaacttaagagggagaaactacggagtgaggtgactctggaaagagacaggtctctagaatggagtggcagagtgggatggtggggaagattcttaagggaccaacccgaaagactattgcctggcaaagcagctgtggggggcagggcctctgaaaaccccataaagagcaggcctgggaagcttggttatctgccagatgcagaggtaaaaaccccagattacagtgacatctgacaagacagacctatattcccctcttctccatctgctgccccaaacctgaagagccacaatccacaactacaaagatgggaggaggtggagtgaggagaaagctgacaaggctgtcttcctgatgagcttccttgcctggatcagaagcagatctgagctgtgagaggggaggaatcattggttaacttaggtttagagttctgatattaaaatcaccctagaaaacagactatttgtttaagacttggaagtgactgtgatagctatgggactggtggagatttttcatctagagacaggaaagaacatatgaagacagcagattcaaagaggcagaggaaggagaggatcaattgctttctgtctgcacatactgattccagtttctttactatcctaacttgattatgctagtaaataaataaaatgttgaattataaaaccgtgacaccaggtgaggtagtgtgtgcctgtagtcctagcttttcaagaggttgaggcatgaggatcacttgagtccaggagttcaagtccagcctgggcaacatagtgaggccccatctctaaaaaattaataagcaaattaaaaagaatcataaaactgctcttaaaggatagtgcagaggg

SEQ ID NO: 116579 - DNA, 1064 bp, Homo sapiens
cttttactgtctctgtctcacatgcttagaaatgtgcttatatctgtgttcccttgctaccctgtacttatctcctgtacagtcccacactctgactatcagaaaatgtattttaaaaggaaaaccctgaatctcctctcacagacacttaccccctaaatcactcatacttaaaaataggcaatcacattgcaattcctgaggcaatcacagtctcctgagcattccaggttctgctttttcctttagaataaaaattctaaaacattcatgaatgactatgcaccaggcaatataatgagagctcaatgtggcaatggagaatcaggatttggggggagatgaaaacatcgactatcaaatagagcttccatagatgaaagggttgagcatgttattataaatgaaagaaatttagggataaaattcttcaaagccatgtagttcaaagagaaggagcacaggtgattcatcttttcaagtgatgtccatttgggacaatcgggagaagagcagcactctgggggttcatttggccttactctcaactttgttttctcatttcactgaattggcttcttctaaagagtagagtgacccaaggaaaaagaaagatgggtctccaggttggaactgaagtgcccattttgtagcaagcaaatgataattttatcaatgcttcgttgtttttctttaccagcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgtaagtgtgtgccttctcatgactgtgacttagggagctgtctgtgcagacacacagttagggctttccttcttttcaaggggatgctgctctggtgtcagtccctgggattatgggccaaggttatgtcccttctcccacttcccactagcttatatgaatttattttgtaccagtgggcattgaaataattcagtgggatcaaaaattgtacaaa

SEQ ID NO: 116580 - DNA, 1023 bp, Homo sapiens
aggtctccaaataaaagagagtcttcaactaaaaaagattaacttttattgttatcaggacttgtatttagcatacacttaaattatgccactaaaaatgatacacctcattagcaaaacacccacccagtgagatttagtgagttatttgtaaatgttcccacacttgctattatctaaacttttgaaggtttagtacattgtggaaaaccacacccagttttttcttgaacgtaatcataagaatcagaccctttccatgtttcttttttttaacgtagaagttaccctatttttctgagatgggatagttataaagaatttgaacatctccccacaaaccctgttctgtcttaagagctgggaggggcagggcataactgggaagtggagatgatttagctatatgtttattgctttagtatttaacagcaaacatgaaattctttttttggctttaaaaacaccatcctctcccatttccattcttatgtctgctgtttctctttctcaccatgcttttctgactcactttcctttgccagtttcctaaatgtgagttctccagggtttgattcttcaccccttccgttctcatattttttacttttataaggtgttgaacaaacgtaattgcttatttcttcttttgatgccagattggaatggttgtaactcatagcattatcccttaaggaattacatacccatgcatcatttagaaaagctgggggtaatagcataacttgaagccttttattacacagttatcatggcacacacaggcaaaataatattctcccaacacattctgaaaaggcgtgacagagtggtagatagaattggaagtgagaactagtgctagttttcttgattctggaaatagttaatttgaaattcaaaataagtgataattttacaattattaagaaaactttaaagttttaaaaattaagtacttaatttgaagcatatgtgtaagctatgtattagagaatggtttctatatattgtagaattgtt

SEQ ID NO: 116581 - DNA, 1035 bp, Homo sapiens
aggaagaggaaggtgggggagagaacatgagtgaatatctgcatgaggtagtggctgaatcatggaagtggtttcaattatccagactcaggctcacaccctagtggcccccacagtgtttctagcattgcaattgtaacagtcacttatttagcacttacaattacatagcaagtacttacatagtgctgagcatgtgccaaacaatggttttcatacttcgtatagattcacttatctaatatctccaaggagaagtgacttgctaaagcctcaagcagccatgcatgtctcaactgttatgcaaaccttggcagtcagagcctgtgctcttcctgtgctttgttccctgagtttggataccttcaaatgggaaatggtccccttttatcttaaacccaacaacttcacccatttagtttctgccagtctctgaaagcatttgcctctggccatagagaatgattttggataagaccaccagcacagggcagaaatgtgcagagtgtatacagtggggaccaaagtaaaagagatgccagaggtaatggagaacaaagggcatagatgccacaataggatcagaatggtgccgaaaggtggcaatggggagggagagatgctccaagggtcaaatttcagagattacatctggataaaagcatggaaactgcagattgaaaagttgtttgcagtctttgatagagcaatggaagcaatgatgagcgatcaactcattttaaggaaagaggaggtgttgagatgccgaagtgagggatatggaagtcttgatgtgtgggggcaaagagccagagagcaaagccagaagtggcagcctatagaaagaattcatggatgttgtaaaaactggctgtgggccctggagaagaacagcgaggaaagaaacagtcttggattcaaatcttcattctgtcccttactgtgtaacctgaggaaagtggcctaatctgagccttgctttgcccatcactaaatgagactaatataattaaagcccttctgaaaaaggatata

SEQ ID NO: 116582 - DNA, 1062 bp, Homo sapiens
atgaatgaggacggtactgttattattcccattttacagtgaggaaattgagacacagagggcctatgtaaatagcccaaggtcaaggggctataaaatagcaagccaagcccaggacttagaactcaggctgtctggtctgagtcccagcgtctgaatcacatgcccttctatcatgttactgttgttagtgacaatctccacatgccctaaactaataccactctcctgaaagaacaaggggtagcagaactttgctgccaaaatcctgcataatcatagaaacggagtatatcatccgtgttttgacttattcagaagagaagtcatgaggaaataggaaaataataatcacatttaaaaaaattatacagatcttcattgtagagaacaggcaattttatttgaacaaaattcttctgaaactgaaacatcaagggaatgtttgaccaaataaaccattaatactttggtcctgaggtgtttagtatttcttaattgtttcatgaaaattttatcttaacgttgataaatgaaaaaatatgccctttataaattagctttgggtgttaagtatggcctcatatgtgttaatcaggaaaaaaattgctccatgaaaactttttttttacaaaataaaaaagagtccccttgtaatatacagcacttcttatattacagcctcggagtgaatcagaactcattgatgaactttcagaagattttgaccggtctgaatgtaaagagaaaccatctaagccaactgaaaagacagaagtatgtttctaaacatataaatctctagttttgaggtttgtgatcttaaaaaaaaattgtgagacagactgttttagcatcaagcagtctgttagaaagcccaatatgccatcgttttttccatgtcatttttgtcttcctttttggatgtgctttctgccccaacctaaccctgatattcttgcaattgaagtcctgcaatgactccttcggaaagctctggaacccatgccttccttcttatcccagcttctgtaactgacctgattggaactgtcaccaccc

SEQ ID NO: 116583 - DNA, 1060 bp, Homo sapiens
aatgtgaaaaagcacagtacctttgctgtgttctgtgaggtttctgtagtggagggacagctgtccagatctcctgagagagcatcaatggggtcttggtcatctgcaggtttctgagatatgagtagaaataaccatcagtgaagaagcagaaggcaaaatgcaatatggggtcttttcccacatcacttacaaataaaagatgtttctataagaaaaaaactgactgacattctttattaataataatgtattgtaaaggagatagaaaaacaagaaaatcttgatggctttttttccatctactctttaatacacgttgcttagcattctctgagcctcagttttccaccctaaagggcttttgtgaagactaaaagagaggtaaacaatagtcacacacatttatatgcatgctttgacaaagtaccaggcacagagtaggcattcaatatgttttagttttctaaaatgccaaatacccctatggctagaataaaacaaaatttaatggaaatatgttcctatggtctttacctttgaatcctctgatttctttgtaggtggcttcactggtttgtccttaaaaagaaggcagactattggttaagcatagatatctgtaaaggtttacttaggtttaggcagtagagaatctattgtcccatgacttgacttggataaaatggagtgtagacttgcaataactaataaacctgagtccccactatttctttaccagctttgcttaattactattctttataatcatttgtgtagacttgggggaaacatatgaaagggtctggtcctggaagtgaaagaaacactatttgtgaaccttctgccatcatgtattatcacttataattctacttaaagtgttataaaaagttacttgtgtttttacatcttatttactatagcttattacacttagaaagtcatcagggatttttcccagcttcaaaggcaagggccttaaataataaatttcccaaagaacgcaagcagggtgagttggtactatcaaagtgggaagggctctagcaggatgtgg

SEQ ID NO: 116584 - DNA, 1039 bp, Homo sapiens
tgaataaatatcagagtaaatattggtgaacaaatggatgaggttaagtccctgatacatgctgggtttggggctttgcactttacctgcattatataactacatccttcaccactgctcttcattttacaaatgaggagactggcttccatagaagttaaatcatttgctcaaatcaagttagtaggataaacctgttttcctatccctgtattgtgctacttattgcacagaaattgttcttaaagagccaagtctgaatcaaatattcagtggagatgttgcatttccaaggcaggtgaagacagaagagatgattttgggtcaggacaagggtaagagtaatggttaacagctggcttcgctgttgtagaaggtctgtttttagtggagctatcatgatgagctcctttaggattaatgatttgaacaattagtaaaattattgatgtgctttgttgagtagtgctcagtgatttttaatcgactgtgaattaatcttgcattctgagagcgtatgaaacagtaggttgagctacaacttaaagtagagagtgaagtgttttccaggttgctacagcaggaggccatgccttctgctcattgtaaagttgcactgtattgacatataattttaaaacaactctgcatcatttaaaattgaattctgatctttctaaaacccattcctactcccctctttattcccaaactaataatatggtattatgacatggatttctaaggaactggctgtctggaatctatgctgaataaataatacatcatggtctacattcgcttcctgaataccaaatcaaaaattgatggattaatgctgtgaaaatttatgggaaaaggataataaccctttaaggtgaaacagaatcgcacaatggtcaatcttgtggcaaagccagcctatctgtcatgtgagctcaaggggtgaattaagatacccacaaatgaaacaagaacaaacatatttttcaggaggtagccaagagtttcttatctctttaaaatcatggggaacttt

SEQ ID NO: 116585 - DNA, 1066 bp, Homo sapiens
cgcgtctaggcttggtggacttgtcagcgcctgcctggcttcggtccccaacttgagcaccggccctttcctgcatgcccctaaccctcgcaacgctaaacagtgaaaaaaaaaaaaagacaaaaacaaaaagcatctcaacacacacacacacacacacacacacacacacacacacacacacacacacacacacacacacacacacacacacggatccgcgttcagaaaggcgtgcacttcctacgcctgatcccccgcatcgcaacctcgcagcttccccggcgtgcagcgctcatttaccaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtacagcgcgctcgagccgcgggtaggggactgcgggccgggaggagagcgcggcacccgccccttccctgcgcccgtcaagtggggggctgagggcctggggcacgggaggagggagacggggcacgggaggagggagacggggcgcgggaggaaggcgacggggcgcgggaggaaggcgacggggcgcgagacagggcgcgggaagggcggggggagtcgctggctaggcccgagtccgcggggtgcccggcgggttggcggcgggcccacccctgccggtccctgtccctgtccctccgggcgcgtggccggtgcgcctgcttcacgggtctccccgctgttcggccggcgggagcctccctcagcgctccgcctggcgcctggatgcctgccagtcctgcaggccaccgacgcccgcgcgaggccaaaaggcggggtggggcgggcagctggctcgggctgaggagggcacctgcccatagctgctagagaaacccagaggctttgggttaaagactctg

SEQ ID NO: 116586 - DNA, 3825 bp, Homo sapiens
acccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccacggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatggtgagtgggctgccgaggcgccgggacccgggctctccggagccctgagggtcgtgggcagtcgtgacacgcggggtcgggctgcagccgtctcccccaacaccgcgggcttcccacgagggctgagggaggcagggagaggggatctgggggaggcagggaggttcggggggcgggcggcggccagtgcgggacccggggctggcttgaaggtcagcgccgccgccgctcgcccggggtgcggccggtgggcaaacagcaaagtttgggctgctgtgcgcagaggagtgggcagtgggaaagttggcagctcaggtttgcccccggaggaggcggtgtcggcccgactctcctgtaggagcgttaagttgtggcagctgccgagcccaacttttgtggggcgccaggagctgtccccctgcccttcagtgagctgccggcgtgacttttcctaatagggcggggtgggggtgggaggcttggcaggttaatgttgtggaaggaagggaaacttcaggaaaggcttgctcacctcgctcggtgccgcggaggtgcctggccacagtgccaccctcctgaccctgccgaggtactcggcagggccaccacgcatcccctcactggctgcagatcacatcagtttttcagtcaaagacttgttaatgtcaagggtccgtcacggtggtgataccactgtgtgacaggaagcgagagtcaacgcagggagcctgcaccctgcaaacagccacagcccttcactgaacggggagcataaatcccaccctagttagaaccatggcttttgtgcggaccagaagtgccagagccacaatataggggtgagatgtcttaccgttttgcggtgttgagtgtgtggattcccttttaagatagaaagtaggaaaactgccagtaagggagacgactcactaaaagaggattcagtctctggttgacatgttttgctgagtgtggttggttacttcaggtacagtatcacattaataggggccacagtctatatccctgtttagtttgttagttaccactcaagagcagacagatattgtccactttatcccaaatcccagccagactttgttgtatgctgtgcttcattcatggggctgtgaactactgattatattctccctattcctaatgtagaatgctttattctactgccatctttctgtctgcactgtttaattaggcttactgataacaactttaattctgaattttctttctcattcaggttctatttgtaattactaagacttaaagaatagtctggtgaagttactcgaagaattaaggaaggtttgagctaaaatgaactagagaccatctagtactttagtgtaaaatatgtttaatacaagtcgttaagtccttgtaagtgactattccaatgttcattctttgtttttggaagaatgcttggagttaccatgtttttaaatgtgaaatttcatctaaattaaaaaaaaaatctctgtgatgaggctgactcacccatttggtcaagattagtgctagctgatttgctgaacctttgcctacagaattaaagtactttctcaagttttaaaattggtgtcttttctcttatagaatatgcttctagattgcttctagatgtgggtatttgcaaactgtcacatttgggaggacaatggaaaaatcccacagaagagaacaaaaaaagaagcaatgcttcaactttcatgtaggaaattggatttctgattctttcctatctttcagagttgatgctggagacagcttggcagtgcataattttggttaatgtagcaatcactccttggagccttatttagcatccttttacaaggaaaacagaaacgacaatatctacagtcaataagaaattaaatgttagcaatttgaagtgcttttcaggtttaagatggacagggtatttatttgaaaacttttgaaggattgctgtagaattttctagtgttttcaaatgacatggtacagtagacagttatatacttcatccttttgagtacaaaaaataatgcatgtataatgctcccattggtctgggtgtgatgatgcagagtatttcattatccatagaatttatgattgcaagatttatcaagcctggtattggattttgttacacgttcatcctcttttaatggaatctttcccacttacactttttcatgtatccctatatatgtagagaggtgtatgagcttaacaaaaaacagtttcagtaatttaggaccacatatcttttagttaaaatcttgtcagtggttccatctactgacctatgcatttgtaaaggaagtgaatttagcttatatcttgtcactctagccttcaatactcatctattccagtacgttttttttgtagtttccctgttttctgtccaaagttgccactggtatgacctatttttgttgggccctgctctctacctgttgataattggttcatttgatgaatatcctatgttaacctgttcaggtaacatacttctgcaacccatttaaaatgcatatccctggaaagggcttataaggatggatcttagtgctaggaattcccatttagctcaggatctatttttggctttgtccttgggagggattgctattatgttgaagtctggacatctggtctgggtttggatctttggtggctttttttatgaagagagatgtgctggaccagtacttaagattgttttggcaataatgattatgtcttattaggcaggtagaggtaaaactgttaagtaatagtgatttgtatattacaaaaaaaaaaaaaaattgaaggcaactatctgcttttttggttagagatattagattaaataattctttgatgtttatccagatttttgtcttcatttgcatgcagggttggtatattttgtaaaaacttaaattcatcttaagaaatgcaaatgctaaggttcaccctcagaatctgattaaggaggtctgattatatatgaaatacatactagaaagtatgtatactttctttttttttttttttgagacacagtctcactctgttgcccaggctggagtgcagtggcacaatctcagctcactgcaacctctgcctcccgggttcaagtgatcctcctgcctcagcctcccgagtagctgggattacaggcgcccgccaccatgcccaaataatttttgtatttctagtagaaatgaggtttcaccatgttggccaggtgaactcc

SEQ ID NO: 116587 - DNA, 1035 bp, Homo sapiens
tagataaccagagagattggttataaggaaattatatagaaaataagtggtaattttctgctcagtaattcaatcatacagctatcttttgaatgcccatttacaagtagattttctgctagacacagttacattaaaaaaaaaaaacccacaacctcgtcatcagataatgcttacctaaataagagaaatgaatagaagaacctagttttgttgtcatgctaatatgaaatatggaaacacagaagaaataaaaaagcaataaagttttgtctaagacagtattctaattatgaaataaatgtacagaaactgttcataactgtttgcatgtctactaatttagtgtaatactcctattaggaaacagcagtattaaccctgtctatgaaaacattaggaaattgagatttgaaagagtttagccaagattaccccagatgttgggatggacctagatgaggcctgtggttcttggcagtcgaggtgaggtcagtgcagctatgttttgtcaattagtcacctcatgacttgaaaactgtagggcagcagtccccaaacttttcgggaccagggaccacagtcggggggatgtatgtatactttctagtttgtgatatattctaaaggggagaaggtttggggatgactcaagtgcattatatttattgtgcactttatttctattattattgcattgtaatatacaatgaaataattatacaactcaccataatgtagaatcagtgggagccctgagcttgttttcctgcaagtagacagtcccatctaggagtggtgggagacagtgacagatcaggcattaaattctcaaaaggagcacacaacctagatccctcacatgcgcagttcacaatagggttcgtgctcctatgagaatctaatgccaccactgatctgacaggaggtggagctcaggtggtaatgctaacgatggggactgactgtagagatgaagcttcacttgtttgcctgctgctcactcctgctgtgtggcctgattcctaacaggcc

SEQ ID NO: 116588 - DNA, 1419 bp, Homo sapiens
ccaagatcctctttagaggaaaaatttatagagattagtgggaatgatgaggagaactcaatcttgagagctcaatcaaaaggagatgtttaaatatctttttaagttggtattggtaaagtgctttgaagacagaaagaatgtaatacatgtctggtgtctgcttgtcctataattgtcggaagggcctcaatgatgaaataagggaggctgccatgacacttgagtcttggtgagaggagctagtgtgtccacatttatcaagatcacctgcaggagtttgggctggccccctcttattagtagtttctctgttttttaaactggaggctcagcgccttagtatctagattgggtagctacattatgaagataactcaaactgaacaatagagtattgggtattagtgggaataagaaatgcattgctctttaaagcagcagcctcacttccatctgcatcagtacaggatactgagaggcttggtagcattccacttgtaggaagcacacagaaaaataattgaatatagaaaagagggtctagtgtgacttggggattagataatagagcatgttgaattagatggaaataagcacatgttcactaaagtgtggctagctttgttccagtccagttgttcactgcagttgggcataattctgttttaattaattaccaattcaggaaatattattgcgataaagacttgaagaatttatgcatagaatcttgtcttggcacatcatcgaatgacaatgactattagtagaaaaaatgtagttactatcccagccttttgactaatccataactaattttttaagttggttaatgataagcaaactggccctcagtcagttgtaaattgatgacaaagttgttactataaagactgaagactgtcgtatacctggtgttttatcaatccaatgagtcacatggaaaagtattacaaaaaattatctgcaaggtaattttttgttcagatccttctgagatctggcaaataaatgtattcaccaactgagatttcttgtttaactcacaagttttctgtatacattgaagagttcttataaatttcctttgcagatcccattcagtgatatgcattctttgttaaataactcacagatactcattatgtctaatgtaatttttcattttaaataaggaattataggttaagatgttcttttaagactatagtatagcgaattgatggaatttaaaagtaaactttttatctttagatcttgtgaaagtatttgcagctatgcagatttgcttgagagattaataagcataaatatttaggcatcattgacaatgtaaattactttatattgctaaatctaacaggggccctaagcattgttaaagactggcaccctatattgtgaggaaagatttaa

SEQ ID NO: 116589 - DNA, 1769 bp, Homo sapiens
cacatatgtagctcagtgattattctgtaacttttgcaggttcatgcacagatttaagggatcctcttttctgattctctcccctctgggatttcccccatgctgtatagcctacagggtctacttctggtttctctggatagaaatatgggactcattggaattttacctgttggcatttccacaccactctgtgaccaaagcctgccttcagggcaaagtagagaaaggaaatggaacaatattaaaacagaaactcacccctgtgtgttttgcttcagcaagtttttgaccctataacctattataaagtgaaatgaaaatgtggacacctgtgaagcggtccgagtgcaaaatttgtctagactttcaatttttttccccagtcttttagagttgtctcctacctaattcaacaacaattttagtggcttgcctttttgagtttttccagtgatttcagctgatcttctcagaattgctttcttcatctattttgcaagttaattgaattacctaatagctataccaagcataactcgaaatgccacagctgaacttgggcaagctcctaactccactaagtacagaagtggagccgtacagccatgaatgtcaggcatgttgtggggactagttgtattagttttctattgccaccataacaaattaccacaaacttaagcaatatagtacaaatttatcttaaagttattggcaggtcagaagcctgatacggatctcattgggctaaaacgaaggagttggcagggctgtgtgttcctttctgtaggctctgggcaggatccatttcctgcacttttttggcttttggaggtcgtccacattccttggctcctggccctgctccttcatcttcaaagctaccaaaggtaagtcatgtcctttttcattatttcactctgatagcctcttttgcttttttttttttttttttttttttgagacggagtctcactctgtcaccaggctggagttcactggcacgatctcggctcactgcaatatctgcctcctaggttcaagcgattctcctgcctcagccttccgagtagggattacaggcaccggccaccatgcccagctaatttttgtatttttaatagagacgaggtttcaccatgttggccaggatggtcttgatctcttgacttcatgatccgcttgccttggcctcccaacctcttctgccttttaaggacccctgtgattgtattgggccgtcctggataatctttccatctcaaggtctgtaaccgtgtccctagggattaggacatggacattttgggggctgggggaggattagtctgttgaccataccagttaatcttatttacagaggatgtggagagtaatgattaatatgttgagctgatgaagtagacaagtggctgctgtatgtagaagtaatgttggaacaaataatacgtcccagaatagtttctgtaaggctgattttactctgaaattttaattaatttatagttaatataactacctctgtattttgttgtagtcttttgtgggtagagttgaggaagagataggaatgggattattttgacatggctcatgatcaccaaaatgtgatccttggtcagtttacctaaatatcaatgtaattatgtttatctaatttaataatttgctgaaatcttccttattttttactttttatgaagcttttagccatttatattagatggtgatttttaaaacaacttttgaagacttaagtgacattt

SEQ ID NO: 116590 - DNA, 1061 bp, Homo sapiens
gttctcaagaatcagtgtctagtagaactgaaaggcagtgactcagatcccatagtcactgaaatactactaagtcctcctgatttaagatccagccccacagcaggtattagaaggaccttgttaaccttatagacagtgtatgaattttatcttattccaagcctccagtaaacctggattcagcccttgaagagtttatgcatggacatggaggtaatttttgtttatacttcattttaatatattagattattgctactttcatttcaacatttatggcaggtttcttccctgctaggcaccaggaatacaaagatgaatgaggttatgaacctctccttggaggaattattcatatttggagcaaaatttataattgcagtttacttatgcagaaattctttttttctacagcataaaccgggccttgagagtttcctaaaccttctatcctcaacttctaattcttgaacagcaaaaagttaccaggattgaaatgtatccgttattctagaaaagtaaatgtagagcaggttttggaactcaatatttcatcctaaatgtgaaagactgtataggcaaatagtgtgcataatttcctttttccagggttgaggggctgccagtggtgtgtagtggggagagagtgaagtgactcataattctggaatgattgttttgatctcctcctgtagcctctgtaggatactggcagggcaaccagcataattaacactacacagtctaattataaacaaaactctatgtacagtggctaccaagaagcaagcctgtactggataatcccccaagttggcaggattacttttagaatgattattagatagtgtcgtttactataaatcaagttgtttttctttgattgtccagggacttaccctggggggaaagtgaatataataatatttgtggaagtcttctgggttatttttttcagggcccatttaaggatttctttattgcagttcttataacctttttgtcttaagagaacatttgtacatcttactatgtatggcgtactcttttagggagag

SEQ ID NO: 116591 - DNA, 1022 bp, Homo sapiens
tttcagtgtttcttctaggattaataatatgcatcattaagtctgtgtatagtcagtattgtaccatttcacattctatacctgacccttcttcctttctgcttaatttctcttactcaacttctgtattctctgtgcttttgttgtcttttattttttggttttaagcatacagtttttaaagatagtcttttaaggaaattataagaagaataaagaatgtacaccttttattttaacatgtattatttctggtattctctccttcctgaagatctgagtttccgtctggtagtagttcccttcatcctgaagaacctcctttaaaatttcttgtagtatacatctacttgaggaaaatgtgttctaaatgaattctgtaagctgtcatttatttgaaaatgtcttttactcttgattttgaagcatattttcactgtatgtgcaaagttgagtttagaattttctttgtcttccaactctttaaaaatgctctatcatcttcaggcctccaccgttgacatgagaagttagtgtatgtactgttgttcatctgtatgtagcattgtttccaggttctcttaaaggttttctttttatctttagttttaagcagttttgaccatgatgtgcttaagacattattatttgtgtgtgtgtgtgtgtgtgtgtgtgtgtgtgtgtgtgtatttatctttttgggggtttgctgaacattttggatctggtaagtggtgtttttcatcaaacttaataatattttaactattatttcttcagatattttcttctgctgcattctcacactccttctgtggctcctgttagatacatgttagactgtctgatactgtcccccagatccctgatgctgtgtttatttttcttcaatcctttgtctcattgttcttcaaattggtaatttctaatgatctgtcaagtttatggactctttcttttgctgtctccaatctgccattaagtccatttagtaactttttcattttatttattgaaccttt

SEQ ID NO: 116592 - DNA, 1676 bp, Homo sapiens
attaactatcaaaacagaacatactttttttttttaacaagaaattggggcactataggaagtttaggagattatattcccaaaagcagtatgttagaacccttcttctttcatagtagatgggtagatggcagaatgctaaactcatacctagaaaatgattagaagttttattcaaataaaaattttaaagtagcataacttgtatacagttcaggttggagaggagtcaggaaaaggtaacctcattgtgatccatatgctccccaaagcagaaatgggtgaagtgaaatgaaaagaaagtttattttttaaaggtaataaagacaaaggaaaaacaaaaaaacataacttttcttaatttgtgttgtagcaagttaagctgaggtacggaataccaggtggatgggcatgggaaagggagatgatgacactgcaagcagagggaagagaaaagaaaaagagacatgtggaggatagcgtggaatagctgcctggcctgtgctcaaaatagtaagcagtttgggatggccagagcatactcaggaatggtatttagtgctggctgggatctgaccatggaagatgcttataccagtgcctctcaaacttaagtgcacgtgagcacccgaggatttgttaaaattcgtattctaggtggagacttcagaggctgcgtttctaacaagctgcaatgtgatgcaaatgctgcagggtcacaggccacactgaacagcaaaactgcaaattttatcctaatatttatcaataatatgttttatggatgaagagtttccaccattacagtgtttgttgaatagcacaaaatacatagcatttatcttaagctagatattcagtagttttttgtaagctttgctctcctgatggtgaaataatactcttagcaacttcattgccaggtatgaaataaataattcagggctctcatcttttattgaattagtttgagtagagggatgcaatataatgaaaagagcataaacttttgaatcaaatttttagacctgtgctttaatatcagttttatgactaaatagctgtgtgactttatgaagacgaattaatctatttctctttttctattttctcatgtctaaaatagaatacttgccattttataggattgttgtaagggttagaaatgataggtataaagtatcttcccttgtagggaagattagtggaggtttcaatttgataacttttgagatcccttaaaaactaaaattgtatgaattttaaataaaaaacattgaacgatctaatcctaggaagtactgatatatgggggattatcgacccttctacttctagagtcttttttctcagtgattttggcaaatcggaaggtgtggtttgttgtagtttgtaaaagctcccactgagatccactaacactcatggtgtgcagtatggttgtttcccatggaaatatgttgtacttctgaaagccatggaagcatgaaaaacagattgaattataattttatctgacttttattgtcttttgatctttttaaaaatcatttcttgcttatggaaatttcccatataatttgctgcttcccatttgctgtgggacagaaacattcctctttcaggggaaaacaataacccatcctgttgcttagccatactcaatcttagaaatg

SEQ ID NO: 116593 - DNA, 1134 bp, Homo sapiens
ggcctgttggacagaaattctgggattgcagtgcccaaaccctagaaggggaaccgtggactgtaggtgggcacatccctttgatcctactgactcctcgcctggtggggacagacatagtcagaggaatgccaaaacagtgccctctcaagcccagggcagggtcccaggttgtggggcaggagtatattaaggaaattagtatattatctcagctaactttttaaaaatataatagcctgtttatttagctttcttgtttcataactgtggtatacttttatttatgttttagtttttaatggatgactcaatggtataaacatcttatttaattcagtagctctgagatggaaataagtcttagtgacttaaaaaaattcttagtttaaatgtggtctaggtagaagacatgttattaatattatgagcttttttttttctaactctgtgccttgttcttatgttttggttttttagatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcag

SEQ ID NO: 116594 - DNA, 2240 bp, Homo sapiens
gtaggtgctcagtaactactggattgaatttgtgtttgttttaggtactttgcagcaactcagtttgaacccctggcagcaagatctgcttttccttgttttgatgaaccagcatttaaagccacttttatcatcaagatcataagggatgagcaatacaccgctttatcaaatatgcctaaggtactgttctgttccttgaatgtaaaaatctttgaatgggtctctttctttaagaacacttaaattcctctttgccagactacagttgagaatgattaaaatcatatacattaatattcttccttaaaatacttaaataaaaattaaaatatattggcatcagttgggaagtcaccttgaggaggacttgaggaaagagaaagacctgctggacttggaatgtgtggataggaaatgtgagtgtgcattgtatattaagttgtgcaaatattaatacaatgaactagcaaaagattagagtaatattttctgagacaggatgaatttgctattctaaactgttatttgagagtgttgaataataactctttttggtgttttattggtaaatgaaaaaccaatattgttataatatggagattgacaactagaacaggagcctctttcttagatgttagctctgtgtgggatgcagtgagggtgaaaccaataattgtttttatgccaaacaaaacctggagcctagggggtctttttttgtttttttttttttggtcttagacacctgagggactgtgcagcttgataggagcctcctggacccatgtggctaagggagaggagcagcagccatacccagcaggctatggagccaatcctgtaggcagcagagagcataatctgtaacaagacagcactgtaccagcttactctgcacactcagccatactcttcaccttcatctttctctaaagaggcagatgcctactttaatttgtggttggaaaattctataaggttgcctacattccctcattttgtgtctgctgcagacttctctaatgacttactactgactttgttcccactaagctttcttgggggtcctcaacatggcaccccatgaagccatttcagatcatttgaagggatgtcgcagctagagctccttctgtggatgtatttgtagcagtagagtggagcaatcccaggtcataaggaaggattttggttttggaggtgttctaatgggagaagcagaaccaatgtgactatctttaacttaacatttatttggtcatctttgggactaaaaactccttgaggagtttcactgtgctccatatgtcctcaggatgaaggatggtacaacagactgagactaggagccatgctctttgcagaaattcatactgagaggttataatatgctagcatctttaccatttatttcctatttgaattttcagtttctcagtttgtttgttattgccatttattcctatagttacagaactgtcttttcccctttgcttgtagaagtcatcagtcgttctagatgatggacttgttcaggatgagttttctgagagtgtgaagatgagcacttacttggttgctttcattgtgggagagatgaagaacctgagtcaggacgtaaatggaaccctggtatgttgatgtggtaattgtctgaaagcctgtgtcacaagaggctcagaggacctcttgctttaacgattcctggtatttgctgtgtgaaataaataagcttttagatcacactctgacattttataccagaaatgctacttttttgcttagctgttatttactgttactagtttaatagctgaaagtcaataattttcaagttttaaaaaattttacttttaaagagaattttagtaagacactatatgtatactaaagcttttagaactgagtggtagccactagccttagggggaatatttagatttaaataaataaaaattaaatacaatttaaaattcacttcctcagtctcactaaccatatttcaagtgttcagcagtgttcatgtgactagtggctacatattcgatagctctaggttgtaaaaattagatgagtcctcccttttttcaaagcaaatcctgatgagattcctcttcctaatgaataagattgtctatttagttaagggtctggtttatctgtattttgccaaaattagactcttctgtttttctttatcatttgtacctgtttgtaaatgattatttgattggact

SEQ ID NO: 116595 - DNA, 1046 bp, Homo sapiens
atgccttggaaacaactgtgaagcttcttgagttttttcaaaactactttgaaattcagtacccacttaagaaattgggtaagaatcaaatagtgtgtctgatttttgttataattagaacctagatttattttgtgaatttttttagaaagaggttctgcccaagttgtttgcagagaaaaccaaaaaccattattaatgctttaaaaattgtttgtatttgttaagattatttagatttcatgaatatatctgaagttggagcttaaaacacttaagtttatagggctgctaaaaaggtgctgtataagtgggaatttgcttatggcttagtctgcaatttgactaattctaacttccaagaaataccctatttaaataataaaaactgagtaacgggagctcaggaaagcaagaacatttcagtgctgttcaacatggagctagtcctagagagtagagtattggccgtgaactttgtccttcttgctctgggaagctgattgattgtaaaggaattaggcatctctttcttcactaagggacagtggaacagtgactctaaaagggtttgaacaggtcttcctcagctgacatgtgggtagagagcatacagagctagaataaggaagattccatttattgtgagtataaaaagaattcattgctttcacagtgataaaccattgaataaaatactttgagtagaaaatgcctaagatgagggaaagttgatcacttatttcctgttatgtccagatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccaggtattagcaaccaaggctgttctgtgtcacacctgtggtctacttcatgtcctggagttattgttagcatttagatgctaataattctttttttttttaagcattgccttcttttataatagaaagatgctt

SEQ ID NO: 116596 - DNA, 1110 bp, Homo sapiens
attatttctgtttaagagttacattttatttaaaaccgacctcaggtaagggaaatgtatattttcttagtagaaattctagactatatataagaaatcagcgtaaggaccagtttttgttctttctctttttaaatttcaagtttcatttaaaaaaatatatgctaacctttttagaatattcatcttggatactcagagttggcatttgtttactttggtaatagattcttaattttcccatatgctgttgtttaggaaatgctaattttaatgtggccaggttataattgtatctttaaatttaaggaatattcatgaagtttacaatcttcctacatttttgaaagcttatatcctgaagtttagtgacactggtcattttttcctaatgatatttcacactaattagtctaattcacataaataatttactatacttttgcatttgatactacttgtgatattctaatcttttcattttttgacagtatgaagatttcttagatgctcgatttaaaaccatgaagaaagattccttaaattcatctcatccaatatcatcatctgttcagtcttcagaacaaattgaagaaatgtttgattctctttcctattttaaggtattgctgtgaacaaaaaggtagctggagtgggtttaaaatttcgtataatttcgtatgtgagcaagctgtgtgatttagattattttaaagattaaatgtttttcaggtattaatggtaaactataaaatgtttgcttctgtataaatcttggtcataacttttttgtgggtttttttctttctctgactctaacttaagttgtatgactagtattccagacaattaaccagatcttatagcgatgcatcttttaaagtcagtttactctccagatctacaggtagaatatgttcagagaaggtcctaagtaagctcttggctgtgttactcagaattgaggtatgctgtcaggtcaggactgccaaaacaagtaagcaaaaagagattttaagaattgaagattcgattttagaatctgaaacacacgccctgggtttcaaggtaaagaaaaagcagaatgttaaaccccattcggatcaccat

SEQ ID NO: 116597 - DNA, 1391 bp, Homo sapiens
taagatttttacctgaacaactggaaaaatggagttgccatttgctgaaatggagaagactgctttagaagtaggtttagggaaagaagggggaagaaacttccatttctaagtgactatgagatatggattagatatccaaatggagataccacacaggcagttggatatgggtctgaaattcaagggggaagaagtctgattagatatataaatcaggggatcatttggaaaccttggagttgggagatcaactaggaaggaaatttagatagagaaaaggggtccaaagatcagatgcaaggacacactttcttcattggaagatgaggaggattcagtagacgagaccgagaaggatggccagtgaatagggagagaatcaagagtagtgtcttgcagctctcaaggaggagcaggtgatcagttatatcaaatgctatcaataggttgataagatgagcctgagaattcacatttgtatggcaccaggaagtttaccagtgaccttgataaaaatacttccggccgggcatggtagctcacgcctgtaatcccagcactttgggaggccaaggtgggtggatcacctgaggtcagcagttcaagaacagtctgtccaacatggtgaaaccccgtctctactaaaaatacaaaaattagctgggcgtggtggtggtgcctgtaatcccagctactcaggaggctgaagcaggagaatcgcttgaacccaggaggcggaggttgtagtgagtggaggtcgcaccactgcactccagcctgggtgacaagagtgagacttcatctcaaaataaataaataaataaataaatacttacagtagagtgatgattagaagatggctcaagagaaaatggaaagagagcaaatggagatggcaaattgaggacaactcttttgaggagttttactacaatgggggaacaaaaaaacagcacggtaacgagttggtaacgaggagggtgaagttagggaaaggtagagagtcttttatttgtttaaaattaggaatgttacatcgtttttgttttgttaatgggcatgttacagtatgaagggaaaagttggtgatgcagaagagaaaggactgttggggacaacagtgagtacttaaatttatagaacaagtaatagctatgaagtgtgatacagaaatgagagtaataggtaataatttagttatgtgtacaataatcttgacattactacatttttatcaaaagtgaaattcattcaaaaactactagagtgcctactatgtagtgggcattgtttttgtcattggagttgagttttcactttttcctctcagcttactgcatagatgaggaaataaatgtgtaacagatacaggatgccatataaattgt

SEQ ID NO: 116598 - DNA, 1030 bp, Homo sapiens
tgtgtctccagcacacaataaattcaatgggtgatttaagcactggggatggaggtgtaggtgccacagaaaatttggcatgtttttctattaaaatgtttttataaatacttagcttttcaacactaacattgaaacagtgagtataccaatagaccacacagaatgactcatggttagaatagtgcacatgggaatctactcattaattctttttcaaatcctttaaaataattttaagacagttgaacacagtccacatctatatgagactaagtagcagtatattataactaagttctacatatgaaagtaaatttttagaatgactgtagtttgaattttagattcccaattcgataatctatagtattctattattttctttctttttcctcacttttttttttaatagggatcttctctcttgttgatgttgaaaacttaccttagtgaagatgtgtttcaacatgctgttgtcctttacctgcataatcacagctatgcatctattcaaagtgatgatctgtgggatagttttaatgaggtaagtgacctgggtaatttatttagctcttactgtaaaaagagaggagttcgtctatttatactttttagcatgtgtgtaagttaatctgtggtacaaagcatagttatttaagaaagggggggatggagcttgctatataaatatttatgaatggagcactaaattttatgtcaagaaatgggagtgctgttcttagttgttggaaaagacgtgtgtgggcttgggtagccagttgtttttttttttcctgtaccttaacttctattcctattttgtaggaaagttgtcttctccgtattaatgaatattactatattttcattatttgactttttttccagaaatctcttttcctatccttacccttttagtttttctgcctcttttgaatgattctgtactctgctctatgaatctcttgcctttgtgactgttcctccagagtagatgatacatcacaagctgactgcatattatcct

SEQ ID NO: 116599 - DNA, 1451 bp, Homo sapiens
ttactttatacttactgtcttaatctgttggcatttagaacatatttctgcctttctcattgactgcaacttttgcatcatggtgtttttccatcccaaactagttcctaacattatcctcaggtttttcagcacccacatcaaattatgcattggcctcttcacttcaatactgcttcgacacccaaaagcaccttggttttaggcaagcttattttcttctaatcctctggttcagaaataaataggtcagagccatgataaatacaagtttaattaaaatgggaagatttgctccatccttttgtgctttaaataaatgggcatatggtgattgaggtgaggcctgccatagtagagtgattttatcaatttaggtacatcatgactttgttgcttacaattcaaattcatatataatctagaaaaataatttgaatcctgagtttaacccacctgctttaaagagactgttgttcaaaaattgcttcttagttattgatactagatgtcttaggggctttgggccttagagggtctgcaaagctctgacactaggttctagattttatagataacttcatatattttctgggaaagaagggctgtgaccactaaagtagtttaccactgttttctagaaagacttaaggcaactgacctgttcatatgtcactcttctgctgccgctgctccctggcactcccacagtattaggtcctaagagactatcattgtggaggtggagggtaggagcataaagagaaacccagactcaggtgcttcacaggattgagtagcagtgtttctgattctagactgtatatcattattcatatcttgtagatgttagtattgtgatttgaaagaatacttataccttcttagggattttaacttgatgaatttagggattttaatgaattcttagttggttgatatatgtgccacttctcaacctagtgcctccctcactcccttagctatcacttagctctgttccaggttacattccttttagcagttgctcatttacctagattagaagtgtaaactcaacattcatgtttcttttttatattaacattaaatgtagtctttatagatggtaggaaaagagggaagggtacagataaattaaaatgtaaaattttttaaaccaatttttatttttaaggaaaaagttttatatatatatatatatattttgtaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaaggtacatgccctctttcttttcatgccatctcttttgcactctcaggtggaaatatttttaagtgttttataatcata

SEQ ID NO: 116600 - DNA, 1022 bp, Homo sapiens
atatttcaaatcttaaaggtttttccattatatgaaattttttaaggaatgcttttcaaaaatgaagactgcagtaccttttgtgatttggtacatataaccaaatcgccctttttattgtgtagttacagttgataatgccacctgaaatacatgaatgtgccagtttcattgcagttttaccatagtggagtgttaaagcagcaacaatctaattatttaaaatcctagtggtagttggtaatgtcatcatatctttgatagcatagctggaagtacaaggaattgctactgtctttgagtaaacaaaactctaactttgaatgagccgtaaaaggatagtctctaacccaagagagaacaaataaccccatctccctatatcctgaagcacagctaaaacatggctggagtatttgcaagaaactaataaggaaattttgcaaactttctgatagtatattaattttcagtgctattagaaataattgggcaataagaaatctgcttttattatctgttttttgtttcattggttgatttttttgtttgttttttcttgtttttttttttttttttttttttttttttttgagttggagtcttgctctgttgcccaggctggagtgcagtgacaatatcatagcccactgcagcctcaaacccctgggttcaagcaatcctcctgcctcagcctgccaagaagttaggaccacaggcatgtatcaccatgcttggcttaatttttgtattttttgtagagacagggcctcactatgttgcccaggctggtctcaaacccctggcctcaagtgatcctcctgctttggcttcccaaagtgttgggattacaggcatgagccaccgcacctggctcctctttactcttttttttttttttttttttgagacagagtctcgctctgttgcccaggtgagagtgcagtggcgcgatctcagctcactgcaagctccgcctcccgggttcacgtcattctcctgcctcagcctcctgagtagct

SEQ ID NO: 116601 - DNA, 1050 bp, Homo sapiens
gactacaggcgcctgccaccatgcccggctaattttttatatttttagtagagacggggtttcaccatggtctcgatctcctgacctcgtgatccgcccacctcggcctcccaaagtgctgggattacaagcgtgagccactgtgcccaccctcctctttactctttacctgagtttattctgagcttgttgagctctttttgagagtttaaccccatagactagctcatattttactgctttagccttctaggcccttacctggcattctgtgcttttgccgcacaaaaattctatcagcaactcaaacatgccatactgcctctttaggtctttgcatatgctattttctctccttaaggaacacccttgcctcctcactccctcggcctactcctgtttattcttcagatcttagctcagccattgcttgctccaggaaacctttccttccctgaagacagtttagatgccctacttaggttttttaataacattctctacttctccactcataatatactgtaagtactgttcactcatatctatcctcatattaggtatttcccccattgacggtagtgatcatggctatatgaatcactgtaaatcacttttagcacttagtaggcacacaaaaacttaatgaattagtaaattttagtccataatgaagtgactccagtctcactataaaaatttctaggaaaagaacatgcaaagcctgataaaatgatgttttctttttctcttcctcttcttagtaaagaggaatatacaaaattcactagaatataattgatttaatctagagctggaactgggccaatacatgatgaaagtagtgtctgttacttcctcttctcaactgtgttatttcccttgctgctgctgctgctattttaattcctgccatttcgggtttagagagtccacatgaaaacttctgtccttacgtttgaccctgaggacagctgagccttcttggttcctaatgctccagtgagaattactcttaatttaactgcatttttattttttctattctca

SEQ ID NO: 116602 - DNA, 2795 bp, Homo sapiens
ctcctgggctcaagtgatcctcctgccttggtctctcagagtgctgggattacaggtgtgagctgccatgcccagccctagggttctttcttgataaaagctccataggatatagtgtttggtgacctggagagtgttgatatttttggattagctaatgataaagttaatttccttagtcataggtttgctaaaaatggcttcaacttggagcagccactgctgccatcacaagtatcccttaaaactgcattctgcccttgaaaaaggaataaaccttatttaactgatctttcccatctgttgctgtatcagcaatataacagaaataagtacggaatttttttagtaagaaagactgcttagcttattatgtcctgttaagacatgatcagaatgtctttttcatcttaaacatcttttgcagtatcgatataattggaataacaaagatattaagggcatctgacacatttgaataattcatgtttttgaaattgataaatcctaaggtttcaggtactaatatataatctttagtacctaagctaaggcttcaggtactaatatataatctttaggttgaaaacatatttataaagcattttatataaaaaaccttcactacagaattataatgatagtgaacattttaaaacagcctaaattgttcaaaatagattggataaacttgaaatgaaatattatgaagatatttgaacactgcttatgaagacaatggaaaaatgtgcggggggatctgataggtgaaaaaggataaaataaatgcatatagatctgctgtataaaatattaaaaacaagtataagacaaaaacttggcaagaagtacattccaaaatgctatcatcgtctgagtttagattattcttatctctactcttctttttcttacaattaaaaatttttttaagtatttgttactttaaaagggggtaaaaattatataataaatatctacaaacctttgtctacacttgatttaaaactatttattgtgacatagtcattatttattcattcactgactaattcagcagtatttgttgagtacctgctaggtcattgttataggggctgaggcgttagcagtaagcaaaatagtaagcttatgtagcttatattctattaaataatagtaaacctcaagatgcttagaagcataccccattataattaagtctacatccttgttgccaactttaaaagacatttcttcattagcagttttaaggattttaaaaattcatacatatattttgtggtcagttaactctcagcgcttcattattggtacattagttgacataattccatggaaatttctaacagttctctcagcatttatagtagagaccccagaagtgcctatcctttcctattgttttaacccaattatttcttatttgtcccttatgcaatcttaagccttccctaatgtttattttgctagctttaaataatgtgacttttctaaatggctttgtttgttcttcctttgctaacatgacaaaagacagaggccaaaatgggacacattttacacagttctctcactgtcttcccctgctgcctcatcctacacctttactttctccctccctctttcctctagccataatgaacttgggagccagttcagtgcatggataacatgtatactttctctctgggccttgagcacttgggttccctactatatcttcttcacttggccaacacctacatattttgaggtctcttagaagaatgacaacttagatgtcatttcttccaagaaatcgctcctaactttccctaggagagggaagcattttttctatgtgcattcgttgaatgctgtcttttctttttctgtcaatagcgcttgtatgatattgtacttgcctgtttactttagactgtgagatctctaaaagcagagacatatctaccttgttcaccatttgatttccagcacctagcttacagccaatattgcacagtaaataaataattgttaaatgaatgtcttgaccttcactaacgtgaaaataactgtacttggagacaggcatttttttcttactagaatgattaaatataaaaataaactaaaaaacaaagcactcataatttttttttcttgtccaattgtcttctctctcaatctctcatttttttggtttccattaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcagggtagagtatacttagtttgagattttttctttttttaaacaaatgtcattgaggtaaagaacatatatgaaaaacagtttgaaagaactagcatgtattggttggtacaatacattttggaggattgggaaaatatgtgttctttgcctccagggactttataaaacattagctacgaacatactgaacagttaaatgaaacaggatttaataataattcaagactagatatcaaaaacaggatacatattttgttgactaaacttgatacacgagttcaagctctattttattttataagagaattattttcaaacagcagttggtttaagcatgaagcttagtgcttatgcattggttttgagggacatctctgatggctggagccaccttatctgtactgcttgcctccccaa

SEQ ID NO: 116603 - DNA, 1586 bp, Homo sapiens
actgtaaattcacaatagaccttgtcataacaagtttgaaaaacaaattcccattaaaccaacaaataaaattaaaaaaagaaatcagatactctctatgctatactctctttcctggcaaatataactaattaataaataaaattagtactattcatcttttctaacccaagatattatacttttgctgagttagtagcaatttacaggagacttaggaataaaaaaaaatgagctattgtttatctttctcttgaaatgcctctttaatcttgggcctcatgaaattaatcagagataatcatatttagcttaactttacaaaatgccactgtaagtttaaatttttggtctccaagactcaccatctaaccctaagtttctcttttagcatgcatagacttcttctgtgtgtctctgcatatttacttttcctgttcttttatcctttagcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtggtaagtctgcctttttgccagcttcttgctgtttatctttaatattgttattcatggttccattttcagccagtaataggctgaaaaagcaaccagttaaattccattttcttcactttcctgcttgtgaaatctttacttaaaatcaagatgttgcttatgatgaagagctgataaaggcttagtatgatatggtcttgtttgaatatcaaaatacagacatttgacaccactgtcaaaatgaggtcacatgagaataatatttctctattcagatcctgttttatttctacatgatgaatgtttgaaataggcccttttgcaaagtagatctccccattaattttctagtggtcattataaaatgacagttacgtttgtattgagaatattctgtttaagggttcttactgataactatctaaaggataatgatgctggtggatatgtttctttgcaaagcactaaaggagtcttagtattagagaccattttacctttcttaatatcaactgcctgatcttaacagttgttattttggatacttttaatattaaactgttgagagactttaaaagcttggaagagagtgaaaaattatttgtttttatctaattctctgaatcagcgcattttgacaacagagtttgctttataaactagtgagatttcccagggacccaggcaaaaggcagcttttagggaaaggaaggcagtattagaccaagaattagaataagtcttttggggttttggtattctcattggtgaaaggaaggggttggattaaatcatttttttaacattttttttattatactttaagttctagggtacatgtgcacaatgtgcaggtttgttacatatgtacacaaccttctttctgcctctgttactgccttaccctgcgtctcctatgaacagttctctcatcacctgcatgattctcagtgaatggagggaacgcagggcagag

SEQ ID NO: 116604 - DNA, 1050 bp, Homo sapiens
ccttaatgatttcatatggagactaactagtaaaattgctccctgtaattcggtggtgtaactgctcaggaattagccacagccatcttcaagtgtcagatttcctttgcttccaggacttcaagtgccattctttccattgctgcctttgtgttttagtaaactctcaatgagtattgccattgttcttcactgattttttttttaaataagatttcaagcatgtgattttttttctcacattcttcatttgttcctatttgacagttatgagtaggatttgaatttcttttgttctccagtcatttggaatggttttctatcataatgctattgagaaggtaaggccagtgaagacaccacataacaatgcagttaggtatgtcaagtgggatcccctgcattgcttgtccgttccttgcatcgtcagcgtagcaagtatttttctacttcatgtcctcccagtgactcaaaagctttaccacttacacattccacaaggtgtctgttctgtgtttcattgcttttgaaacaaacacaagcgagttgacatgttatacaaaccttgagttcttttccttgcagattctttttttctattctcatattcaactccacaagatgcttattcacagtaagtcattgctaggataatggtcttaatagtttaaaaatttccaaataggattcattttaggtattgacagtggtactcagtggtactcactgtcaatacctaaaagaaaggaagaaagcaatgttctgtgaagaacttgagctaaacttctgaagttaagggttttgcttgtggtcatctgtggtacatgattacttgagatgagatgccacgatggtggtggaggtaaagaagtaccagcaggaagaaatcttcctgtgcttattccttcagagggggtatctgttgaatttttttcattttggtccttcttatgtagccatgaaggttttctaaagaatacctaaaaacggccaggtatggtggctcacgcccgtaatcccagcactttgggaggccgaggcaggtggatc

SEQ ID NO: 116605 - DNA, 9890 bp, Homo sapiens
gattacttctagagggtggcatatatgataatgaggaaaaaatctgattccattctcttcccttgtctccctaatacaaataatttaagtggtcataaaattgtttggaagaattgcattcttggggtgaattcatagcaccaagcctttggactctactttatttattgttacttaaacatctccttggttccattttaagttagaaaaatgtatctgtgtgggagtaaaaagatttcctttttaaaatcatttcagatatcaccatacttgattgggaactccatgtagataccttgaatattaaagtacttctttctactgctttcaagatagcagcacagccatcactaagttaaagcttattttaaaagctggggttacctgaggtttatcgtccttttcttcttttgaaattcttctgtgtgaaacttacaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagcctttgagaaattgaaaaacaattatttgaagttcaccatagtaccttaaaggaacaaagagaatgtgggataggagtaacttgaattcgtgtttagtatggtgggctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctgtgtgtgtgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccgacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttcagtggtttttttgggagtatatactttaaaaatgtacatacatgtttttgatagtttttatattatttcattttgtatatttttttcctgatgaagagtgatatatcatcctatgaaaatttcatctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgctaggagaggtttcaaggtaagagtatatactttaaacatgtatataaatgtttttgctacttttctgtcactacctttcttaccttgtcctttacatggatatatgaagaaaattgaggttcagcctgtagcagctctcctcttctgcccttcccttagattgtctgtgtgggcaggtgtctaagagagtagttgattagcttcagggattctttggtgggtgttggggtatatacttttgtatatgtatgtacatatttttatttctttattatagtgtttcattgggtacccggtccttcacttggatgtgtaggttcctaatgagccatggagttatggatgtataacaatctgttctccctttacccttttaatgtatatgggcaataattttaaagtagtttggatttttttaagttttgaggggtgggaggggtctaaggcagaatatatcctttttaaaaatgtatatatacttttcattaactatattgtattatttcatgctgtacccagtccattgcttggacttacgggtacctaatgaaacgtggaggtccggatgtatgaaaatctcctcttttcccctttccttattgcctctgtaggcaataattatagagtagtatagatggtttttcttttttatccatctgcctatctccaggaggatggggtgtgcacttttagaaatgtatataaatgttcttgctcctttttcctgttacttcattgtgtgccaaggcctttccatggatacttaggtacgtaatgaaaattgaggttcattctatgaaaaaatctccccttctccccttcccttattgcctgtcttggcaatggccagtagagtagttatttaagggattttgtttttttgtttttttgttttttttttggtaggggaggtggggaatttctgggtttgtcttttttttaatgtatataaaagtttgctagttgttgttattgttgttctttcactctcaacacagttttttgtttggagttgtaggaatcaaatgtaatgagggacccagacccgagagtgtggtaaatattctttgccttcctcagagcctgtatacacaagcaagtagtatgtgagcactacagggcttgggttttggttttttgcttttgagggttttaatgaggagtgggattgttgagaggaaaaggcaagatatataatttttttaatgtatataaatgttttgctcctttttgatgttaacttcattttgaatctggtcctttgtatgaccacttaggtacttaatagtaataaagttgagattgactctatgaaaaatatcccatactccccatccctcattgcctagggggcaatggtagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatggggaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattcttaatatgttttcatatctttatttcattttgtagtcttttgcatggctatgtagggacctaatgaaagtcgagtttcataatatgacagctcacttcttttcctacatatttcctcacttagcagtagctagtgtagttattttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatgtatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaacattgtgtggactctttggattaatgtatatataaagtggtatctcttcttaggttatgacctctaccagggcagctcctgtactcattgtcttctgtggttagttttttatttcaccagtatccagtgtctttattgcatatacctcagttgacatttgacattcggaggtggctaattctttgttgtgggggctgttctgtgtatcataggacatttagcaggatccctcccatgccaattgcaactagttgccaatagtaactcttgtccccagctgtgacaactaaaacctctcctccagacattgccaaatgtcccctgaggttagggttaaaac

SEQ ID NO: 116606 - DNA, 1027 bp, Homo sapiens
cctaattacttccacaggcaggttgctccagcatgaaacagggccccaggggacagtctcacctcctttgcctcaaattccctgaagcatctcttttcaaacatcagtcaagtgtgagccaagtccttggccttgccaatgtaaaggcaatttcgtcccttgggcaaaaattgccaaccttaatgggttccagctgttgcatggttgagtgccctctcagtcagcctacagcctgccctggcatttcaaagggctcctgccaggtctgtgtcacccccacgcaaaaggtgaagctggcctttgaaccacgtggccttgccctgtggatgtgcattacctccaagggaaaggaaatgacttccttctggctgcgtggcctggccagaggcctcaggagctcagattacctggatcactcgagaggctggcagcggagagcagcccggatcaacatcattaaggcacgggtttcagcaacacaagcattgctcagaggacccaaggcagagcgaattttttcctctgcaaatctctgtagctcttggggacctttacactccaacatattatgaggtgaaaatcctgtggacatttgggctgtacagagaaatgatcagtatttggtattcacagtacagatgtgtgtgtggagtggggcagaggagggaaggcaagaatctaatccagtgtgcacattatgtctagtttatcaccaggattgccttgttgtgataacagggagcctggctctccctgctgggggaacatcagttgaaccagcagactttcctccctctgtgcttagctgacattttaaccctagatcgctagagaaatggcagcatttattagaaaccagatattcagatatttttatgccctacacaaaaaatctttgccccaatttactaaattactttgtttctatatgaataacatgtttgttattatataacatatattatgttatatcatagacatataacacattcatatgttatataatatatatagcatagccatataa

SEQ ID NO: 116607 - DNA, 1067 bp, Homo sapiens
aaaactactgtaactgatcatgtattttggaattagacttgataataaaagattatcatgtatcacatatctcacaccaggggaacaattagctacataattgtcataccttaatatcttttaaaggtaacagtaattttcaacacattttattttaaaatattattttaacaaaagttacattcctctccacaatgaggctaaatgtcacccacgaaagaactttattcccttatattcctgaaaagaaatcagaattaacatttttatgttgaataaattttaaaatttaggaaatgttctatttaaagttaatttctttcataaagccattactctttacattgtcatttccaaaaagccacaatttcccatgctggatgtgatgaaagttaggcacacctttactgcattagcagcctttgacaatgacttcctcaaactgacaccatcttaattagatgcagggacagggatcagatgggacaatatcaaatttactttgtgccctacaagttaaaaactgcacccattctgtaaattgaatatagaggttctcccttggccactgtcagcttttcttgactggccaaaactgcccattcttcctggaatggtatgaaagcttcagcaaaataaataaaagtcagaatctttgctggtccctttaatgctgatttgatagtaaatcaatttcagctgagacataagggctgtcagtctatcatataaacatctttaactatagcctagagaaaagagggttgaagagcaaagcagattttttttttccttttctatatcttgttctgaacaacacactgtgataaaggggactagagtggaagattccctatttaaacacatgaagctctgggtcctagccttttttggttataagccctttgagaatctgataaaagctgtggatcatctcctaggaaaatagaacaaaacatacatattcacattacacagttccagagtatgtggaccccccaaagtccagagattgccctaggggatctttagattcttgtttagaactgttgattttgaacacaaca

SEQ ID NO: 116608 - DNA, 1050 bp, Homo sapiens
gtctgtcaaggtagttaaaacatttctattttaaaagaaaaaaaaaagaatcctattgaaagattgacaaaatagacaattattacactccccatagttctttatatttttttctctagtgtccatgaaatgtttgaattatggtttcggtttttttttcctcctgcgatgataatcagttgatccctattttgatctcatcccgttaagcagctgtgagaaaccatcatttcgtcaccactcctttggcacttatggcctgtgctatttagtttacatttccctcatgtggctctgtactaagtgttacagcttcaatgtggtgtttttgtccacacctaagttgtaagttccaggagggcagagctgtaccttgtacttttctgtaacccccaggtaactcccacaggaacacacacctagcagtgcacaatcagacatttttggattgccaatggttgatttttcttcctcgcatgaagggggtaagattctgcccactgtcaggtgttctcctttacgatgaaataaactgtgccaagacccttttaagccatttatcttctgactccattatcacaggctaattacatgcagggttaagttgatagccagatgatacagaagacagcatcaagaaagtcggggctctaaagacaaacacaccctctcggctagagctctgccttgggttggccctatcacactctctcagaatcattccatatgccatgttggcacaatggcttaaattgcccatccttacattcatccattagatctacccccgactgtgagtcaccaaagtcatgcacgcaccatgctctttagagccaaactctgtgccttgtgcataaaccctggttagatagctgtggcaggatcttgagcattcttataatgactgtttccagggaaggaagatgcattacacaaagccacatttacacttatttgaccattttgactaagaagaactgatcagcaaagcaaccagcatgactaatcctttattggttgtctaaaatcattggtcctctaaagtctctt

SEQ ID NO: 116609 - DNA, 1058 bp, Homo sapiens
atagtgaacaatgaacaaaaacaaattcaaaattttactaatgtaaagctgtatattgtgattgttaaaacacttttttttgcctaggagttccagatttaaatcctggttctacacttcccaaacctcaggtaccttctgtggcctctctaacctcaatttttttacttgtaaaatggggacatttaatagtatacctcagtgtcgtgaagactaaatgaagtaccacttgtaaagagtttattacagtgcctgacatatactgtatggttagtactgctaaaatgacttcttaaggttaccaaaaggaaaattccacaagctgaccacctttcctattgtgatggtcactggtatttcagctatgatcctttgttgtgtatttatccagactgaaagatgtttttctagtaaccatcttgcatcgtcttagtctccccattaaataaacttttcctacaaactatgcggtttatatttgtgctaactttgtggtattgatagccattggtctgttctttggcacatagctggctatctttgaggtttctccaaaaccatagatgtttaatggatactaatcagagttagtgcagctcgagataatcattcttttagccaactgcttagtaaattttctgacaaaatacatagctgtctaattaaaaaactctgcctgatgctgccttccaggttgctacttacaaaggatagagggatgagttatgttaggttctcagagcactttctgaagtgtaggtttatttcactgtcacagattcagcactctgggtgggctacagttcgccatgcccagtcttctttatccctccttagaacatctccctagagagcatcaggccatatcttaattcgcccttgctttagtttatgaagtactggagccatcttatgcacctgtgtaaggaggctggagattaaagttcagaaaagccatgggttacacagttgtgtaataaccaggagtatggggataactccaaagctacaatacttttatagagaactgtgtcattcacaaaacctatgttgttaga

SEQ ID NO: 116610 - DNA, 1070 bp, Homo sapiens
ccatgtgaaaaacattagtctctaggttgcagattttcctaccctagtggagctgactataatgagtactgtctgtttccattatatcttctgtttgtgaaggtggaaagagtctcaaaaatttagatagggagagacagatttatatagttcagtgaaagaagaggagaggattattagaaaagggaagatgaattgtggggaggtgataaatttcaatggcttaagcattctactgtttttaaattttgatagtgactaacaaaatgctggaaaatgaaaattgttaatgtatagaacttaacagtaggtagttttatcttcacagaaattttaaaatataatgatctttctgaagtattttatgtcttcagttttgctgcatgcaaaaaataatataaattaatcaaatgggattcattacattatacaaattaactagataaattgtgggttttttaattttagagatgaagaaaatgtgggagctatgaatcagtatagaacaagaactctgagtatcacttcttcaggcagtgctgtaagctgttcaacaattcctccagtaagtagtcattcaacatgtactgaatgtttattacatcactactgtgatctgattgccttgtctcattaaacaataatgtatgcctttcaggtacagacttctgttgattgctttttgacttgtcttgaaaccagtactttctttgattttaataaatgaatgttgctcaaaggatgtggtagagttgtgtcctgccaccattatgtgtaaaatgaaggccaaatgactttttgttggtaaaactcaaaacaccttctttttcaattgtcctgattttaggcagcctgttgactaaatttcaagtaattttttcttagaatacaaactgatgagtttcaaaaaattaatgtaggtcacttgataaattgatcaggtttgaggtggatgagtcattcttcatatgagctgaagattaatgagcttggtcactgtgaggattataaggtgtgtaagcctcagacacttggacgtacatgttaatggtataaaattttgttgttgt

SEQ ID NO: 116611 - DNA, 1717 bp, Homo sapiens
acattcattgaaatttgtgtttttcctttatcaaggaccaggaggtatctttaattgattctcaaaacataactatcatgtgcattctcaaagctcagttttctcatatttattttatacacttaagatattttctgatctgggatgagtcacataatctgaaggaaatccttagccccctttgaaagttaatttacaaagttaataaacataagctgaggtttttataacctttttatttatattgttgcttttcagttattttattcttaaaatgacagccagcatatacctttcatatttgtttacctgtgtcatttaaatattacattttagggaaggaaaatttatttttaacatataagctattaaactcacttgaatcataatttatcagagtagtagatatttgctcctcttagataaacattttttctctctttctatgcttgacgccttttttttctaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacgggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcaggtatagacttctgtcgattgctttttaactttagtcttgagactgatactttgttagattctagtaaaagaatgtttttttcaaatgatgtgacaaaattgtattctgccaccttgatgtataaaatgaaagccaaataattttttgttgttaaaaactcaaaatagcttccttttcaattgacctgattctaggcagcctattgactaaatttcaagtaattctgccttaaaatacaaactgatggctgggcacagtggctcgctcatgcctgtaatctcagcacttctgggaggccaaggcaggcaaatcacctgaggtcaggagtttgagaccagccaggccaacatggcaaaaccctgtctctactaaaaatataaaaattaaccgggcatggtggcctgtgcttgtaatcccagctacttgggagactgaggcaggagaatcacttgaacctgggaggcagaggttgcagtaagccaaagatcgtaccactgcactccagcctgggtgacgagcaaaaaactccgtctcaaaaatatatatatatatacaaactgatgattttaaaattattgcaggtctctggatacattgatcaggttttagatggatgagttattcctcatatattttcctaattacacatctgatgtgtgtttgagttatgtaaaggcatgtaaatattaaaacatgcaataaatgtactttctatatgaaaca

SEQ ID NO: 116612 - DNA, 1539 bp, Homo sapiens
ggttatatacttaaattttcactaatcatgggagatttcttaaggcagcataaattagtaatactgataccatacatgtcaatgtacttcttatactaatagtttgtatcttgtaatattcagtcagtaaatgagcagcttggtagggatcatttacacattttcccaaaagggtagtaggtgtttttcaggatatttatattgaaggtataggaatggaatctggttgcacataaatgcactccttaatgtattgattattcataagagaggaacaagaagataaagattgggctatagcatgaggtctaggcgatagcacaagttctagacaaatattcacaatctttaagtttatcacgtgctattgatctgtctaggtatgctcaaaatggtctacactgaaaaaaagtatttaaaaacaaagcaaagaaaaatatctgggaagtgggaagtggtttggttcttgttcacagaaggtaagcaatagacaaccttttgaaattaattgctggggtagtgtagggtgaaggagtggatgccaaagaaataaccagtacgatctgtgtcttaaagttgagaagataacacatgaaacagaaccttttatttatttatttatttatttatttattttcaagacaaggtctcactctgtcacccaggctggagtgcagtggcacgatcacggctcactgcagcccctacctcctgggctcaagccatcctcccacctcagcctcccaagtatctaggatcacaggcatgtgctaccatgcctgctttgtagagacaggaccttgctgtgttgcccaggctgctctcaaacccctggcctcaagagattcacccacctcggcctcccaaagtaccggggttataagcgtgagccaccactgcaagtctaagaacaattttttttttaattatatactgaatttagagaaacttcagtaagtgatagaatagttgatggaggaggtttcaggtagtgagtggagctgagtggagccatgaagcttggatattatttgaccctaagacagtgcattttggcagagaagtggtatgggcaatgacatgaatctatgtgagtcctatgtgtttaggtgacactgaggtgactgtcctgactgcgtttcttggtgtgtattggagagaatattgggagaactaggactgtacaggtggattaaagagttttgaaaaccaggaaaagtttatatttacaaactgaaaagaaaatttacagccaatgtaaaaaaaaactttttttgaggtgtagtcttgctctatcacccaggctagaatgcagtggcacgatatcaactcactgcaacctctgcctcccgggttcacgcgattctcctgcctcagcctcccaggtagctgggactacaggcatgtgccaccacgcctggctaatttttttgtatttttagtagagatggggtttcaccatgctggcaggctggtgtcgaactcctgacctcaactgatccacccgcctcggcctcccaaattgctggggttacagac

SEQ ID NO: 116613 - DNA, 1701 bp, Homo sapiens
gataacagatatacaaaaacagacataaattctaggtcaaattgatatacaaattgaacttaaattcctccttttatcttgtcacaaacacttacagacctgtctgtaggtcacattttgattatcagtacactggagaagaaatgcaaattataggaagaaattggaagcttgtgagcctgggcagtttatctttttccaatgaagactttattgttaaatctttcttatgacttgaacttacgtgacttggttgtacaatgtaactgaaatatggtctttatgctttgatttttgtctagctgtccagggctatcggttgacaaatgcaggatatgattacctagctttgaaaacactttcttctaggcaagtagttgagtctgttggaaaccagatgggtgttggcaaagaatcaggtaagtgctaatagtactgtgcaaagtattttctttgctttagtttatgttttcccttcagaaacctttcctcttttaattttcccttttttctaactaaacagtaagttggaaagttgattggaagcagtacaaatcagaaggtgtccttaattagtaggttattattttctctgaacgtctatcactgaaaattcatttataccaggaattaattttcttctaataactcccaagatatatcattatttatgtgcaaatataccagaatccaaaattcaaaacacttctggtccgaaggttttggataaggagggatactcaatctttattaggaaaaatgacatttttgatacaaataaaattagagaaagttagaattgttttaactgattggaataaacgtgtaataatggttgtttttgaaattttgtctctagatatttacattgttgcaaatgaagaaggacaacaatttgcattaaagcttcacagactaggaagaacctcgtttcgaaatttgaaaaacaaacgcgattatcataaacataggcacaatgtgtcatggctatatttatctcgtctctctgccatgaaggaatttgcctatatgaaggtatttattttattttgtagtcatgcattttttagccaaataatacatgtgtctcaaaggccttaatgacaagtgtgattctgttgtccccacatctctctaaccttagactcaattcctacagacagactcaatcttaaataactctgttgattatttgggctcttttaagtgatttccttctacgttaaggtattttaaattgttactaatgcataagggcaacacattctgtaatgctgacaagatgaaagagccaaaagtaattaatgatgctgttacctcacaaatatgtatgtgtggatgtatatatatctattcaatatatgtaactatacatatgtctgtttctaattgaaaacaccaggtaattatcatctgtagaaaccttagtgtctcagataagttggctagttttttgtttcacataaaggaacaaacatttatagatttatatgtatattaaaaatggtaaaaattggctgggtgcagtggttcatgcctataataccagcactttgggaagccgaggtgggcggattacttgaggtaaggagcccagcctgaccaacaaggtgaaaccccatccctactaaaaatacaagaattagccggggatggtggtggccacctgtaatcccagctacttgggagactgaagcagga

SEQ ID NO: 116614 - DNA, 1064 bp, Homo sapiens
ctcaaaccaaattcaatttttttctaccccctttctcttttcccaagctctataaaaaaaaaaaataataaaatcttaaaacttgcttttcctcatcacttccaattgtggctttccgttccctttacccttccacatctaattgccaagctctcccataatacttcctaaagatttttattccttccttccagtaccactaccacttaccctgttctggtggctctttcctctgagctggacttctgtcttagttctccggagtaccccctcagattttgccatctctaagccaatttgcatattcctggtacattaatgtccttaaaataaccctgttcgtgtgtctcccacgcctaaacatcttcaagagcttcctgctctcatcaggataaaatataaaagtatttggtctacattttaatgccttctctatcctagaagtatcttccagccgcgtttgcatgaattctatatgctatcccatctgagctgctactgtactcagctattctctgtggtcagtactttcttgcatatgtgccattttcaaatctttttctttcactaatatccccttgtctgttttctctgtatgcccacatcttttaaaagtcagtctctagttttgcatcttccttggaactgatccctcagctagaagtattcttattctgccctgagctacctttttaagcacttatcacttcttaacttctaataaacttagatgtataccattttttaaaatttccatcatgagataaaaatttctcagaggtaaaaagcacatatatatatatatatatacatatatatatatatacatatacacatgcagaagagcatgtaggatagagatatatatatatgtgctttttacctctgaggaataaatttaaaaatatatatataatatatatattatatatatattatatatatataatatatatatattttatatatatatattatatatatatataaaatacttttaagttctggggtacatgtgcagaacgtgcaggtttgttacataggtatacacatgctatagtggt

SEQ ID NO: 116615 - DNA, 1024 bp, Homo sapiens
tacatttatttaggagccgttatcttttggtaaggagtgaaccccatgataaggactacctatattgtgtaattatgtaataggatatgcgatgtgagtcacactggttcttgcattatgttaaggcttcaagttttggatttttaaaattaatcttaaatagcgcttaagtattaaactatcaaatgcaaaatcagtgtgaaatttggaagacaatgtttactttgcctctcatgtagattcttctaatcagctggactttctctatgaaaacctactatcacttcggaaagataccttcctttcctgctttctcagcacactcattccttagtgtctctgacagaagtaggggtcaaaagtaagagtgttagaggacgggggaggcagagacaaagcatggaaaataagttaaatttaaaagttaaggttttggtgagacatcaaaatgatgccagatttatcttccaaaacattggcgctgcaatatttaaattatttgtaaagttcaccaagaaatgacttagtcattaaatatgacattccggtctcagttgaatctcaccagtgttggtaccctttcttgggcctctcttcccttttacttctttggctcctcctatatcaataatcattgtttgactagctgcccttagctttcaatatgaacttgccccagaattctgctcccaaacattccttttcttccattatctcctgctcagtgatagcatccacttcacatcttcaactctcacttctataaaataattgacaatttttccttctaattataacttcattcctaaatataggcccctttcctatttaattttctctctttcttttttttttttttttgagacggagtcttattctgttgccaggctggagtgcagtggcacaatctcagctcactgcaaccttcaccttctgggttcaagcgattctcctgcctcagcctcccaagtagctgggactataggcgcacaccaccacgcccagctaatttttgtatttttag

SEQ ID NO: 116616 - DNA, 1794 bp, Homo sapiens
taaaaatattagcagggcgtggtggtgtgagcctataatcccagctacttaggaggctgagggagaagaatcccttgaacctagagggcagaggttgcagtgagccaagatcgcgcccctgtacttcagtctgggtgacagagccgggctctgtctcaaaaataaaaaaaaaattcatttctatgccttcttatgtaagtacagaaagaaaaattccgtttaaatggagatgttcattggttgaagatggttaatcaaagacatgctgcattcaagtaaaaagcagacaaaggcttgaatatcgaggagttgcagagccagtatgggtaactattctaaaatccttaaatcgctcctgggccctcgaagtcctacccgcgtaggtcagcccgaactatcaaaatccccacttcctctggaggtaaggacgtccgccgcgctctccacgtgtcaccttaaactcccaccccaaccagcgcaggcgcacttcgaagcctcctagaccaacctaagagaagtactgagcaagcgcatgagttccattaaccacgccctccggagctgccggagcaggcgcaattaggagtagagggcgtgcttgtgtgattacagtccactttacctttaacagatttggttgtctggactctagctcaggttcttttacccctgtcttgttggaagtcactttgcctagagtagaagttgtttgcgggaaaaatttgctcctcccattaagtaaccactttgctctctgaggcggaacgtgtcattgaggcagcaagtcctgacagatatggaaaaaaaaaggcacattgtagagaatatctacactccgccaactcagtcacaacgcaaaaattacacaaaaataaaacgttcacttgttacatactatgtgtttcataagacatacaagtagttttattttcctatatcaatgagaacagcacttctaactattaacaaggacctatactaagacgcagcgcgtgcgcgagccatctggcgctgtaaagcgcttagaggctggaataacgacctgccttacgctttgcggctgtcgtcggagaggcatctgggttcggactggggccgccatggggaaagtgaatgtggccaagttgcgttacatgagccgagatgacttcagggtcttgaccgcggtaagaaacccgccgttcctgttctcccttccccttaacactgtgtgacctcttcctgttcctgcaagttttctgggatctgagcaggcacactctgggacccgggacgtggcagaagctgggaatggagaagagagcattcagaaagtcggatttttaaaaaggttttgtttgggagcttaccttcccccagatagagcaaaggtcccgtcttctaataattgttttcttttctgctgctattcgctttgcgctgaagagaaacgcttgcatctctgtggcctggaaacttctctgatcctgagcttccgaccagctgtgaaaggtttaagcccccccccccccccgagatttgataatattgacttccctactaacagactcagtcgcatagcagtctttctgattcattcagtcaacacatatttgtcggttttttagtagcaacattaggaggttcacttgttcaaacagacaagtggagagagagacacagatcatcaagtaaacgaaaaataggataatggataaatgctatgaaaatgataaaggataatggcatagaaagtatatgtatctggtggagaggaggggcacaagttattggcctttggtagacaatcaataa

SEQ ID NO: 116617 - DNA, 1251 bp, Homo sapiens
caagcaggtagaattttcgactattttctattgttatataatattttaatctgtaaagctaatttctggaattttgtattttttttttttactggggtttttccccttctctctttatacacacacactctttctctctgccatccatttttttttatcctctcttttggaaaaagaacaaatgcccagaatggacagaagcagaatgatggcaccattcaaaggcaggaagagccgggagagatctgatggagtcaggatagagatctggttctggctttcatccactaacttcctactctgtgcagggtatataatggaagtaaacaccacccacgtgtatcccttgtccctggcatgcggaatcatccatacctgttaaaatactgaaggggtttcctttgatctctaggggattacgtatcatttgagggaggaagcacgtgttctgtgaggttgtgaggcttaggtctaagcactgtcatttactaatgtacccctgcttttgcttttggtaatataatcttatgttctccctgccaaccttaaccatgcccctgagggtggcagggcagcagcaccccagagagatgtgcttaggaccccagaggtggcctgggtgagtgaggatggggcagtggacatgggtcttgaaagagtcagtagaggcgagggtaaagagcatgaactgctagtggcacgaaggattctaaggtttaaagacctggctgggagctaaaacagagatgatggagttcaagaaaacactccctctctggtgaatggggagttttttcagtggactcttggcactagctcttagggccctaacccctgtttcctgctgcagtatgggtcagatatattctttatcacatgaagagggtgcttacatgtacaattttgtggatatcctatcaaataaatatattccttttctaatttaaacaaaaaaaaatgcctgcttgacaattgatctataaactggcgtatttgacataaaattaatatctatcatgtttacaaacctaatcctgcacatagctggacatagaaaaactaaaaataacattttttcagaatttgaaagtaacatactgtaaacacataaaatagaatttacaatttaagagaaaaaaattacaatatacattttagtttataccatttcagtacatatatgtgtgtaaatatatacgtactcatgtatttatacaggaatatatgcatatatgtttgtaacctgtgttt

SEQ ID NO: 116618 - DNA, 1325 bp, Homo sapiens
ttatgtcaaatacgccagtttatagatcaattgtcaagcaggcatttttttttgtttaaattagaaaaggaatatatttatttgataggatatccacaaaattgtacatgtaagcaccctcttcatgtgataaagaatatatctgacccatactgcagcaggaaacaggggttagggccctaagagctagtgccaagagtccactgaaaaaactccccattcaccagagagggagtgttttcttgaactccatcatctctgttttagctcccagccaggtctttaaaccttagaatccttcgtgccactagcagttcatgctctttaccctcgcctctactgactctttcaagacccatgtccactgccccatcctcactcacccaggccacctctggggtcctaagcacatctctctggggtgctgctgccctgccaccctcaggggcatggttaaggttggcagggagaacataagattatattaccaaaagcaaaagcaggggtacattagtaaatgacagtgcttagacctaagcctcacaacctcacagaacacgtgcttcctccctcaaatgatacgtaatcccctagagatcaaaggaaaccccttcagtattttaacaggtatggatgattccgcatgccagggacaagggatacacgtgggtggtgtttacttccattatataccctgcacagagtaggaagttagtggatgaaagccagaaccagatctctatcctgactccatcagatctctcccggctcttcctgcctttgaatggtgccatcattctgcttctgtccattctgggcatttgttctttttccaaaagagaggataaaaaaaaatggatggcagagagaaagagtgtgtgtgtataaagagagaaggggaaaaaccccagtaaaaaaaaaaaatacaaaattccagaaattagctttacagattaaaatattatataacaatagaaaatagtcgaaaattctacctgcttgcacaggtaatatgatacacaacttcagagaatggagtcagcaggagattgtggcagaggccacagctttagactaagtctttcttttctttttttttttttaattatactttaagttctagggtacatgtgcacaacgtgcaggtttgttacatatgtatacatgtgccatgttggtgtgctgcacccattaacttgtcatttacattaggtatttctcctaatgctatcgctcccccagctctccacccactgacagggcccagtgtgtgatgttccctgctctgtgtccaagtgttctcattgtttaattcccacctatga

SEQ ID NO: 116619 - DNA, 1028 bp, Homo sapiens
gccaagatcgcaccactgcattccagcctgggggacagtgtgagactccatctcaaaaaaaaagaaaaaagatgcctgaaagactatgaacaacaaaatgataatggttgcttatttcagggtaaaaaggttgaatacgacctttattttcttccatatagtattatttttaaactgcagctactctagccctaggcttctatgattcaaaaaattaaaaactagtggatatattttgatttgtcttacatcatctgagaaagaatataagacattcaaaagtctagatgtgctcggattaaaaattcctatttgtgaatgttggctgtgctggttgaagagtggcaaactcaccaaacctcctccatggctgatgctgatgtaaatccaaaggcctaccctctcgcagatgtccacctcaccaagaaactactggacctcgtgcagtagccatgtaactacaggcagctttagaaagaagccaaagaggccaccaaaaccctcagtaggggcatttctgggttcattgtgggggctgcagatgccaagctgctggagatcattctgcacctgcagctgctgtgtgaagacaagaatgtgttctacgtgtttgtatgctccaaacaggccctcgggtgggcctgtggggtctccagatctgtcatcgtctgtcctgtcactgtcaaagaagctcacagctcaagcagtagatccagtccattcagcagtccattgaaagacttagtctaactggtgtgaaatggtatctcactgtggttttgatttgcatttccctgatgaccagtgatgataagcattttttcatgtgtctgctggctgcataaatgtcttcttttgaaaagtgtctgttcatatcttttgcaacaatggtgatcattaaaaagtcaggaaacaacagatgctggagaggatgtggagaaataggaacacttttacactgttggtgggaatgtaaattagttcaaccattgtggaagacagtgtggtgactcctcaaggatctagaa

SEQ ID NO: 116620 - DNA, 1082 bp, Homo sapiens
gagttttgaggtgtagtttaataaaaaaaaatgtaaaggtaaaacacatagaagagagagcactaagggcccttgtgttacaacaggaaatggtttcccaaaatgccactgtgcttctctagccttctctgagtaggaaaatattctgaagatattctacagaagccagctgtttggatgcctcgatttaaatactgattccgcaactaactgacttcacagctttggtccaggtattaaatttcttttaatcacggtttgcccattggtgggacagtgctagtaatagtatctacctcagggttattatgagaattacgtaagataatctacattaagtactccagtacagtcaatgttcagtaatttttttgtccttttttctctcccataacatatgatggatcacaattttgtctgctacaattatttattcagtttccactgcctggatgctgggatatacaaaatatagtctctgctctggggaccctaaaagataagcatgaaccagacacaataacccataaatgcaaatactttgtgataagatatgcattgtatatatttttacagatcagtaagtgaaccacaagtattgcaacaatttgtaatcaatttcccagagcaaaaaacatagtttttacagatatataacataataagatgcattaagtatgcatatttatacattgaattatgcatcaattaatatgatgcattaattaatggggagatgttggccaaagtgtacaaactttcagttatgagataaataatttctggagtcctaatgtacagcatggtgactatgattaataataaagtattatatacttgaaatttgctaagaaagtagatcttaagtatgctcaccctgccccccacacacaaaggtaactatgtgaagtaatggatgtgttaattagcttgatcatggtaatcatttcacaaaatatacatatatcacaaaatcatgttgcataccctaaacatatataatttttatttgtctattataccaggataaagctgggaaaaaaaaaagagatacattcactgttgtctgccttgtatgtctc

SEQ ID NO: 116621 - DNA, 1055 bp, Homo sapiens
aagttacagtaaaaacagataggcatccttcattagggacctagtggtttgggcaattcaaaatgtgtctaataagtgagctggtgagactgaaggtttgcccctcaattatcctagtccattgattagctcatttaaacatgtgtggaatatcagcatgtccgtggttgataagaaattcctaattagagattctgagtaacatagcgggtacagttgccaactacgatttggatgttagtggattttaaatggcaaccctgtgctgtttggggaaaggcaaaggcgagggcggtatcaagtgtctctcagccttgaggtcattcttgagattagataccacttcacacctaccgataacaaattggaatctatcatcagtctcataactgcttttctgtctccacttggcagcctctttctttgtagacaattgtctttttcctcactttcggacccatccgatcataaaaggagaaagtgagctgccattgaattaatccgtagaaatttgtggaaaatttaaataatctgtagaaatttgtgaaaaagccactgagcaacaacaaatcgtggcataattacactgcataaaaacccaccactctcattaattacactgtaaccgaacgttgaagtttgcccactcttagacctctccttgccgctttcaggaagggaaatgtcaaactagaacacctgagcctcgcacagctgccagcgaattccggcggcagttcgcgggtaccttcccagcccatcctatctgctccggaccgcgggtgacattcagatttccaacaccgccccgagcttgctttaccagacaccctcaaacgactcggaacgcggttccgcagatgtgattggctgaaaggggacctgccgcgcggcgctctgtaaaagcgcctgcttcctccaaggaggtggagctgaagctggcagggccagggcagggaggggtaattaaattaaaaaaaaaacttggagggaagatgaatcggatcacattaattcaaggagaggtcaaaggccggtacctttgtaacgccggc

SEQ ID NO: 116622 - DNA, 1059 bp, Homo sapiens
aaatgaaagctctagacccacaaatgctttagcatgttcagtaactggtgtgaaaatactgtcacactgatcacagataatctgacccaaaaatagagaaatctgtagctgcagagttttaattctgcccttggggaatgaaaagagtatgaaaagagtacctttagttgctttattttattttattttttttaagcaaacctctgcaattcctgaatagagatccaatatgggagttacttgcttactcatacacttcatggccttcttggctacatccttgagattgtttctgctccgcattgtcttggcattttgacaggaggcttactttaccgcctataacaggcaaagtgtgcgttgtcgttataaattcatgaagcctggatatttctgggtgtatgctacaaattagtcattatatagaagcccacaaggcagctgaaaatgctgacccaatcgcactttctatttagccctcttcgctcccatcatctctgtagcagaaggctgttggaagccttagccaaagcaaaagaaccccgggagatctgtttgatttgagatttgtttaagcagtcagcacctacctgctatgaaagagggaaaggtttaggccgggcgctgtggctcacgcctgtaatcccagcactttgggagactgaggcgggcagatcacctgaggttgggagttcaagacctgcctgaccaacatggagaaaccctgtctctactaaaaatacaaaattagccgggtgtggtggcgcgtgcctgtaatcccagctactagggaggctgaggtaggagaatcgcttgaacctgggaggcggaggttgcagtgagccgagatcgcgccactgctctccagcctgggcaacaagagcaagactccgtctcaaaaaaaaaaaaaaggaaaggaaaaggtttggggggttgcaaggaaggtatgaaaagggagctgggaatctaaattccacttttctttccttctgaatggttccatctgcatttccatactgttcgtttgatattttatgactatttgaaataattataaag

SEQ ID NO: 116623 - DNA, 1028 bp, Homo sapiens
aatcaagtaaaggtgttttaactaattatactataatttaggattttacaccttcctgaagtggggaggttttaaccatggttttgtgcctagtgctgcttttccaatgctttctgaaggaagttatgcaattttggaaaatcaaaacaatgttcatgtttttggcgtaaccttagagtaatctttttcaaaacctatgaacaaatagcaacatttataaaatattttatttactattcccttgtaatctcaacctgtgatcactggactagactcatgttcactcacagtggctcatgctttaaagttgtaagttaactaattgcatgcagtttttcttccagtggcttagtttgagaaagacacaggaacacaatgaaaccctgtatctgaaggcttcttaaaataggagtacagtgtataaaatagaacaaacaattcccaaagaacaatgtgattttctcatgtagctcaggaagttatgaagagtttacaaatgtttggtcttatcttctttcccataggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaa

SEQ ID NO: 116624 - DNA, 1036 bp, Homo sapiens
ggcagtcagtgctaattcagccattagtaagtaaagtcacttttccactaaaatagtgtcccgactaaccacctccttccgtgtcttttccaaccacaaaaccacacacatagaccatctcatcttactttatttcttgcatttattgtatccaaaaaaattggtttagttttttaatgtaattgacaagactcaagcttttgaaatacttacgactgttctcttgattccaggacaccctcccctgtgtctaaacatgtgtggtatactttttaaataaattaaagcttattttacttggcattttgtggagggaattttacaacacctcgggagatatctgcagacaccctggggtgtcacaaatttaagactagaagtcattgccctaatcaaagacgactgttacactggtctagacatcttaggggaactccaaaatgtttatacttcaactctcagtaaaagctcaagcttgtcttttgccttaccaaattccatatctcaaaataaacttttctccctctggtttttgtatgtactcaaatcatttttttataaatatctcagaatatgtatttgctataaattatatataaagttatagaattatgaagttataagagaaacgatggccccaaatccatcattactgcagagtcatatggcacatgaaagctgggaatagtctttgggtaactgaaagaaggcagtccattgagaatggaaaaagtcatcaattgtgcaaataattgaggacttggcagagtgaccttcgaacaaaactatagagattaatcagagcttgtaaatggggaaatactcattctcttcacaagaagcagtattcaaattttattcttcatgccttccatccggtcatgtcacttctgttattcagtctttcagaattctattgttactgattatggtgaaaatatgtgggggataaccttatgaatattgctatatatatggaacagtttacactgaagtatttaagatcattttatttcagttgaattctgttgtaatt

SEQ ID NO: 116625 - DNA, 2250 bp, Homo sapiens
cttcagtttagtttactgaccagtctagagtccagagatgagagctcctaaagtctggctctcatgttttgaggattccagaaaagtcctacactcacagtgccaaatggcctgattaaacacagataaatgtttcttccaaaatatattacgcacaagtagtcaaggtgcacagccatttgagaagtctgctgttttaaaacctgtttgtggcattttgcaaggctgctgtgctttggatagatatctctgtacctcttggcgaggcagtacctgtgtatttccctctttgttggctacctaattttcatttaatatgttttttttttttctcccggtggaaaggagaggcaggtgcctcttaaaattatttcacagcaaaccttcgtaagttcttattgcctatttcatgtagaaaggttgatttgtagctgctgtctttctcttcctaataaaccttgtgggtggtgaagatctaggagagtgaaacattaaaaatgaatgaagagaactgaagtagtttgtctaaggtgggggttgagaggggctgggtggaggaggtttaacaaaaggcattgatgttttaaatgcacagaaatgccatctatcaataataaatggtgtggcatagaacagatgtgccaaattgagttatgacagcatatatattagttcatagaggggaaaagtaagtagcatagctaacgtttttaaattatctgtgagcttttgaaatacaattttatgtattcagtttttactttctagtggctgctagctggaaatattaaaagtttggtgttttttaaaattccaattaaattgtgcttgtttctaaagtaagaattaagaatgaataaattttgcttttctgaagaggaagacagtctgaaatgaatttcttgcccttcattggctgagtacttgccttttaaaagctcatgttgtaattgttatgaggaatgaaagtgcattataaaacttaagtcatgtgaaactattacccagtgttttctaaatttacattgattatatctctaggtacctgctcagtgcatatttaaactacaagggactactcaggaaacccactcatgctttacaatcaattcacccccctcagcattttgattcaagggataattctacacatatgctctgtgtgagaattaccttgcttggttgggaaacaacaagagaaatatccacttgtctcacagcaaatcactactagtaaattggaaagacaaatcttttaggttaactaggatattttgtaggtgtagatactagagcagaaaacaagttttgagcttctagataggtaggagttattgttaatgtcactggcatagcagaggacaatactgtgggaggtgtttgaaatgaatcctgagttcctgagttggaattggtgtgcttaatgaaaaaaacagccgtggtgagacatatggaaccattccactcatctcaatatggacccttgcttgctttttggaaacttgtttggaatcggttatctttgctttgttggcccaacacaagtaaatcctctttgtttttcctaaggtgaacaaaaaagtagttcttgcagataatatcaagttggtttaaattttaggtttgttagactagaaagacgaattatttagccgtcattgaagagtttaatctttgagtagatgttacaggtgaaaatgagcatagtgattatataaaaagtctattactaactcttattttagccatctgtattgttgactttcaactttttcaggtgcaaaattttcttgaatcaatcttttcatctccaagggatcccagcatgccttaaaaaaaaacacttgtcaacggattttagagccaccaaataaatctattttatggtcccgttagatatctagctcaaaacccccattcactctgaaaggtcctatggttggatgcacaacaaatttcctgaaatcatctctgatgcacctcctttgggttgttaagaaggtgttgaaatgtgagaaggctggtagtgaaatcaagttgtggctcagggtaattaggaagggagaaaacccagcattttcatagtacattgtctggcttttagttgcagctgcacacagcggatatgaatttaaccggttgctacagtgcagctggttcagatctggctttataactggctgaagtaaaatgaaatggctggaaaattccagtcaagtaacaccagtgggaacaagtggaattaaatag

SEQ ID NO: 116626 - DNA, 2286 bp, Homo sapiens
ggaaattttgcattccatatttttaaaaagtcgggaaaaattaatatatgtgaacacatctcattgaggtaaaacttaacctcagcaatctggaatattattggaaccaggaaggttttttgtttattgttttttgaagcctttgaacagtaagcaacctcagtgtaataacatcagaatactttttattcctttattgataaagaagtattttcggtagttaatgatcactactaaaagtaaacttgaaaactgagatttatagtatttatgcttttatagtaagtagaagaaacaaattagaagacatctttgtattttagtgttcattacaataatttctttgagaacctctgtcagcactatgaacacatcagttgtagaatggctgttatttgaaggggtcaaataattaaaaggaaaaggcagatttatagtatatatttcacaggcttatgcaatatagttacagttgtgtgtgtgtcagtttggaaaaggcactcattttagagaataattctcattaaactgccacatttattttttatcaagctgtcacatgtttgtatggagtaaatttcgtaatgattcatgtgtcgagtcttactatataactagtcaaacttgaggaagcttttaataggcatcagcaaccagtgaaaaatttttcagcatagactgcattctagcatttttaaactttttcctgcttagaggttggtaaaaggctctggtctcaggagtatttcagatagttgtaataatcttaatttcagcttccagacaattaagatgcagtcatataaatgatgtgtaaaataaaaagcagctaattatctaaaatagccatgtgaaattagatgctattttaggggttttgtatggttcgctttagttttatgaatcaaatagtttttccaaagagatatatccagtgatttttgagttaattaagtaagttttataatgcaacactgaatttctatacaattaaaaacatgttttaaggtatttttatgttttttagttatcttttatttggaaacattttaatttgcatgatttgtctaaaattctcaatttttctttattagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattccct

SEQ ID NO: 116627 - DNA, 1001 bp, Homo sapiens
tcacaaaggtttggaagaatacagtttatatatctagctatattgattttaatagttttgctaaaatcattttaccctgtatttagtggatagtagggtattaagttatactctgaaatattttactatcttttaatagtctatatttaagactccttagaatagtgtgctacaatataaaaaataaccatttttgtagaagctaagtaaaatccaaaacttttacttactcaaagactgattttaaatgataacagaaaggcttgctctcctgaagaaaatctaaaggggaaagaaccctgatgtataagatttgtgaagtgagatttaattgcttattttgctatcaaacagtgttataatattatactcatgtaaatatcattgaaggaggtagaccttgttgaatttaggtttttaatacatgtgtttatattcttgttttctcattttaaagtgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaagtaagtgatacacttttcaggaagtgttaaatttatattatataactgtctttttttttttttgttttctttcctgattctgaagtttaggtaacaagataatttttaaagaggtaacctacagatgattgttttaatttttctccctttaatgttaaatttttttatttatgagtggttacttatgtatcatggtatgtaacaagtggcatctctgcctttaaagaaatagtgaaagctgtttcattaaaattcagattgcattttatttgaaaaagtctttgcaatttaccaaattattatcagtaatatcttttgaagttggtgttcccacaaagtttattgttgcttgaatttagcaattt

SEQ ID NO: 116628 - DNA, 1423 bp, Homo sapiens
ataattataatttatgtatttatttataatttactcaatgtatgtattcataatttatttactgaatataattatatacttatgtaattacataatataacagtatgtatgtgcttaatagtactgactcttgaggcagaatgctatttggtaagtaagtatgaagattaaatgaattggtacatgtaaagtttacagatcagtgctgtcttcagaaaagctcagaaatcgataagtgattgttgtagatgttgttcctaaattcagacatgtgaagcagataagagtgagactaaaaagtccaattgcagagcaaaaccaggaagaaataataatgttagagaaaaaagggctgagtgatacgagaccgataatgtagtttggctttaactaggactaggaaatgtttccttacaagccacaactgaaggaaacacttatagtctgatatatagatgtgtcatgtttatatatagttacaatatacacaaatttatatataaatatatattcctatatttcctttttagagatttctagcatctgaatcttttatactagttggagcagttaacatacttcagtcacttgttagacttgggtgtcagctttatcactagtattaatcaaatgctatacttcaaagagggaaaatttcaccttctaaaattatatttgttttcaacccattatgtccttctagatccccagcttatcctcttgtcctactttctcttcttttgcaccgtgactagacagtgttgatttaatgaacccactaatgtatttcctactgattccacaacatgccctaatatagttcaactattgttcatgctctttaaatatattggttttttaccatcctcttgttctccctactttgagctgttgacattcttccagtcactgggagtattggagacattcaaagctgctgcagctcctatcttccattttatttatttgagccatattttttatctctggacttttatttttatctcctctgcaggttcacaggctggaatttcttctctctttttcaagggtaaccgtttttgtttttgttttttgtttttgtttttgttttttacctactctgtattgggtgggagtcaggggaggtggtattctttagcttttttgaagtgaaaacattaaacttttcactggagctacttccccttctctatgtggtctactaatgaattaggtgaaattgtatctcttgccacctttttttccccccacatttcttttttaatcttcggactttttcatgtaactgctggaatggaaaaattcctgctgtgcacaatgcatgaatttcctctccattaatcttaaatgatattgtgtgtatcatggaaatgaagactggaatagttcttaaacgtggactctgtagccagactttctg

SEQ ID NO: 116629 - DNA, 1102 bp, Homo sapiens
gaaagatataaaggaaaaagattttaaagaaaaaagagaaaacaaagtaaaagaagctatacagaaagaaaaagacataaaggaagaaaaggtatgcaaatcataataaaaaatgtagaaagtaaaaacaatcagcatatttacattttaggagactaaattgcatatcagcccttattagtctcaataactgagttcttcagaagcatgtttgggtatgcagtagaggagaatagtaggtctgaacactctttaatgctttaccttcagagtaacattacagagtagctttgattgtttccccaaataaaattggggaaaaaaacaaattaaaatagatgaggatattcaatgagaatgagcacttgtagaataaaatgagacagtaattattttctggaagtgttagtcattttgcctttgttgctattggggttttgtttttgttttcttttcactttttctttagttgagtgaatccaagtctgatggtagggaaagatccaagaaatcttcagtgtcagatgctccagttcatatcacggcaagtggtgaaccagttcccatttctgaagaatctgaagagctggatcagaagacattcagcattgtaagccttagactttctgattattagtattaactcataaaacatttaagttgaagtttgtcatttatagcatttaatttagaactgcatttgaatttattgtagattgataaaagcaatgtatttgaaatttgaagggtgtcttttttttttttttttttttcttttttgagttagcatctcactgtcgcccaggctggagttcagtggtgcagtcacggcccattgcggcttcaacctcctgggctcaagtgcccctcctgcctcagcctctcgagtagctgggactagaggcatgtgccatatacccagctaatttttagttttttgtaaagatggggattttttatgtcacccaggctggtctcgaactccttggcgtaaaagggagataagcctgggcatggtggctcacacctgtaaacccagcactttggaaggccgaggcagtggatcacctgaggttaggagtttgagatcaacctggccaac

SEQ ID NO: 116630 - DNA, 1052 bp, Homo sapiens
ctgtgaagaaaaaattaagtagtctagattcccctgtaaaactttcctcccagtgtatgctttaggtcttcttctagaaggatgacatcttgtagtctaggaatttctgtgtacattatatataagtacacttttactgagaagggaaggtgtttaaggattatataacatttaatagtggatgttaagtacacttttgtatatttgaaggaaatttacaaccttatgctttctattttcattttgaaagataatctgagggtttttgaagtttagaattcattctcagaaaaattaaatttttggctctggcatacgtataaaaaatacattttgcattgagtttattcctacaaatattaataattgaaacttgttggtgaactatatatatatttaaatggttaagcattttttagccagtacatttctcatgttatttattaagacaatctgaaaaaatttattgctttttcagattcttccagatgatcccgataaaaaaccacaagcaaaacagttgcagacccgtgcagactacctcatcaaattacttagtagagatcttgcaaaaaaagaagctctttctggtgcggtaagttaaagcccacatgcctaagaccagtttactttttagtaaggtaaattttgtttacttcaccatgctaaacatctgaagtcaatatgagcttatataaatggatttttctgtaattaagtagttttatttgatgttgccatatttaaattttaccttaaattatctcagcatacatgttaaaactgatgaatcatagctttcagaagtaggattctgttttttttttctagttttagagagggatagagaaaactcgtttagcgtgcggagtactttttgagaagtcaagccttacatagcctacatgactgttttacttggagtcattagaatgcttaagggacagcgtcataggttgccaagcttactgaaaaagaaggaaaaagacaccaaaaaggaggtgattggaaacttagagcaactgttagaagtttacctgtgaccataatgt

SEQ ID NO: 116631 - DNA, 1006 bp, Homo sapiens
agttgcttggtgttttgtagaattatgttttatacttttaaaaatactggtttttttaaaaaaaatcaaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtgagtgatttattttctccattgtaagatttttgttattcaataattgcaaaatgaatgtgctgaatttttatggtgttattggctagttttgaaaaaaaaaaggaagaaataaagcatattattttgaagttctaatgactcacgtttttcaaaattaatttttcagttaaggcaattacaaacttatcattagttattaactttgatgccaggtatactatcccatgccacacaaaggcagctcattttgatatagactggggcaaagaagatgattccaatttgttaattggcatctatgaatatggatatggaagctgggaaatgattaaaatggatcctgacctcagtctaacacacaaggtatttatctatttctgattctgttaaccattcatgttgaatttaatttattctaattcttgcttttaaattatgttggaaataatggaaatctggaaaccaaggcactagctggttgtgtgaccttggtgcgtttagaagatgctttgcatgaaaggatcaaatttaaatgatttctgagattttgcgttactgtgaaattatatgttattaaggcattaggtgtattatttttcaaattacgaggttaaaagtcttattccatcattagctttaaaaaaatttttgatgcataatagatgtacatatttttggatgcatgtgataatttgatacaatcatataatatataaagatgcaatcagggtaactggaacatttatcaccttaaatatttatctttaggaacatttaagtgattcttttctagc

SEQ ID NO: 116632 - DNA, 1042 bp, Homo sapiens
tcaagttatcttcctgccttggcctcccagtcatgctgggattacaggcatgagctgctgcactcagccacatttttcttttatgatgtaaattactttattgatcaatgtttcttcacagttctgatctcctcaggaaaaatgcctagaggttatgttgctgcgtcagtagaataacttttggaggcttttgatataatgtctgattaccttttaaatcaaaatatccaccagaggtatatatttttctctgtttgctctttaattttgtttatggaatgtttttgatacatttaataacatttttaagattccgaccatcttttataatggtttttgctcttaagatacaagctgtttttacactaaggttgggtaaatattttccaattccagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtaaggtgttataagacaatcgcttcaacttggttttagtagagtgtgaaactaaaatgtaaaaacgccgtaattttcaaaaattgtgatgaagttttagaagaggcaaatctgttatttgagtaggaattgggtggttctgcttttgggtatttgttataactgaacaaaacaagtttggtgtctaatctttgcatgttatttatttatcgctaaactgcttagactacacaattttttttattaatttgactcaatagtgatcctttcgaataataaaagtagttttgatgcatttgatttttaaaaattctcacggtgtttatgactcccaaagttactaattttttgtggaaattctgtatttttctagtttcttaacaacagggtaatttcctttttgaaagtaaccctgttaaaagcatttctgatatgttcaagtaggaattgagatgaggtaagattggccaggcaggatatattta

SEQ ID NO: 116633 - DNA, 1123 bp, Homo sapiens
atagtaccttaaatgtgctatcttatgtaatcctcacagaaattagtgtgctctcaaagagctctatgtctctgccagtagctctttagatagtgtttttgtgaccataaaaatgatattagattgttctacaatacttgataggtggactggtctgagaatttctgcagattatttagcatgttaatagtataaattacttttttgttgttctgttaactgctcttagttctgtgatgctactaattttgttgagcagtagggcaaaataaaatcattcctagaggattattagatgtcatttggtttgatctgctttgccctaatgaagaaatgaatctaggttgtttagaagttatatttggtttagtccacagccatgttcattatcctaaggagcatgccagttcttccccttaaaaaaaacttttagggatcaatttttctgtaacagttactcttaaaattctgaaatttatcaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacaggtgattttgcaattttaaagatatttctataaagtaagagtattcaacctgggctgattttgtttgtttctacgaggtatcagtccatagttttcttttcttgtaatggccttgatttgataatgtttgcctcatgaaatgagttgagaagtgtttcttcctcttttattcatcttttcaaagaacctgctcctggtttcattgatttttgtgtgtgtgtgtgtttttaatttcatgagtttccacaatttattatttcttcctttctgcttttgatttaatttgctgttttctttcttttcttttcttttttctttggtgacagcatcttgctctattgccaaggctggagtgcagtggcacaattctggctcactgcaaccttaacctcccggcctcagatgatcctcccacttcagcctcccaaatagctgggactacaggtgtgtcccaccacacccagc

SEQ ID NO: 116634 - DNA, 3045 bp, Homo sapiens
ttcatgtaatgacttttttgctctgggcagatactcagtagtgggattcctgggatcaagtggtagttctacttttagttcctttaaggaatttccacgctgttttccatagagttctttttttggtatatgccttttattttttaaggaaataaaatttacagttagagttgaagtgtcattcctttcctatcccgttttctttctttttcaccagaagtaaacactgtattgaatttggtgttaataacatatatatttgattttggagtctttttgttgattggtcttgctagatgtttattagttttaaaaactgcctttctgtttaattagtaccatactgcttacgttcagaaaatcaattgaaaaatttttcattttgattattcaatttcttacaggatttttgctttttgctgtccacaagagctggaggtctagggattaatttagcctctgctgacactgttgttatatttgattccgattggaatccacagaatgatcttcaggcacaggctagagcccatcgaattgggcaaaagaaacaggtatttttaattttaatttatattatattgctgttttagaattctttttttttttttggaagtgatttcagtttatcctctagaggataagatcactgtaacagtcatactactgtttaaccgataggatactgaggagcttggtttaccaaaatcacctggagagtctgacagaattgagataactatgcatatataggatcatgtattctgttttgatcccgtattctagtcgtaactataaaatgcagtgtttttcattttataataaaaactttaaaacgtctttacttgcttattttaacttgaaagggagtttgagtagcatatgctacctttctgttagtctatattttgtccatgtgcttacaagattctccacatgtaaacgtgaccccattttataattgtaacaacatacccttaaatggtggtactgaacctttacctagagaaatagggaaaatttactgcagaatctttgacctagagaaatagggaaaatttactacaccaattcttttcaattttggagagtttgttttatggtgggtttcttattaacttggggagtagttcatagaattttgcattatatagagtgatgaaacattagaatcaaggcaacgagtataagaaggctatcagaagtttacatgccccccccccattttccccagctaaatcataacataaaaattactgtcattcctttaaaaaaaaataagcaaatgcaatctccttatcaaaatattaagaaggaaggaaggatatagtttcaaaatagtcccttaagttgaggaactctagctttaaacatgttttttaaattttcattttgcttttaaccagtgaaaacttcatatagaatgagcttcaatttgtgtgccagtgtttaggcacttgaggttagcaaaacaaatcctttatactgcaatttgtttcctcatgtgtatttttacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaaggtggttacttgattattaaaaaaatgtcattttagagtcagtaaactcatatttttgatatgttacatcactgtagatcattgaggaaatgtattcagagttgtactttttatattttggaagactttggactaatttctagttagaagacatacttcaaatacctggtttcatcgctacagatttgtaattttaggggtaatctctttcacttctatgcttcaagttccttattttaaaataaatatactgcactaggcaacatagtgaaaccccacctctgcaaaaaataaaaaacttagctgggcatggtgacacacaactgtagtcccagctactcaggaggctgaggtgggaggatcagttgagcccgggaggcggaggttgcagtgagctaagattgtgccagtgcacttcagcctgggtgacagaaggagacactgtctccaaaaaaaaaaaaaaggattctaatacttgatttgtctaacttcttcatgtaactgttgtaaaggtgaaaatgtcagtaattaataaaagtgctgtgtaactgttatatttttaactgttaatgttaagcatttttgtttttcctgttttagttctactcctttcaataaagaagagttatcagccattttaaagtttggtgctgaagaactttttaaggaacctgaaggagaagaacaagagccccaggtaaaaaaaaaaaaaaaaaaaaaaaaggcctgcctcagaatatgtgtcatatatttgacaggatgaaaggattcaagtatatttaaatattgtctttttaattataggaaatggatatagatgaaatcttgaagagagctgaaactcatgaaaatgaaccaggtcctttaactgtaggagatgaattgctttcccagttcaaggtagatttaaacaaaattttccttgtaattacataaattgagaggaattgagttatgtcatttagtggtttgttaatctttctttaagcataatcaggaagattgctgtgttatgtaaaaactactctctcttgttcagacaaaccagtagcaaactgatttgaaagagaccaaacccatttatgaagttacatttagttgggtggaaagagctgttgtttcctaattagcaactagaatagtgtttggcaaatagcatgtccttaaatacttaggtaaataaatgaatcagtgtgatctcttacttagatttccatgactgaaagctttcagctgatatttttttgaagcagtttttgacattaacttatcacaaataagaaaactcaagtaaatcagtcaaagtaagcaataagctactatatattgatacttaatatccctggtttgttgagggtcaatgagttgaaaggagtcct

SEQ ID NO: 116635 - DNA, 1011 bp, Homo sapiens
gtagcctttagctattcctcttgtccttccatttgccttcctcttctgccctgtgttgatttgtttttaaacaaattattgtgtacatagtcaaacaaaaaattagtttgactaattttgagtgttaataagcgccacttctctgttgctaattccttctcattcctaggtcacttcctggagagaataatttttaattttatttggtttaggtcatgccacagtaatgagatgccactattcttaaaatttgtactaatatgtattttagtggaaaagaaaaattattttaattttttaaaactttaatagacatgttttcctactttgagtaggtgataattaagagcacttcatttaaaccacttagaatacatcatttaaaatgtttatattttttcttcgcagagttaaaattcatatagtaacaaagcaaaggtaggcatatggcttcccaaaatactagtttaattcgtcggttaaatgcatggatcatagtagacaagttatttctagtctataaccagttaataattataaaatcattgccatttctaaagtgaaatagcagctaatgtttaataagcgttcagtatgttgtaggcactgtgctacatgttttcctgtgttctctcactgagttctctatagtctatgaaggagggactactattatgtctgttttgtttaaagcggaactgacatggtgaaaaagtttgtggagaaaagtcaaatcacttgctcaagataccaagtgaataaaatactcatttgctggctgttgactagaacccatgatgcttcacatcaataattttcaaactttagtgtgcatcagaattaactggatggcctttgctaaacaccttcagtaggtctggggtaggactcaataatttgcttatctatgttctcaggtgacactaatgctgttctagtaaccacgctggacttaatcagtgtttttaaaactgaattgtaacctgttaatggatctgtgaatcagtttaa

SEQ ID NO: 116636 - DNA, 1096 bp, Homo sapiens
agtgagcacaggaattgttacatgtagtttggagtagtaaaatatcaccaagatgttttctataagttacatatgtattgtgtaattgcaatctagagaaggcagtcgtggctaaaaccaggtatcctcaggtttcttttaggtccatgcaaaataattcagtttcattagctgtctaatgcagtaaaagttgtaagaagattcagataaataatgcagctgaccatctttttagcaaatttgaggggaaaggattaatacactgtaataattatgttacattagcctgttctgtgtatagctaatggttcagaaaacaagttgtgttctcatgagtattatgaaagaggtttggtccgttgtatatacagctgtgaattttataacggtacagttttactttggtactatcgttggctttttttgtttgttttaatgcttttagaatttatcctggtaattgttctgctaaacatcgttttcataatttttttttttaagatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaagtaagaatttttaaatgttgtttctttgtgataaagttctagaaatgttgatttcacttacaatcgaaaatggctcaatgctttaacttattggataaaagttctctttagttaatggtgcctttctataatggtctcagttattaatctttgtagaaaagactttaaaattctaatttatgtaattattttgatgaattttctaaaaataggtctctcaaaccatggcctataataacttatccagcaagaaaatcccacagtatgttcataattatgaaaaaatcgttaatagtaattgtgctgcatttgtgatttggtaaatggtaatctaaaggacatcttgacctcacatcttaacccttcctggtacttctggaagataagtcagaagtgcgaaggcacagctgcaatccagccactgtagtgcat

SEQ ID NO: 116637 - DNA, 1061 bp, Homo sapiens
ttttccataaatatttttctgtgtatttctaataattgatttttaaaaatactagtatcacctgggcccagtggctcatgcctgtaatcccagtactttgggaggctgaggcagacagatcacttgagcctcaagagtttgagaccagcctaggcaacatggcaaaaccctgtctctactcaagatacaaaaaacttagccaggagtggtggtgggtgcatgtggtcccagctgcttggtaggctgaggtgggaggatcgcttgagcccatgaggcagaggttgcagtgaaccgaggtcatgccactgcactccagcctgggtgacagagtgagaccccatcttaagtaaataaataacccactttaaaattttcacaatttaggaaattattgctctctcagcagaatcaatttcttgataccaatattcagtatcagtgttcaagttttctctgttgtctcaaaaaatttttttacgtttactcgaattgggattgagataggttcatatatggcaattgatttgtctctgagtttattatctataggtacttcttttttgttaaaatgtatacgatggggaaaacagttattctgtagaatttttccacaatctagattttgcatagtacttccctctaaaatagtttaacagtatcctctgtatttcctacagattggtaggtagatgtaggtgcttgataatattcaaattaataattatgagaagagtatattttgtagtacacaatggcgattatctaattttgttatggggttctttaaaaaaagtaatgcattttgtagaatatttagaaagaaaagtcaaagtaggaagaagacacattcacctgtaattctcttagtgctagtcatatatcatggatgttgaacttaaactcttcaaggtactttttggcaactaaggtaataagatactgccataaatttctggaaaaattcttagaatttttacctctagagaaattaataataaattttttctggataaggaaaaatattctttattcttgattacctcttagggcattgagcattg

SEQ ID NO: 116638 - DNA, 2076 bp, Homo sapiens
ttctacagttcataaaagttgtacaaagaattgtacctacacttggaataagacactgttctgaatttgtgtcatagtttttttttcatattgacattaatagaggcttctattggggttaggctaaaaatcttttgtaaaaattttaaatgacactgctgatttttctccgttaattatcagtttataagctaataaaaactttggcttgatattacattctagtggttaaatttgtcatagaaggaatatgtgctgagttacttatgtattgtaatcttgagattacgattttttatttgaaaattagacaaagtttgtttttaatttttatttcattttaataattgagttcagattaaatgggaaggctaaatttgaattccgtttttctctcaaaatactgtttttctattattttaaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagtaagacaactttacaattttaatcatattgtgtggatattatgtttagtgggaataaacccaggtaataaggtcagtaagagtttttattgccctaaaagattagatcacagattactaagaattttttaaaaaggaaaatgaggtcaggtagtttgtaatactatttgaatttttcaattttgttaataaacttaagccatgtgtaataaatcacgacagttgattttgcacattttcaaaatataccttgtttgaaaaactaacacagtaccattctttgtatttaacagtaggagtaacaacaatgaggtgctggtaatccctttttctaaatgaggaaaactagactagacaaggctaaataagttcccaaaggtcactacttgttctctttcagtaggtccagaactttaaaagtatatttttttgagaaatattttagtgataattactcccatacttcaaaatacttcatattcacttgattcaagaatcataacttataaaacaactaattatatttcatcatgcatcttcttgggagggagatttttagaggtaactaagtttagctaatttttttttctaaaaatctgtagtattttgtttataaatgactcccctaaaaaaaaaagttcatacacaacatacacaatttgattttttctagtaattgttccaatttcttaaattttaaaggttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaagtaagctgtacacagaacacagttctgaacttctaattctgaaaaccttccatgtctgtgtcctgcttttggtgcccccaccttctctacaatagtgtcttagagcagttgcaattctcgagtttcagaataagtttattctgtgtcgttaggaggcaaaaggagatttaatgacatatccaaaattatgagtgacaacactgagtaattcatcttctgacacataattaattgctttcctatatatcatactgttatcttataaagagtttaagtgttaggatttccacaataataaaggtattatatgattatgacaattaacagaggccaaaaaaagaaacttagaaaaaaattttaggctctgctgctttttgaagagtattaacaaatcatagctggtataaattttgtatgtcaagatctatacagtaggacttttcaaagaatcagaaaggaaaatctgttctaatatctgtttaaacatttaattgcataaaaggaaatatattgctacatgcatttggagtttcagaaacatttatattctatggtaaatctataggtgcc

SEQ ID NO: 116639 - DNA, 3340 bp, Homo sapiens
tcgtgatccgcccgcctcggcctcccaaattgctgggattacaggcgtgagccaccgtgctgggcctccagctgaccacgtttcatatattgtggataattatagaataatgctgtgggatctcaggtggatctctgtctttttattttttctaattcgaaaaaggaggggattatattagataattctgaaattctcagttttatttatgagcaatagaatttcccataagtttctatacccccaatactttatttaaaagagtatatatttttgtactcatattattgaaattttgagttgaaatataatcctacaacagaattaattacatggaaggatcttgtgcttttgttttcagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggtaagtatgctgtatatcatatacttcttttaatagttcaaagattactaaacctttatgttaataaagaatacatagtaacattaaatgatagcctaaaatagctatagactttataatacagttggctgtctttgtccacagcttctctatccttggtttcaaccaaccatggattgaaagtattcggagggaaaaaaaacaacaataacacaaattaaaaacaataccatgtaacaactatttgcactgcatttacgttgtaaatgtaaaattgggtattataagaacatctagagatgatttaaagtatgggggaggatgtgtgtgggttatattttaggtaccatgtcatttcatataagggacttgagcatcctcagattctggtatctgtagaggatcctcaaccaatcccctgcaggtagtgagggatgattttattccatctcaaggtaaaactcctagaggtatacctatctaaacctatccttggtaacagtcacatagagtgtgtctcatacattataaattacaaatttttagttaaaaattaatgatgctttattcctgtttgagtttctttattactcaaacttggcccacacagtggcaaaatgggagattttgtgctacaaatagtgttggggatgggggagtgaaaggttatttatgggagatttttaagtctattcctggattaataatttttcaggttgaaaaatgcctctccagaagatgtggaatattataattgccagcaagaacttacagatgatctacataaacagtatcaaatagtggaacgtataattggttagtgataaatgattctagttaaactttctttttatgcttgaaataatctgaaaaaagtcataagtttgccacttacatatcaaacacagtagcttgctcttactaaaacagtattgtaaactagatagctaaattttacttgtgtagcctttactaagaattatgtatctgatgattaaatgtaaaaaaaaataaataaataagtaaatgcctgattctctcacagctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtgagtattgtctaacattttaaattattaaaaatatatttatacattataaatatttacaagcctaaatacaagagttggatcctgatttcagatagactaagggagaatatttcttggttaataggtcttacaggaagtgaacttctgcaattgctgtgtgttttttagttttagttttataattttttatttcaaactttctcttaaaaaaattgtaaatgatgttttcgtcaatgtatcttcttaagtgttgtcttttatcttgttgagcatcactatgtcagaaagatgagttggttatggtgattgtcaggaagggttgggagaataaacagaaaaaaacccttggaaactagagatatgctcaattttaaagatagtggatattttcttagaaggtagagaaaaaggagagtgatataggaaagtatccagaactaccttgcacaatactttctgcatccttgtaacttacccagagttactagtgatgtgttgagatctatggactactagactttctttccttattacaagaattacattcttcatagggataacttggaattcagaaattgaacggtaagctaagccagttttatggtttgtagcttaaggctggagtgatggttttgaacaatttaacgtaggttttgcttgtgaaatacatgagactcatattttggcaggaagttaattttctctatacatttttgtttaaaaaagaaggcaaaatatttcactgttcatttttgtagagtagtagaaaacagtattgactgaatcctcaggtacattttgagtaatggaatctctgagcttgatgattagagatgaaatttaagaatttatggtaaagctgaggctttcatcttttagtataatttcttatatttaataactctacataataatgtttatttctactaaaggtattaaaacaaaggccaaggtttgtagccctgaagaagcagccatcctatattggaggacatgagggcttagaattaagagattatcaactgaatggtttaaattggcttgctcattcttggtgcaagtaagtatattttgaatcatctatttaatttgacagagtaagaatttaccaatacaggattcagaaaagatttccatttacataaagaataagactctttggcagtttatatgctagtctttgtatttcctagtttgtataaacaatacttactacatactaggaagaaaatccagtggagttggagtttaacttgattgttgcctttttaaaatatgtttttattcagtttaaaaatcaaaatgcatatctgttctcatcccatgctattcctggaatatttctctttttcctagttattttaatatccatttactcttctacattttttttctatcttctatggcccccactctacttttgtgaatctcggttgcaatttagctatagtttttttttttaatctgtgttcttcctatatactttttacttatttaatatatctggactctactactagtagatg

SEQ ID NO: 116640 - DNA, 1069 bp, Homo sapiens
agggataaaacttgccatataagtacaaataaaaatactttataaattttgtctgcagtgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaataggtatggtctcagtttggtgctgaaaattgattgtggaaagtatttgttctttttgtatatagtttctcaaatcttgtttttttttctctttgcactttcctagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggaggtagtttttaaaaaaccatttattgtttggttatttaaataatatttacaggagtagagggctgggcacagtgggtcgcccctgtaatcccagtactttggggggccgaggccgatggatcaggagttctagacctgaggtcaggagttctagaccagcctggccaacgtggcaaaaccccatctctactaaaaatagaaaagattagctaggtgaggtggtgcgcacctgtagtcccagctacttgggaagccgaggcaagggaattgcttgaacccacgaggctgaggttgcagtgagctgagattgcacgactgcactccagcctgggtgacagagcgaaactccatctcaaaaaaaaaaaaaaaaggtaaagtatttaagatttttctacagtgttgaaagctaagagggtggattttttgttgttgttgttttacttatgttttataaaagctactttgcttagcctgagtaccttcttaa

SEQ ID NO: 116641 - DNA, 1050 bp, Homo sapiens
ttatttcatagcccaatctaatttaatctcttaactcctgttaccctctcccacctcacttgattttttggaaacataatttctctatgtgttagacttctgcctgaaaaaagtcattaaggtttgccttgttgttgtaactataaattagagaattagagattttcattcatgtcattgatactataataaattttagatgtatgttaggaaactatttttcagtgacttttcagtgtatatatccatagcccttatttctcatctgctcattctctgcttactagaaaatatttacttttgagtttatcctgggttcaacacaactaagtaatcatctttgaaattagtcatgttaaaagttactcttcctagtatctctccacttttaacagttttaaatttcttcagttagaaactttaaggagatagaatcatattgtactttaagcagagtttataatacagttttgtcttggattgatagtttagaatgctgaaaggaactgttgttttgctggtcagtgcttaacaaagcagtggaactacctggttttcagagttgtacaaatgagaagatgttttccaggttttctgaaaccttttatagtttttatttgtactatttcatcaaactttgtatttatgtgtgtgtatacttcatcatgatgtaaaatgtattatataggtcatggtccaaaaagtttgaaagccgttgcttgactttggccactaattgtttttttgttgttgttgttaatgtttagcattcagtcattacctactactttccagattctttctacagtcatgctaaagtggacagtggtctataaaataactaaaataaaggtcctgacttaatgatcttcaagacctagttaggagagatatatgtataaaaataattgtaatactgtgaaggaattattagtaacatgagcaaagtattgtgggaacatgagctagggcaatgatctgtgcctggggaaaccagggaatggctacctaaaggacatagttttgaatagtcttattttttaatagtct

SEQ ID NO: 116642 - DNA, 1001 bp, Homo sapiens
ttctgatgttggtcaagttcatttttctctcacccctttgagtgtaattatgtgataaatttataataaaattagattcatttgtcacaatctgcattccatcctgtgatcatcatcatactggttgatttttaaaatttgcatatattaatgcttattcaatgatgcacagttctttgggttttgacaagtgcatagaatcattttttctgtactccagtaatgtacagaacaattccttcatcttaaaaggtcccagatctactgagccagaatttccattttaataagattcccaggagaattgtattcatgttaaattcatatgcatgtatatgaagctattcacctgtagtcattcagcatcttgccatgttgtaaagttatacattaacttcaagaaagattattataatctaggggtgataatggaatagccagtttaaatatgcaattgagtatattcaaatttgtggggccaaatgggcatgcaagtgaggtaaaaagaaaatggagggtagattactagagtcatttaatgagctatttggaaagttttcatagcatgctttaacttttgtaattttcataatgatgagaaatgtagtttgaaaagaaagaacaaatgatatatattcagaagggtgttggagaggaagtttttttttttgtttttttttttttttgaagagtcttgctatgttgccaggctggagtgctgtggtgtgatcttggctcactgcatcctccaacaagtgattctcctgcctcagcctctcaagtagctgtgattacaggcacgcgtcaccatgcccagctaatttttgtatttttcgtacagacggggtttcaccatgttggccaggatagtctcgatctcctgacctcgtgatccgcccgccttggcctccctaagtgctgggattacaggtgtgagctcccgcgcccggctcaggaagatgtttatggaagtcatagtcccccattaaagaagtatgcaa

SEQ ID NO: 116643 - DNA, 2555 bp, Homo sapiens
ttaaaatgtacagagaaagccattttgagggacgaaaggaaggtgaaaaggaaagaacgaaaaggggagtgaactttttaaaggaagaaacgggaaaggcagtttgttaacatacttagattttttaagacttaattgttcagtaaggcactttgactagggttgagattaatatttaacattaggaataaatgttgagtagaacggttactttttagataacctgttcttgcagagtctactggacagtagtctagagaattaacatcctgatccagatgcagactttgctatcattgagttggtaacaatctgtttccctccctctcttgtggaatggaaataatcgtaggagtgaattctctttgctgaggtcggaggacagctctgctctcagttggctgtctcggtactttctggctggggaaggatctgacgtctccttcccccgcttcttcctctccctcccctgccagagatctcctttgtttattcgtggatggcttgtaggtgattcttcagtgttgtactgaaatctttaaaggtggaaatggtgtgtcttggttcattattcttgccccaaattttttacgtaaaaaatcagatatagtgtatattctattaccttttcaatttttttcacaaaataaaaaccaagtgcaaactggttaagtattatttaaatgttatcatcccactatccgtttacctgttaaataacacatttattttgagctatgcatttttgttgagagtatatggtatcttttatttgcctgttcctcccatgggagcgttttcagaactttctcactcaagtgtatgaagttcttggtgataggagtgagggcttgattaaaggtaacctcctcccacccccccccccacttcatttattcgaccaagttatctaataagactccgttatctactcttgggatgtatgcatatgttacatcgtatcaccttgctttaggagtctataaaaacattgttagttgcagttagtctctaaaaatcctttcactccacaaatattttaattttttctgtccgaagtatattagcagtagcatactaaattctagttagcagtcaggagtgtagttattacaagtctagatattttaagtatttaataaaaggcccccacttcttccttaacagctgtagtctaattggcctacgtagatttatacgttttagacagggcttaatttaccttttttctgcaggaaattttgttaatttattaatatattttctttaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaaggtaagtaagcactttgttatcaattgtttactatgaagagagttgaaaacttgacttttttctttattgttattgttgttatttagttttcctcataggtagcagagttttcaggttttcctcttagctatccaaatactaaaaaaattctgatatacgaaccttttttcataatacaggttttaattatatttttcattcagatacacagtagatcttaaatatagaaagtttttgtttacttaaatctatttggaagtttatatttgagctaataattaagctggagcatgtataatagatttaaattgttttgactgttagtgaaatttctagatgaaggcaataaaaattttttcactcatctttttctggcattttgtcttctatacctgtactgtccagtgtggtaaccactagccacatgtggctatttgaactcaattacaaaatattcagaatttacttagtcatactagatatatttcaagtgctgaataatcacatgtggctagtggctaccatattggacagcacatagaaaacattctatcactggagaaagttttagacagtgctgagccagacatttgttgaaatattactgtggcccttttttattttcagattggagttttaattatctgtgaaggagttaagagttcttgcttgggtcaagtgtttgcaaagaagattctttaaattctgtagctctcaaattttgagttatctgcacattagtttacaatccatgtagttatatgcattatcatatatagaaattaggaatgtgggcactggagtcaaactgtttgcttaccctatttctacctcttattagttgtgtgaattagggcaaattacttaatctctgaggctctgatttttgccccataaagaggggattaaactattgtttatcttatttaaagttcacggctgggcttgttggatcctgtttgtaatcccagcactttgagaggctgaggaaggaggatcacttgaactcaaaagttggagaccagtttaggcagcatagtgagactttgtctgtaatttataaaaaataaaatttaaaaaaaat

SEQ ID NO: 116644 - DNA, 1078 bp, Homo sapiens
ctatttttataacttaacatcaaaatccaaataaaagagttggattataatattcttattaactttactaaagcccgaacgacttaaaaaataattgcatccggtcttacagtaatcccaataggtaaatgttacataacttgctacaatgaaaaaaaccaaagaatataaacctataagtaacttatttaactgcttaatcaaaccagtgaaatcactagctaatgtgctgtatttgatttatgcgcttgctcattgacactcttaatagaagctctgtgttggttgatggaatcaataaaggtgagccttatatcaagtgattttgatccatgtattacctttgtgtttatcgtcttaacttggaggacactgatgaatcattttattaataatataattgatttggtagacaccaccctaggaaaatttgttttgctaaaatttctaatgattacatttcatacttatatcttctaagcacgtaaagcacattatgttatttatatttaattattggaaacctcaaaattgacatcaacactggatgtctgtgaatccaatagctcccctttcctcctcaagttcccagcctgtgggctctattatctcactgaatgactcttaatgacagattttttttaaacagcttctttctctaagtcaactaaatttcaagacagagagccatattccaattggaattagcaaaataggaatttattggctccataatctaagagtgtagatccagatactcaatttttactgtaaagatgctgcctgtcttcatctctcggtcaggtaactgtactcctgtccatatgagatagtccaggtttatgttgtttgcctggcagcctgtttagcatttgtcctgacagaagtgttctactatggatgataaagtgtatggtcattctatctgttgattccagcattgggcttatgcaatcttctcctgtggcagtgagatgggcatcaggaaatccagccttaaattgtgctagcctgtatcagcttgtcatcagggcagaaatcctaattatgtgggtcatgggcagttgttttggttaga

SEQ ID NO: 116645 - DNA, 1356 bp, Homo sapiens
tcaactaaagtcatttatgaatattatatgaggataaactttattatgaatataacctagtctttactcacagtagttaaatataaaattcctttaaatagttagaatttctgtttaatagataatttctgaaataatttagacaaaataagcatgtgttattggtgttctttttaataatttttaagactaagtacttttattatattcttccttcccctccaaatctttctgaatagttttaaatgtttttaaaattgttctagaaaggatatttatggtatttttttctttttcttgcagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaagtggtccaaattatgtgtttataaaataaacataagactatagaattaaaaattaatatatgtatttgtaatttgtcggaaaatctatcaaaatgttattctattttagcaactactatgtaacatatctgctttgattagatatttcagaaatctgtgaattttacagccatttaatatctttactgtatagtaagatgtagaaatggcaataatggcatagttcaaatacttcattgtgttatggaacaggggattgaggaattaaacacatagactttggagtcagatctatattcagagactgacttcacgatctctgaacaaattatttaacctcactgagattcaatttttcacattctagaagttagaggagaacttataggaaaagcatgggtcatgaactcagttgcttactgagaccagggacgtaatttaaatgtgcatgtaagtcaggattggctaggtcagagagagttaacatatggt

SEQ ID NO: 116646 - DNA, 1057 bp, Homo sapiens
aggaaatttatagcaaccaaagaaatagggcaagagaggcaggtgaacacacatgatacctcaattgacaatcttcctcccaccaagccagacacgttgtaaatgctgcttcctattggagcccagaaaaaaggaaaaggaaagtttaggctttctttgtcctttgtgtggaagcagggaattggattgaagactttcatagttgtaacataaaggcaaatcctgaggaactcactgatggagatgtgaaatggcagtaaggaagaaaacagaataactgaacaaatatattagtctagggccacttaatttagaggaagaaaaaaaatcaacccatccatagaaatagtttgataaacaggtcactaaatcattggcgtttataaagattcttagctatcaagggctgcattgtattttatatactcagttttataaggtgatactttttaaataagcgctttaatgaaaatggttagactgaaaataattttggtccttaaaaggagtcaggagcttttatatataaggtacatattttaaaagaatacctcctttataacagggttttacagacactaccataatttataatcattattttttacttttgggttcacctagatcatatgagttgatgtgatacttctagaacaaaattattcatagtgcgttttttgtaatttatgattgttaagtaagcttgacttataaattgacattgtaattgtgtacataattggatatatgtgttaaaatttaacatttagatttacttaattgtagaaaatacaaatgtaaaacttacacatggaaagaactgtatgcagttgactttactatgtaaattggagggaaacaaagttttagatccattttctttcaaaattttctttattgtaaagtatgcaaaatatatattcataccatttattaaatcagaatgtttatacaaaattgtcgtgtttgagcttattaaatgacacaggtttgaaacttgccttatctctgtgaacataagcatattttatggatgggaaagggaaattagtatgct

SEQ ID NO: 116647 - DNA, 1023 bp, Homo sapiens
cctaagaattgtaaattggcttatagtcttatgaaatgggtataaaagtaaaaaatatgtcatgagttttgaaacttattaaatttgttgaatttattttttttgaaatatattttcagctacggtcttaatcaaaatttaaagagatttgtggagatcatgacttgtatgtatatactcattctggtattgaatgaaaacaatttatcatacctaagtaaaaaggatacctagttaattcaatcagatgttttttattttcaacttatagtaatgtttaaactcctgtaagtttaatctatatctggactgttaatgaatgaaaacaatttatcatacctaagtaaaaggaatctctagttaattcaatcagatttttaaaattttcaatttatagttatgtttaaaactcctgtaagtttaatctatatctggacaggacatttttaagtaagtcaaaattttcagattttcagtcttaccttgtttaccttctattccttcactatagttataataaatatatgtttttttcttttactttgcatacaatttagaatgcaagtggttgaaagacttatgtttacttttgctctagaatcctttacatggtaactttaatatctgtaagaatgttagaaaaatataggggtttgagagctcaatttcttcttcctaagactaaatcaaggttatctctttttttggagttggggagaggagggaagagataaagtaatagtcaaagttatctcttgtcatagataaatatgtttaaggattgaataatttgggaagcaattgagcctaactgtagtggcctatggggtctcttgtgccttttgtagtcttctgagtgaggtccatgggagtatgatatattaatacttggaaactctatcaaactggcttcacgggactttaccagtttgacttcatcatttaaagaaaaatgaattaaggctagttaactataatttagtacgtagcaagcatcagtcttgttggacacctgaaaattca

SEQ ID NO: 116648 - DNA, 1006 bp, Homo sapiens
atacctctgacgtcttgattcttggagtccaagcctagactgctttggtaagcagcaaaggaagaaaacgcaagatagtttcctgaacaatctcctgatgcaactgtttacaggtttcatgtcagcacccaaggggagcttatggccagagactcccacagtctctgtgtgttcccagtgcttgggctcaagggaggcgcgctgcgggctgaaggctcaggtcagaaccgcaggggcttgggcggaggcggactccggtcgaaggctgtggggtgagaactctcgccccctctactcggccgccgccgggtggcacgcccacgccgcgccttccggttggtccttgaggcgacgggtgaggcacagctgagcgccaaagccacaggctggggcgctaacgcccccgctcagcgctctgcgctccagacagctgcgagctggagtaggaaggttcaggcggtggcggagagtgcgctggaggctggagggccaggaggcgggaagcttcccgcacgggggcgctgtcacctgcctgtgggaggagccagagagggacctggctctgctgctctgaagcaccggagtcgggagaacccatccagacatgaagagcgccaaaggtattgagaacttggcttttgtcccctccagcccagacatcctgcgccgcttgtctgcgtcgccctcccaaatcgaagtctctgccttgtcctctgacccccaaagagagaattctcagccacaggagcttcagaagccccaggagccccagaagtcaccagagccatctctgccttcagcccctcccaatgtctccgaagagaagctccggtcactgtcgctgtccgagtttgaggaggggtcttacggctggaggaacttccatcctcaatgtctccagcgctgcaacacacctggaggctttctgcttcactactgcctcttggccgtcacgcaaggtaaagtccagcgcccgcttgaggctcgggccagtggagagcgaggt

SEQ ID NO: 116649 - DNA, 1016 bp, Homo sapiens
ataaatactattttgtgaaacttttgtttcaattatatatgctgtgtttactgggttgagagacagatataaaatatgtatcttactttggacagaggtacattctgttacctgtttcctcacaatcgagaaaactctagactggccagccgggcgcagaggtgcaggcctgtaatcccagtactttgggaggccaaggtgggtgccttgagtccaggagtttgagaccagcctgggcaacacgacaaaaccctgtctctaccaaaaatgcaaaacttagcctggcatggtggtgcacgcctgtagttccagatacttgggaggctgaggtgggagggtcgcttacaacctgggagggtgaggttgcaatgagtactccagctgtgccatagagccagaccttgtctcaaaaaaataagaattaaaaataaaaataaattctagattggcctaaaacatggggaaagagtagaagtaggagctaacatttaaaatgtctgctatatgccccattattaaaatctttacaaaagcagctgcactgttatatatagtttacatattgaggaaaccatatcccataaagaattagtaactgtcccaaagtcacatagctaataagtgaactgccacttaaggatctgaactcggctctcttagccagaagtcttccctaaactttgcattttctgtcttttaataactacagtgtatctccatcaggttaaattattgcatagcaattttaagagatcaaaattcaaaattctgtgatattcgtgaggcttagaagattaatgctgctctgaaaacctagattttggaggtattcaaattaagcatggtatgtaatcttcctgggcttgctttctacaaaaatggactcaaagtaggtaactattttgatcaccattttatctatggaatacgaagtaatttacacaaccagaaaattttgttttgatgggatgtgattacatacaatcatggcttaagactattttgcagctgtgact

SEQ ID NO: 116650 - DNA, 2085 bp, Homo sapiens
aggggaaacatagaagataggaagaaagtagtcttagttttgaaagcacagccctcctggtattcaagctaccaactttgcaatgtttaccaagcagtttttcatctgtacaacaaccttggtgaagatgtgtctggcttcttctcctaaatactttgtcttcatgtctggtggcttggtctagcattttcaactacaggatcacaaaggaaggaaactggaggagtgacctttcaaattcttgagaggaggaaatggatgtttacactgttgttggctagaattttgaagcctttcaaaaataaagttgctctgtatgccccagattttatagagagaagtccagtgccaagttgaaaataatgttttgtaatggtttgtcaccccagtggcttggatccccctgccacctacctgcccctagaggggctgtgatatgctagaagggctgtggctgggtttaaaagaagaaatgtttatgttttcttgtcctagtaaactatagacatcagaatcataataattgttcccatttgttgaggtcattttgtagagtggagaagaaaaccagcttccttctggcattagacatttgggtcaagtcttaactctgcctcttactataatagctgcgtgaccttgggcaaattactgaaaaacgctctgagtgcctcagctttatcctttttgaaacagggatgtattggtgtcacttcatacagtgtggtggttgtaattattctttgagattaatgcacataaaatgcatagaaaatgcttggcacagggttaactgcttaataaatgttggatatcattattattgtatgttgtaaaccttacctagagtacctctaatgttttctataaccctgcagtgtaaaccttcatccctattttacagaggagaaaattgaggcttataaaggtaattgttttgttttgcatgtgagggtgtttgaaaatggcctgttttgtgctgtcttcctcatcctgattcttgccctctgtggttctctaccaacaccaagcttgtgaaatagagcaaaaggggattgcattttgtgttttctcaaacttatgtgctaggatgcttgtgcaattcaagagatatgcacatggttctcaaataagtaaactatacaggcccctttcaaaggaaaataccctcacttccagtttgacttaattatacttgtcgtagtattacttaaatatattcaaagttggagtaatgtcttagtttatagcacttatacagctataaaataaaacacatttacaaattaaatgccaacaaaactataacacaaatacaatttgagaaattacattaatttatgtgacggatgttgatgttttgctgaaagtaaacttcaattttgggttcatctatagttaggatggattttatgttcaaactgtgtctaccttttaatttcatgattttaatgtatcacagattttcaaatatctggagtttcatatgattcaacctatcaaaacaatgtattttgaaataatatgtcatataccttggtggtaataatatcaaggttttggcagttcagagcaataggacttcaggaatgccaattttaatgggtgttacttgacaaacttggaaaactattttacttccttgggagtcaagacattggctcaatatttaagtgcagatctcatgctagacccagccctgagcttaggaggcctagagtcagacttcctgggttcacagttgctacactgtttttacatacaaattcctatgaaatttacattttgttgtaataaactaaaagtactgggtccataagtatgaagatatatagttgttgctttgtattgtatttgattgctatttacagtgcagtgacaacgtagaggagttcacagtttaccatatgctgtattaggagttagcatacttttcctgtaaaggaccaggtggtaaatattttaggctttgtaggccacatgtgatctctgttgcaactactcaactcttttcttatagcacaaaagcaacaatagacaatacataaaattttatttagggacattgaaattaaattttatatg

SEQ ID NO: 116651 - DNA, 1177 bp, Homo sapiens
atgtttatattcgttctatcttccccataagatggtaacattgtcaaaggcaaacagtttgtctttactttaaaattgcccagagcattctatatagtattttagacaaggagcattcaattaatgtttacctgacaagtaaacaagaggaaaaattaaggtttcaggaaggagactgtaacattaccaaaaatcatattaaggattcagaataatcaaaactggcatttggtctccctggcatttagaatgaaataaaaactagaccccatatgatggataaaatgaatcatgggactgctcaagtagattattattattgttttccttccaaagcctggtctgtggcattttgttccagaggaaacttgagagctgtggtgattaaatcttaccaaattagaaacctctgaaatgagtcatttttattttcattcacttcatttttacatggaagattgcatagacaagcaaccaaatgaacgaagcttagttttctggtgggttggtgatgacagttttctcagtttgtagttgtcgtggttcccatggtaatattttatatgtagatgctatacaggtcaggtttacccgtttgtgtttttggagggaatactttgtgtgcatttgaatcaggcagtccttaattctcagagatctactaatagtatgaatataagatcagaatagaatagaattatctgttgtggaaaactccttggatttgccgtcagaaaacctgatgggcttctctctgtgcctctaacttgtcttctgcaaagtgaaggaattgagtgaggtactttataatacaaagattctcaaccctattggatccagtgtctcctttttcatagcatatgttttgcagtgccctctttattaccaagaaatgaaatttatgtgtaatataacctgcctaagtgtgtaattcaaaaatatgcatatatatgtgtgtgtatatatatgtgtatatatatatatgtatatatataattcctaactttaatataaaagagcaatacaggaataagtaatttataataagataatgtgtatttcattcaatatgtaaatgtttagttatgattacaccataagacctaatgaagtgttcaaaagcttgatcctatatgtagaataacagtatgtgtgacagctacaaatgcagattgat

SEQ ID NO: 116652 - DNA, 1042 bp, Homo sapiens
ggaaaaaacttggctcttgttttagaaagatacttgaaaggaaaacatctatgtttattgagaagtgagaagtacatgcaaatctttcaaacataatatttgaaagtgaaaatcacgtcataggatttagagatattcccaaagtcaatatttggttcttaagttccaggtagtggaaaagtcagaatcagttaagtacccagagcacttgctcccttcctttctccatttctctctctctctctctctctctgtgtgtgtgtgtgtgtgtgtgtgtgtgtgtgtgtaattttatttattactggtgaaactggtacaggcaacatgttggcttttttgtcaatcagtttttttttttgagaaattttgcttttgtgaaaaatctgccttttcaaagttttctttccttctattatactccccatatttttggtgtatctgagatgctaatggcctttcattttcaagtttttatttcccagttggcagtaccacttttacactttgaagatggaaacttggcaggaaaattgtatgtcagggtgtatttctgtgtggggttgcaagggcaggaaagaaaaaaaactcaaataagaggtattttcattgagtatgatcttagctggtggcatatataattacccagttatttctctcatgaaatgaatgtttatatttgttgtcatgaccaggatcagctacacagtttgtggggcccagttcaaaatgaaaatgtgggtgtattaccagatttagcaaaaaaaaaaaaaaaatagagatgcccagttaaatttgaatttcaaataaacaataaataattttgattatgtccagaatatcctgggacaaatatgattcagttttctatcaccataaattagtttaaatgaccattgcttagatctgtcttcaatttcagtgaaagcaaaggttaaaactcatctgagttgcaatagaaggtgttgcctagaatcattgattttttcaataccaacaccagtatttggaatcatccctttatttggtccccactgaagttttc

SEQ ID NO: 116653 - DNA, 1114 bp, Homo sapiens
gtggtgttacatctgatttttgatgatatgaagttaaatattatgctggaggagggtcatacttttacctgagacatattgctttgttcttattccatttggctggaattcttcctattaagtaactactattttaataacaaagttgtgagtgttgtggtggcattattaaaatacatatgtgtcatctgaaagtggagataaaatgtgttcattgtcaggggaacatgtcagatgcagtgacagaaatttggtggctcagtgctctgttggttgacactaacggtcagaggctaggtgtgaagaaactggaagagtatttatggatgacattaccaaagagagatggactttgatagagaaaagttagctaatactggcattattgggagttataccttacgtcataggtataaacagtacttttgttttttaatttgggttttaaaagcatgtggtgaaagataatgaaatagatccttggctgttaaaaattcagtatagagactgaatttgaggataattgattttttaaaaatcagaagacatgtttactggaagttggaattttaaaagcaaaacttatctagcaatttgatttctggatatgtacccaaaagaattgaatgcagagactcgaatagacatttgtatgccagtgtttattgtagcattattcgtaatagccaaaaggtggaaacaacctaagtggttgtcagcagatgaatggataaacaaaatgtggaatatgcatatgatgtaatatcattcagcattaaaaaggaatgaaattctgacacgtgctacaacatggctgatccttgaagacattacgctaggtgaaataagcgagacacaaaaggacaaatgtggtatgatttcacttacttgaagtacctagagtagtcagattcaagacagaagatagaatgctagttgctcggggctgggaggaagagagaatgtggagttactatttaataggtacagagtttcagtttgggaagataaacaagttcttggagatggatggtggtaatggttgtgcaacagtgtgactgtaattaatgggactgaactgtatacctaaaaatggttaaagtggctaattcta

SEQ ID NO: 116654 - DNA, 1119 bp, Homo sapiens
tttctgaatgcaagataggcatactgtagtaaattcccttctttcaaccctgggttgaaatcctgtcaattaattagttgtatttagtcttacaatagataaaccaggtagtttcacatagcctgtttctagggttttatctaggacatcgtaggagtttcttgaaggaaaatatagctatagggaacattttaatttggatctgcttcattactccaaatattgttgaaacaacaccagatgtcatctttactgggcaatatacaaacattgggagaagttgtacccatactaataagggtgaacataaaaaatggactattgctcagatttgtgttctttacagcagagtgtttgacaaactctttgatccttcttttttttcacaagtggagattagagccatttattgtttgggggttgtaatttatatttaaacatggtatgtatggaatttaggaaattcaccttagacatatgaagcttaacattaatgtgtgtgtatatgtgggtttgtgtatatgctggagggaataagaagtgacaaaagtaatctaaaatcttaatgttgagaaaaatattaaaggtaaatgaaatctttattgtcataaactgctctccaatccagtactgataaacgacgtggggaaagactatggaggttactttcaaaacaaacatttaccatgttccaggaaatacatgtgtttgtataaaaagcaggtagcaattacataaacttttttcttctttatctatttgccaagcaattggctgttaaggtctttttggttgcctttgggcactttgtgtgcactcttttctgcttttaaaaacataatgcatggtaacccatttgccactgactggcattgtgaagagttggaatggggcagtgtaataacatgaaaggctgatgacaaatttagtatttgtaatttggaatctcttctcagtacattagaagtcttccctatttaaaggaaccctgaaaccatcattttatcaagtgaagagtttgtaacacatgattaccattggttttcttacaaatcagaatacagcttcagtttttgaggctcctaccacagttattatggtggtctcttactggctgac

SEQ ID NO: 116655 - DNA, 1063 bp, Homo sapiens
cactcaaatttgaactcagtggaatttttgagataaagatgtgcattgcagccagatcagtgcccaaagtacctcgtggtatgggtgatgggagacaatcacaatgtaaagagttctgtttctcgtactgtatatattagagctggcattttgccactggactatatgatgagggaggaatattgtttgtgagctttgcatttaaagcataatttctgaagctgagttctaattttatttattcccttaggtaattactggttttcagcatgcgaaggaggtatattattgaattttttgaatggttaaacttgtatagtagatgtcttttctttaaatttaggcactaaaaattctcccgcatcaaagtagcttgtgattctcatttgtggctagagagttaatcatctttcgataatgctttgaagttagctttacttctttttttcttcacccagcatgggttcatgaataaaactaaccactgataggtatagtgtattattgctcttgcctatggctcttgctaataaaaattgcaaatctggttagtttgctggaatcaattcaatgtagtataggaatacatttttttctgttataaagccctctcacagaaaaaagataggaaggaaagcatggtgggtgaagggaaaagaaggtaattctggatttaaaatattttagcttttctgtctgtatcgtgttttgtctataacttatgtgagtttttacttctcactgtcctagaatctttaaaattaaaaatcctattgcttaggatgaaattactaaaaattcctgtaaattaatgtatatgaatctgctgttgtgtggatgaagtagcatagcaacgtcaataacttcttttgagaaaatgtgtgtgtttgtttttaaaagcagctaggtaagaaaccatcaactgaagaatagggtaggtgatgcaaccattgctaaaataacctggaattctgacagtttctaaaattatgtcagcttgcttacaagattacttaatcactaaatcacatcggatttggcattttaacaaacaggatgcttt

SEQ ID NO: 116656 - DNA, 1051 bp, Homo sapiens
aaatatttatatctgtacctgcattgcgtccccattttctcatttaagagtagcataattgttttttttctttgtctttcacagcaggacgattgaagtcattaaggtggatggtttctacctgttggttagacttttctacaaaactacggtatctgctaggttgtggcttatttcaccactgtactgaatctcactactttatacaggtcagggcatctcaccactgaaatgtattgttgagtaccttcatcattgtttattgagcttttcatagggtttttcatatagaacttgtaactgcttgttcattcttctccatgactctcctcttactacaccctcagctcagttcctttaatgagaagacattctaggaagttctgggtattaagctggagtggtggaggtctttgaaggaggtttgatattagaaatcagattcactttcacaaggagcatttaaatcattttagccaattaacaccctaacatgtgatttaacaccatcaagtccccaagttgccaagaatgtggcccatgcctatttcccctggtatgctgtctagattgctgaataatgtttgtcttctattaattaagaattctgtacttggcaaattaagcatgtttgcctaaacaagtctcacaaatgtgataggaacattagacttctgactctgtattttggatgttttgttttgttttgttttgttttgtttttggttatctgagagtctgagttacaaggtaactcagaaaccagctctctcaattaataggtcagaatatgaagtttgtagtagttactaacccaaagacagataagttttaatctctatttcagctttgttcagtgggaattttggtcacttggaggccataaatttgacatccttcaataaaatcaaagtcacgtagctagtttgtggcacagcctggactagaacctggttcttttgatttctagtctcactttcattttttcctagtcactttattataatgttcatggaaaccgttacttgaatacatttttataaccttgtaa

SEQ ID NO: 116657 - DNA, 1058 bp, Homo sapiens
tagaacacaaagaaaaaatatcaataatttaactttacaaaaatacaacctaaatatatatatatatatatatatctccacatatgtgtaaatgcatagaaaagagactgaagaatattaatatggtttggctatgtccccacccaaatttcatcttaaattcccatgtgttgtgggagggacctggtgggaagtaattgaattgtggaagcaggtccttcccatgttgttctcatgatagcgaataagtctcatgagatctgatggtttcataaagggaagtttccctgcacaagctctctctttgcctgtcaccatctatgtaagacgtgacttgctcttccttgctttccaccatcattgtgaggcctccccacccatgtggaactttaagtccgttaaacctctttcttttgtaaattgcccagtcttgggtatgtctttaacaccagcgtgagaatagactaacacaaatatgtacaaaattattaagagaagttacctttatttgaggaatgggtgttgtgtgagttagtctttgacagtttactcaagtactgctgtttagtttgaagcctgaaacaacaacagtgtaatgagttaatgtatcatttattgaaccaaaacaattaggaatgggagaaaaagcaaagaattaatgcacagtctgcattgaataatttttatgagccatactttgagagaaacataacttctccatttgatatatacaacaatgttaggatttggtaaattcgccataatctagagacattcttatcccaccatcaggaactattccaagggaagaggaagaggagaaaaatgtggttttaagaagcaaggtcctaacatggctctaagaagcaagtcagcccactaggtgaaaagaaagttctacagcttgatcagtggtactgttgtacagtatcctaacctaaagcctaattatgttttaaataaaccaccagagcctaaggacttgacccatgagtaaatgcaccactaaatgtgacatacatgataaaacactttaatgttactggaattgtggtttc

SEQ ID NO: 116658 - DNA, 1032 bp, Homo sapiens
tagccttgagttcaagagaaatacggcatgttagtgctatgttattatttatggagaaaggactttcacctttgtgtttttttcttaaccttgttttaattgatcaaataatttaaagtgtgttttctcattatatttgaatgcattaatatttaataatatcattctttcatctctgtcattcaacttatcttttctatttaaccgtagatgaaggtattgtggaacaaaatgcaaattctactatgccaaaaaagcagtaatctgtacaacatattcttattttcctagatatatacccagcataaccaatgtggaagctgctttccccattggtatctatccctgaatcaatgatgcagtcatctgcaccagccattatgatggtggaaatgactggccagtcaagcattggccattaattttgaatacatccttgaaaatcatgttgaaaaataaaatggtcagcttcttttaagtatctgatatacctctggactgattatggggactactgattattttaaagctttattttgtcaatggaattttacaggttttgacaatgaccttaatatatttttaaataagaataaatatgaaaaaagaataaatatgatctctatcaaatgtgtaaattttgtatctttatgaatagtttatttaaaagagtaatgctctgtttttttctatttggtttctatttttttcaatctttaaaaacataacctttcaaaagggtaacggtttctggttgggattattagaagtatgttgtttgctttatccagagttttacataatgttatgagttagtcgcaccaggatcaaagaagtttttttaatttgtatgatttcttcagtgttttaaagagggatgtaattttatgacaatagaaattaatgtggattataatgggaagcaaatttaaaatataaaataaaatttatgcatatatgctgacttttaaaactccacttcaaaggaactacctcccagcaagataatttacataagccctttatttagga

SEQ ID NO: 116659 - DNA, 1109 bp, Homo sapiens
agagatggaacacatggaccgtgattgataattgactgtatcccgcctccctttccgcaatgattggttcaaaagaaagtgtgtgatttagaccattcaaatcttaggacttttgctgagaatgtatttttctgttgcatgtgagcagtaggcttgtcttgctagggtctgctgaattcatgagggagccatgcctataataaaactaacaccatagagggcaatgcagagagattgaaagaatgtagtgcttggtgacgtcactacttatgcagtgttcagttatgttagcctttctggtttgaataaagttgagttgggttttgtcttacttgcaactgaaactactgggtaaatgattcagttgctctgcctgacagctcagaactgcttgttgaatatttcttccatttttttcccatcactctctgttgaccatgtgccatgagtatgtaacttggttcagctgacatacagatcttatactttgtaaacttttatgagaaatggtagactatccattgaatatgcccaggaagaggtggatacagaaccttcagaacctctttccttctgaatttggtgttctagtgaggaagaccaagagctctgatgccgtaagtacttttgaagaaagtattattttcttaaaatgaagataaaaccaaagttttacacaagtccttaagaggaaaggaggtgaaaaaaagcaagacagaataatgaaaacgtattagagggaagaaacaaaaggtagaagggaaataagaagagttgaccgaaaaacaaaatgaaaaaaaggtccaagaaaatggaatgatcaagaacaaaaataaaaggaaaaaaatcaggaataactagactatgaagaaagaacatctaaaaatcataaaagaatagaggttgaaggaaaatgtaaaaacaaggaaagacattgagttaaatggcagaggatttttttttttttgatcgcagacaatcaagaagagcaacaaaatttaaagaaggaacagagaagaacttgagttgggaattgagagacatcatgttgattaaagaaatgtattcattccacaagatttttttaaaataaagtacatcttaagttt

SEQ ID NO: 116660 - DNA, 1041 bp, Homo sapiens
ataaagggacgaatctgatgtacacattagagaaatggctctgtcttagcaggcaaaagtcacctcattcaacaaagctcacagcacttttaaagaggagggtatataaaaatagcaagtacatttctttgtacaatgtgtcatactcccaccctcagcgaatccagtattaaatgaaaacatttgccatggcaacatcgatttacaaagggcaaatgatgtttctgagagattggagtatttcctttcatagatttcagaagcacacacagttaacactttagcaaccttgtttaataactatatatatatataactataaaagctttacttgattatttttaagtattggagataaaatccaaaacaaaacaacaaactcctaacaaaaactgccatcaaagtagattcaagcaggaaaaaaatatcactagaacattttagccttcactatttatgggaataacaattatttcatgtggtaagctgtgctaaattaaatctgtgaatgatcattttgctatgaaaatgaaaattctgtttatcttaccatttctacagttgacgttatcagttataatatttagcctcctcattttggacatctttaaaatattttatctatttttcataaatgctaaggcagaattcacagattgcagttgtagtttcatctatttgactcagactatgaaggcagacacagtagatgtaagaaagaagatagattggtagcctgagtaaatgcaagtattgaagaggtgaccttagtggggtcaaacaagtttagaagttaacaaatagtctctatattttttctcagcttgtcataaccactccatgatacaaaatggagaaaattgtggccagaggtgaggaaattaagtacctgccctaaatagtttatagtcaagagcaaaaaatttgtcttactcatttctttaactctgccagaggtgaatactgttctactatctaacctttatttaatgggcacagtaagctgggatctagaagcttatggcttctgagtgtaaggga

SEQ ID NO: 116661 - DNA, 1147 bp, Homo sapiens
atacatttatttgagttttacaagattatttgcatattttacatactgtctttaacaggaaccatttcaggcaatgttatatggtgctgataccagttatcaatgcgtaacaaatagtaaaagtgcaaataatacatgaatacattaattttcaaattgtcgtttgttatatatgtagcagagtctcacagtttatagactattcttcaagtaggcaaagaaaataaatattttactttaaaaaattgatctaatttagcttattacacctgtgacctctgggtatcaagggaagaaaaccttcaaaatatcagttaaaggtatctcactttcttctggttcaagacagtcacctcaactttttagtaagctatacctcctcttcccttttttatttgtcagtacagtatttggttgatggaaagggaggtcttacatgaatggccttgggcagtggaagaggtcttaaatgaatgggattcattgcctctgtttccttaattggtgtcaatttcaataactgtgattatgaaattaacctccatttggccagaggaatttcttttacttcttccttttatttagaaaggtattcccctatgtcatgctttctccctttcccagcttagctttagccctgccaacctccttggagccataacagaatgcttgctggggaaccaaatatgatttatgtgggagaggaatgtgaatacattcaaaatactagtattacaaatatgtaaaacctgaaaacccaaaaccttgcacagaactgtaacatttataaatatgctgaagtctgttgggttgtttctaaaagtcatctactttaacattgtagtttttattcttttcttactctttcatgtgaaaagtatctgcttttgtagtatatcacttcactagttcccagtgcatcataagaagttaaaatcactgtgtgctgaaagggtaaattaggtgtttaggttcctaagtttgtgttggtatcactagtctatggaacagaaatagtttccagggttggaagtcaacaagcatccattgaaattctctacttggtggcatattcttgctggagtctgtgtaatatcaacattgctttaaataattttccttaccttattttattttgactatttga

SEQ ID NO: 116662 - DNA, 1036 bp, Homo sapiens
tatgaattgtgaacggctgtaactcccaagtgattctttccttccaaagcatcttcttccatcccttgtgcttactatattctttggtaatagaaaaccaagcctcaagttatagcaagtccattttctggccattctctcttcattaatattttaaatgatgacatgaaaacttcaagatttgatttttaggcttcaagttcttactttcattgcagtaaaagaaaggtttgtctcttctgaaagttataagccaagatggcacacagtaggtttggcacatagtgctatgtttttggtcagacacactgtgagtcatggtgctatagtttggtgtagaacatttttttgttttataagtactcatgtctcacatacacattttagcaataagtgatgttttcttaattttatcaaacagaccaaaatagctgaaagatgcatttttgcacacacctgagatttaagatcattttggggctatttagcattttatgtgcaaaggtgactcgtaaacagctacttcatactggacagcattttgatgagaacgcaaaaggatgagccaaacccacactaggaaagggagttcatagataataatatatttttaattttttctcttttaattatgcacttgtttattttaatgtctttcaacaactattattaggagaaaacgagaaatgtcattccataacttctaatatcttttaacaagtataccatgcttattgaggacagtaattttatgtctttcgtatttttgtaaagatacattttccacttttatttttctttcctggtaaattgcttcttcatatacatcccagtgactatcgtactgttgttattctaagatggtcataaatttgtgttatgaatttttgtgttcatattttgaccactcactgtggcttctttttcactacaatgttgagcagtgttttatgatactcagcactgtactgatgtctaaaaggaaatatactgtgaatacatagcctgcagatttcatttaatacccatataatgc

SEQ ID NO: 116663 - DNA, 1036 bp, Homo sapiens
tttaaaatcagagacagagaacagagttcagagtgacagaatgagaacagcctaactaaaagggatcatcaggcctcacccttccgttttacagaaatgaagatcgatgctcagaaaggttgcatgacttgcctaaggtagtccagtgctattaaaaaccaaaacaatttaattcatattggttttctagtttgtgtatgtaacaaagttcatgctctaactatgtaaaacaagtaatagagtcactgtttttaaaagtcttttgagccatagttatgaagtgaaatgaactcatgcacagtagaattaatattaataaagatcagagtggtttacttcatctcatttgtgccttttcattttcatgtctgaagtaatccatttcccttatcatgtagagatatttctaaatcaggttgcttgataatcccactgatttcagaattgtaatcggatattcttcatgttcttctctaaccttcattatacacaagcagcttgatgtgagtcatgcgaatgattttaggactatttagtacctcccaaatgatctgaaagaagcctattatccttcagtatttttttcttgcagcctcttcacataattgtgagctctctgattctctagcttgctgcatttcaactttgttaatcatctttagtatggaagacaaatgatcctcagtcatctcattgattccatgggacacctgtttattttaatacctaaatatggccattatgtatcaggaattacactttcattcatagggttatgagaagatatgtaaagcactacagttatacttcttttttaaagaatatattcagaatgttttttatcccttaaaacgtggatttttaaaaaagtaattcaacattgagcagagcgtaagtgatgtcttttttgggaaaagaaaagctttcctacatgcaatttagtttttcagatttacatttagttcttctagtttttttgagaaatccttatgctttacctttattgatccctttgcaactcatgtttttttaatcg

SEQ ID NO: 116664 - DNA, 1050 bp, Homo sapiens
gattgttctatatagactgtaacttcacttattttctttgattttctcttggattctccatgtagctatggcaaatattacttattttttaaaagatctgagactccaaaattattggcctaaataacctgactttccccaattcctatttaggatgcctgtaatagctatatatgtgtattatatctatatatcaatatctatgtatttctgatttctactggttttccaagtggaccacacatttcagttcccgattttcctgtcacaaggaggttagtcctctaaccagtttgccactgatctggttactcaggaggagacactaagtattttatattctacttttgttgccaattgtagggaccaggttgaccctaaatttattctttgcataatatacatggatatattagaagtccattcttacccatattttaaagaaaggttaactggatttgctgttgcaggcttgctctttgcagtgaatgggaagcctcattttggggaccaagaacctgtacaaggatttgtgatgaacttttccaatggggaaattatagacatcttcaagccagtgcgcaaggtatttacacacattgtctaggtttcaattttcatgagaagaagactaaaatataaatcttggcattcaatctgtacttgaatagctttagaaaaacttttaagaagatgtgataactttcttagcaaggttgatgggagtgttctattttattttttattttatattttatttagaataaatgtctttgtctattcctagatcaatttcttcagatgcaaattagcacgtgtgcagttctaaggttcttagtagaactgcacctgcatatgatggcaggtttttaaattcactatagttagaatacaaaaaataaatcagtcgctttctggtttcatccaagtagagaaaacatcacaacatgttaagtgtactcttaaagttctcttagacccaacagacatcttgtttgctttctttattgctatgactgtgctaagcaacaagacttgaaaatagcactt

SEQ ID NO: 116665 - DNA, 1009 bp, Homo sapiens
ggaagcatagctgaccttagcacgtaaaatcctcgctctacactgggacaggattttgttttgctattgagaattcttaaatgaaatagataatttttttgtctcagatagataaaataataacgatagttgccattaactgagtcttatgtgtgccgagtgctttacatagtttgtcatttattcctctcaacaattccaggaggtatgttagattattatcaccattttacagagttagaaatggaggctttgaacagtcaagcaacttgctctattaaacatttgttataagtaaacgtttgaatctgtgttaaaaaccagatctgtctgccttcaaaatctgtattctattgtcctgtcctgttcttcctcgatttcaatttcttcactaacattttcagtgtctgaaagtatccattcatttaaaaaattttggtgtacctacttatatgtctgacaaaagttagacatgatctctgtctttatggagcattgtgatgcagaattaagtagtgcagaacccagaatactgtacttactgcagcacaggtttatttaaagcaaatgactaaactgatttgcagaaaattttaaaatcaaaggttgctgttttaaatgttaaattcatatgactttcagagtagttgttgtgagggtattaaactgaacaattggtagaacatctgttgattacccaaataagtgctatgaaccaagttaagtagtgggaatatatagattaggtcctcattctttaaaagctcccatgcaaccacaatatagacaatgttatggactattaattttctcacgtggaaaaggaattgtggttatgtaggaaggtgttcttatttttagcagatacatactaacgtacttagagttgaagtgtgttgatatctagtactttcaaatggtacagcaagtgtatgtgtgtgtatgtgtctgtgtgtataaatagcaaatatggcaaaatgttggcaattgtgagtataatggtgggcat

SEQ ID NO: 116666 - DNA, 1890 bp, Homo sapiens
aaaagaaatcaacaagaaggttgtgtggaacttggaataggctttttttgtgtaatcttataaatgagccaggttgcctttgccagcctgcagaagcctatttattccctattacctggatgtactattggtggaaaggagacaccatttataacagtgtttccattggaaaatgcttttggaatttcaggaaaactggttatgtgtttgcgtttaggctaagcagcaggagcaggagctcccatttcctctgattttgagagcagagatttactagtttatagttgggctcctgagggaacccatgaaaagggctacagtgatggcttggaaatattaagttcaggtaagggggatctgaatactaggtgggactgatggatgatccagggtgttattttgaggatcaggtagctctggccgtgaccagtaaaggtatggaagagatgattatcccaggcagtagtgttcatgatagtctcaagcagtgtggtaagactagaaaaggtgtaaagaggtctccaacaacagcagtggcaaacgggagtttctgtggcttcattagacaagaggtaagtagatacattctaaattgagttatttatatttgttccttgccaattaaatttgctagaaaactgtcataacaacatttaacaaaatattaaacatctaacatttactgagtgcttaatatgtgctatttgctgtggcatctgtattgcaattgtcaaaacaatatatgagattcataatcccattttacagatgatgactagagaggttcaataacttgactaaggacacagagctgagcaacttgcagaaaaagttttcaaacccagttttgagtctagagcaattgttctcatagtgtgattccaggacgacgagcaacatcagcatcaccttggaacttttggaaaggcaaaatattgggccccacccccagagttttgagattagtattaacaagccctacaggtgattctgttgcatgctaatgtttgagaactactgcattgagtgtggacatttttagtagcataacactcatttcagatttagaaatcaggtttaagggatatttgtcttttgtacagttagattcccaaacctggctgctcatccatttgtaaaaatacagtttttctagttaagaattactgtttaggaattcctaatctgtgataagcccagtaacttgtgtttttacaagtctaccagataattctgatgtaaccagtccattttgggaccactgctatagaaggaattctaaaaataaagtaaggttcaacactgatatttgaataatgtatgtatctttatgcccagacagttagcatatgttgaaattaatgactgaacattgatcaaaatgctaaataatatggaagtgctatatgtataaactgtacttcgttcaagtatcagcgctttaagtgaaataatacaaaccattttgaatgtcctgcatctcttatgatgctcataaaatctcatcttggccgggcgcggtggctcacacctgtaatcccagcactttgggaggccgaggcgggaggatcacgaggtcaggagattgaaaccatcctggctaacactgtgaaactccgtctctactaaaaatacaaaaaattagctgagtgtggtggtgggtgcctgtagtcccagctacttgggaggctgaggcaggagaatggtgtgaacccgggaggaggagcttgtagtgagccgagatcgtgccactgcactccaacctggggacagagcgagactccatctcaaaaaaaaaaaaaaaatctcctcttgtactacgacatatatcctacttaggtgacagaaatgtatttgaatttattttatatttttagttttctgagaatt

SEQ ID NO: 116667 - DNA, 1027 bp, Homo sapiens
agaaaatggtagtatttgtacagtatcctggggaaactgaagagagtgctactggaagcaactggccagggtataacagctgccttaaaggctgaggcaattaatttcttggcatacttacaattcatttatggtgagacaacatgttgggaggctctgaatttacaagtaaggtacttactaggtaacagtgcctaataaatgttccttcccttgagatttatgttgtggagggatatacataacccaagctgttaaataacaaggttatatgtgaccaaaggtcaaaacgaatgattcggagaaggtcttgtaaattgttaaggcaagttttgtagaggagtatctattggatacttgagatgtgccaaccaccagaagacaaaaattctgcttcatcggttttatctcctttttattataggaaatttcctatagtacttgttttcaaaaactggttctcaaacttggctacacattggaattacctgggaagacttaaaattacccgaactctactctcaatcattttgatttaagtgatgtggagtatagcctagacgttgggatacaagcactcttagtatattatcttacatataacatcattaaaatgacctatgagctatgtacaatttacagatgaggaaattgaggccataagaagttaactcacttgctcaagatcagctaattggagtcagtcaggttttaaacccaggtattttaacccctgaatccatgctcttaaccactagcctgttcagtttttttttttttatatgacatctctaagtatctctcatatactaaagtggaataacagaaaaaaaaagaaaggcttccttcactttatgtcctttagaggtccaattcctctgtccatcttttataaactcttcaaaataactgtctgtataacttgtctgtatttcatctccttctattttcttgtttgtttgagacagagtctcactctgttgcccaggctggagtgcagtggtgcaatcccggcttactgcaacct

SEQ ID NO: 116668 - DNA, 1244 bp, Homo sapiens
gaagaactgggagtctgatgtttaagagcaggaagcaaccagcacaggagaaagatgcaggctgggaggctaagctagtctatctagccttttcacgttttttttttttttttctgtctgccttatattctagctgcactggcagctgataagatggtgcccacccagattaagggtgggtctgcctttcccggaacactgactcaaatgtttatctcctttggcagcaccctcacagatacacccatgatcaatactttgcatccttcaatccaatcaagttgacactcagtattaaccatcacagaatagtaggaaacacagcccaataggtctgcacagctacaaccattagttctgccattgtgtcatggacttattaactgattctttaaattttatttgtatgtattccagactttttccaatgaatactctaaaaggctaaaaaaaattaattttcagctttacctctaaaacagtattgttctcactttgttagaacactttaactagaaggaagtacaatacagttttaaaataatgtcataaaatgtgtgtatacacactcatattcatgtatgtatacatataagtacatacctatatattgcattgacatactggacctggcatttcctatcattgccattctgaagtagatagacatttattacattattacatgtttctattatcttttttattggtggtttatcacactaaaacagaaaatgtcaatttatttggctatcttcctactagactaaaagctccttaaggaaaagagccatgtttactttgactttatataaccagcacttaatactatgccttctataataagtaaatagtgtttgttggataactatattcatttcaacaaataatgaacaattcattcttttagatttacatgttagagtcagtagggagtttggtttacaggagtgttcatggaaactatggtttattgagtgtttaatatacgccaagcacttatgctatctcacttagtctttacagggttacagggtgttactatactcccttttttatagactaatagcaactagcacaagtcactagttaagcactgacagattaaaacagatgtacctgactccagaacattccccttccattatcgaaatatttgagctgtttttagatggaaagagtaaaaaaattgaaagaaaccaagagatatttgccatttgataggaaacagaactgagatcaac

SEQ ID NO: 116669 - DNA, 1037 bp, Homo sapiens
gagtctttctctgttattcaagctggagtgtagaggcacagtcatagctccctgcagcctcaaactatttggctcaagccatcctcccaccttagcctcccaagtagctgggattacaggtgtgagccaatgagtccagctatgatagttctttaactgatactcatggacgcctggttatgtggaagagtttgaatgtcagtgaatcacataaaattcttgcagaatttagtgcacatgtactttttttttctggggaggagatccatagattttattagatttgttaaagagtttttgacttctacatgtttaagagctgctgttaaatgaaatcttgttctgactctaatctttttttgttcatttatgtatgagaccagaatatagaattgttatgttccctaaaaaaactgtttacagacaacttttacaaattgacttaatgtaatttcagattaatatttgtcagtggcttttaaagctgcattccatttgtctgttcttttccattccattcagatatttcataactatgtgctaagagatttagctttaatataattttgttataatttgagtaattttctcttaattagtttagctattttgggatgaggaatttaatgtgtagtctttttgttaattcatatgtttgtcaaattgctaagatgtatattactgaagatcagttttagtttcttaatttttttgcttttattataagtaattttcttatgggagaaaatgtattttcattttgacaatatacatcaagttattgggctgattttacaagtgtcattaaaaattattttttacatgaatgtttttggagtgcactctccaaaattagttttttcattgcattttaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaa

SEQ ID NO: 116670 - DNA, 1067 bp, Homo sapiens
gagtggatgggttttgactgttattatactttactggtgtgaggaggataaataaatgctagaggtagttaaagagggggtactttcttagtttgaaatttcattgaaaatagcaaccatatttattctgaaagtgtttttgtttttaaatttgtttccagacttttgtagaaaactgttttttaaatgtttattataacaatgatataatttttaaaaattcctttgtttgttaatgtgtcacttttatttattaatcacatgccttatctacttttggaaaacaaatgaagatagctgtactttggagttcatgtaaagttaacccgattttttgtttcatttttgttttagccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggtattaaggggagtgggggagaaactcctttatcctctctgtttataaaactaatacatattaattgtagactatgagataaaacagaaaaataaacattaactcactttcatggacaggtaatattaacattgtgatatatttctttccagtgtttgtcttctatgtgtattatcatttaatttagtgtcatagtgtatgtgtaattttatatttaacctttttcactattatatcaagaagtttttttcccctaccatgtcattcttagataatgtggtttttaatggtggcatagtatatcattgtgtggatataccataacatatttaaatttatccaatatcctaacatttggaaagtttccagttttcactattaaaaataaggttgtgtgatctttttcactgcatatttttgtttgcatctctaagtttcttaggacaagttcttgaattattgaatactttaagcccctttctatgctttatagaacaagatctatcatttttcatat

SEQ ID NO: 116671 - DNA, 1034 bp, Homo sapiens
agtgtgaaatggtaagtctgtaaaattttgaagaactatagcttttaatgccatacgtatcataaatgttggcacatgttatttacataaacatggataattaaaatcaagtaagtacattatccaagttttcttttatggtcttttagtgaaaaagtcctcgataataatgtggtgtcctgataatataataagaatatgtgatatttcttgcaatcgtgtttgttttatagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaaggtaacacctttgtaacttttgtatgaatactcttctttgtacattgtcgtgtattattaaaagcaatcaagcatttaattaccgttaaatattgaactcttgaaaatgtatcatttagaggtaaatttatgaaactgatatactttgttagaaaagcatggcatcattttagttatttaatgttgttaagcagaatttctgcctgcagaatgccaggaaagatacttgacttttcttttccctcccattttgtacatctgtcaaactagaaattcacttaagcagtagcagtcttttagaataatggcccagaaaaataacagctcatagaaaaagtaacactaataactttacgtacatgaaagtatacttaattgtactcaaatgcaaattaaattgagatataatgacattgtattactttttggattgacaaagataaaaaatattgagctagttgagaaataagcacaagaccaaacattgttggcagaaatacaaagcaatgtagcctcttaacaatataatttagcaatgtatcagaatgtaaaatgcatatacatatagaaattgatggcaattcaaattaagaacacagtgagataccattttaacatccattaaagtagcagatattaagaagcct

SEQ ID NO: 116672 - DNA, 2089 bp, Homo sapiens
agattatacctctgaattctagcatgcttctaagatgattttatcttccagtaatttgagttgtaaatacttgttctccttacatgggcaaaacttagcaaatatataaatatagcaaccatcatgtaaagttttattttgatttaatgaagtctcagtctgtagtgacctaatgctatggatcagatatataagaaagctcagaaattgtagtccatctacttttatcccagagttaatgtagccatttctagagaagaaaaggttgtattctactatatagcttaatatcacctccctcccccagcttcttaagttctttttgaattttatttcataaagttaaaactagattgttataagtattattcttcatgggaaagatcttgaagtggtaaaagatggctttaaatagatgactaaatgttcatattaatctgaattatacaacacaaatcttttttagagaattaagaacatatatattttttcattttaggatggaacttagatgtgtcatagctgttatacgtcatggggatcgaacaccaaaacaaaaaatgaaaatggaagtgagacatcagaagtatgttttcagatgaataatttaacatgcatgatacaattttaagatttctgataagtgatcaactcttttgattaatacatcatatagaaaaacttttatctactgtctcttggccatttatatttaaaccagtgggtgggtacaaaatccatttaaaatatgttcattagcatctaaaattattgtggcaatattcataaatatcatcagtctgccctggctttcatttattgtcataaaggtgttctatttaatctttgcttatcactctcttgtattgcattctgagagtgagtaatccctcagccttttagaagaaaattagtagaatgaaagtttctgttatttctatccagtgtttggtttggagatgataaaatttgaaaaccctgagccattaagtatgtgttgacacaagtaattttcaatgtatatgcaatgacttcagaaaatatataatattatgaactataattgtatgtttggtttccgtgaaaaaactttgaaaagtagtatggtgattattagtttggtatcatttaggaaagtactaagttttatcaatcaaagttgagcagcaacatgtacagtgaaagaggaaacacagtacttgaaatccttagatcccaagttctagtcccatagcttatcatttattatttgttagtttaaacatatattggtaatgttaattattgcaagtgactaacagtgttctgtcttttttataagattttttgatctttttgaaaagtgtgatggatataaatcagggaaattaaaactcaaaaaaccaaaacagttacaggcaagtgtatttgctttcttgtttaattttaaattttttagtggtgaaattacataaaaattcaattttttattaatttattttataggaagtgctagatattgcacgacagcttcttatggagctagggcaaaataatgattctgaaattgaagaaaacaagccaaaacttgaacaacttaagactgtattagagatgtgagtatctttttgaaacgcttaattgtggtactacatatagctcttcttttttatgtatgtgattttccattttaattactttcacagtctgatctttttactctttgttactatagttgagacatgaaggaaaatctaatgtgaaaaaaatagattgctgtattgaaggttttagctttagttttaattttggtgagaagattaaacaaggacatcaaatttgtgtcttctgtgaaatactgcttagaatgaaggccacattgctaacttgaccatagattcattgcagtttaaatataaaaaatttgaattttgccttaatcaagtaaaatggatacccaccaatattcctgttacagctttacatttttaatctcttacaatcttatttcctttatttcttaaaacacatacatctgtgtttttacatatttctgtactttatctcttcagagttgtcttttttttttttttttttttttttttttttt

SEQ ID NO: 116673 - DNA, 1004 bp, Homo sapiens
gttagaatgattatatatggtacaatttttttttgatagaatatttcgaagaattaaacaggcggttacaaataaaagggagcatgaatatgtgagaattagtttttccctacatgttctattctgtttatcattttatttttcaggtatggtcatttttctggaataaatcgtaaggttcagttgacctatctccctcatggttgtcctaaaacatctagtgaagaggagggtatgttattcttaatgcttatacagtagttttatatgtagtaacttgttattcactgttgattacctttggaccatcttttgcttagtagtttagggaatggcatggtgaggaaaaataaagtggaattatcttagctgtgcttccttttctttaaataaaggatacaattttaaaattacctattctttaaacaaaggatagattttattgttctgaaaactgcataggaattccttttaactgcgggattgtttcggaaaacttatttgtttataactaagtgttatttaatgggctccttacatcaccttttgatagtagagggcagagtatataagaagaaaggccaagaagtacaaaaagactttgaaaaaatatacaattaacctgtttctaaaataaatgggtattttcttccacccagtaaaccagagtaagtctttaaacaagtttggtctcctaagagcagtcagtatccacattcataaatgcatttaccttacaaaagaaaagggtagggattggggaagtcatttcatagagaaatgcagatgaccaataaaataataatgatagtaataataatctgtcttgcctatcatattggcaaagtgttttcttcgtttctgttttaaactggtaataaagtgtgctgatgagaattcattgagacaggatttcagtctatagtagaagtataaattggcacagtgttttgaaaagtaacttggcaatatatcaaaaacttcagaaaatgtacttatgcttt

SEQ ID NO: 116674 - DNA, 1009 bp, Homo sapiens
taaggaacatacatgcaacagcatttaaggaagaaaatatcttacatatgggccatatttcactgcagaagagagcacagagaaaaaaatgaatcttaagtctgtttaaagaaataaacttaacatttgttttattcattcatatgtgtcatagacagccgaagagaagaaccatctttacttttggttctaaaatggggaggtgaattaactcctgcaggcagggtccaggctgaagaacttggaagagccttcaggtgtatgtatcctggaggtcaaggtaaatcttagagttttctttaatttgactaatttcataaattgtattttgaaatcctcatttgtgatgttattaaacatttatagaaatacaatgaaatgaaaatatagctgaagtgatttgaggatttattttcaggagattatgcaggatttcctggttgtggtttacttagattacatagcacctacagacatgacctcaaaatatatgcctctgatgaaggacgagtccagatgactgcagctgcttttgcaaaggtataaataatttttttttagaattattagagtttttaatctaatattgtatcttaaaacatttttggctgggcgcagtggcttacacctgtaatcctagcactttgggaggctgaggtggtcagatcactagagcccaggagtttgagacaagcctgggcaacatgacgaaacctgtctctgcaaaaaaattaaaaaaataaaaattagccaggtgtagtggttcacacctgtagtcccagcagctcaggaggctgagatgggaggatcacctgagcccaggaggtcaaggctgcaatgagccaaaatcacaccgctgcactctaccgcaggcaacagtgtcagacccttgtctcaaaaaaaaaccaaaatttttttaaccaaggaatatttaaaaattctgtatttggaactttcaagtaaaactctaaaatgacaataatgaactgtagtattaataaagtttatt

SEQ ID NO: 116675 - DNA, 1022 bp, Homo sapiens
ctgatgaacctacattgacacatcacccagagtccatagtgcattagggttcactcttggtgttgtacatatgggtttgggcaaatttataatgacatgtatcatcatagtagcatacagagtatttcactgccataagaaggtagtaaagtttttttttaatttaagaattgatactcttagagaataataatatgtgaacaaactaaagaatggaaaacagtatggaataaatcaattaagcatttattgaacacctgttttgcatctgccatctctatatggaaatatgtggagagtaacacataaagaattacggtcttatataaaattttttgcaagtctttttactttatgcaaaagtattttgaaaataatgtttagaggtcaagatatatgtagttgttcttttgggggacatgggtcttttcattataggagaataaaaataaaggtgtaacaagaattcaattaactaaaatgcaattaagcagagaattggattgataataaaggggtaagtggcaaaacatattgagatcaggactatgttagaagaacaaagttccagatgtcacttttggaccttttttcaactcagtacaagattatttggatattgtaaagaggaggttggagtagatcaggtattccaaccgtggactacataaagtttgaaagcaggaaaatattaaatacatgaaaaagataaagattatgaaaaaaaagttcaaaaagcctaacttataaatacacatgtataagaatggttaaaataactgtccctttcctaatattcatagacagtacaggaaaacctatagattttgaaaaactgagaattcatacaattgtacaacttacctataggtatttgtatacgtgttaacaattagcttgtttcttcaacatgaaagagaactatatatttgatcagatatataatatagacaattttaggtatattgtatgaatctgtgattttaaaaattatttttagaagagtatgaaaatatctcaga

SEQ ID NO: 116676 - DNA, 1021 bp, Homo sapiens
aggtatctagtagcaggaaatagcctttaagttgaaatatcctagaatgaacttggagagagaaggtatatgtgtttctttcctcttcccttttctccctctttcccactctacccccacttttctgccttcttcctttctcctcttctactgctttgaactataattttcattgcaattactcttaaaattgccatgttttctggacacttcacattgtgctaattccttacaaatccaattaactcataatgattatgtcattaaatttgataatttcatggaatctttgctcacttccagttaaaactttaaaaatattggccaaagccttttgaagaatgtgttagtcttttaaatctttgacatttggaaaaacagaaatctcaaggtttaatttttttcatatatttattacatattgtgctttagtgtttgtggccttaatccacctttcttttagggttgtttttacatttaaaaccactgatttagtgaatactagtcataaaaattacattcacccattcattctccgccttcagaaattactggcttttgttcagttccaccacaaaatccttccaattatacttaatagtttgaaaatcatacatttgcagttgcaaaaaatgcaaactcggagttatccaacgttcaaaaaaggcttgataaaatatttgtctctcactagactaatttaggagtgtatttttttagagtactttgtcattatatcctttttctaatgtcatgtattttttgctcaggaatatggtataactaaagctgaaaaactggagattgccaaaggctactgtactcctctggttagaaaaattcgctcagaccttcagaggacacaagatgatgacactgtaaataaacttcatcctgtgtaagaaactgtactggttatttaaatctctaggcatctatttttgcatacttcaaatttaaattatactttgatggtcctatgaagtcagaagtgtgtcattggcatactgtgaaaatagta

SEQ ID NO: 116677 - DNA, 1170 bp, Homo sapiens
tttagtgaaactcagtaatgctaatttatgttttcccttatcaattttgaaaaaaatacatcttttcacatactacctcctaaacttgcacacatgcatgtgcgcacacacacacacggaatgtataatgtctaaaacagaaataaaatacacgctgaattttaaaaagcatacagtcaatgtgtggtcttataatttgcttttaaaacaaggtgcattctgtactaaagtccataatattgtatactcttagtgtatacaaaaaggaaatgttgtccttttatatatttgtaatgtaattacatagtatacaacaaaggaaatttatctgtgatgtacgtataatttaagtagatcctgttaactgttgactatagactttactttgagtagttttgccttttcagatagaattttctactttgaatgcttgtagtacatgttctctaagatccttttcagttctgatgctctatgattacatgtttaaagaccatgattctcagaatgaagatggaggaatggtgaaggagatggtaagatcaatagaatttacatatgcctccttcttctgatttttgaatatcacttcagtgtaatagggatacttgttgataggcctatattgcatacatgaactatatgatggtgggaaaaaatggcattcctgttataggatagtattctgtggttatgaaatatgatactatactaggtactttggaacctgacaaagttaaaaacggtctcttaccctcagaattcattagtgtttgtcatatttcaagaaattatttatttttcattttgtataagcagttaaaaaaggttaccactagaacttctaatataggttgaatatctcttatctgaagtgcttgagaccagaagttttttggaatttggaattgtttttgtattttggaatacttgcattatacttactggtttagcatccctaatctgaaaacccaaaattctccaatgagtatttccttcgagtgtcatgttagtgctcaaaaagttttgaattttggagggttttggattttggattttcaagttagggatactcaaacttgtagagattttaaaaatattttatcaaaacaagcttaaataacatactaagacttttaaatgtagtggaattattttttaaaattttgc

SEQ ID NO: 116678 - DNA, 1504 bp, Homo sapiens
caacttggatccatgtttcatcagacagttaattgtagttagatttacagtacttgtacaataagtttgttgaaatggaaaacttagaagagtattatgtgtattcttcttttagataattgattatattataaagagcaagcgtttctttgatcttttaaacttttatttattgttaacacttattttacttattgagctaattaaagtgagtggaatgtttataagtagaggacaatatcatattggcaatatttttataaaaataaacacaggatgagaatattttaggatcactagctgaaggagatcctcttaatgttgttaatataccttaagttttaatattaagaattttttaaggctcatggaagcgtgtcccttttgttaagagaagtggctctagctctttcaggatcgtctttatttaaaacattttcttatttatcaacaaatttattttagacagtaaaacatggatttaccagaattgccagctcatcttgcttttctttcttttgtatatttcatttgacacttttcctctgtcatcaagctagttaacttcttttaaccaatatttaccttattacattctctcattgtcccttctgcatgtcacctttctaacctcctcatatatttgtttttcccctctttcttttaagtgttctttttgtagctgttacgaatttcaggtacctgtttttctctttcttagacgccacacgcggttctgctgttaaaaggttttctatctcatttgctcgacacccaaccaatggtacgttttgcttttattttaaaagatactcccctgcttcatcccttttttatttttattttatttcaaaatgtggggtatacagtatcattcatttcttcatccttaatgtcaattggcgtacaattccaacttgttattcacccaaattattgatactgtctagctcccttttcagctgtaattcacataataatttaacattactcatcaaacttttaatgaccacaatgatgatgagttttaatgctaaattaacacctgaaaatttcatctaatttctcagatgatcagtctacacaaatttttaaattataattagtattctttaatttttcttaattctcaataacttttttcttcctaattttctgatcacatggttgttttattgagatatttaaacaaaaatacagagccacccatgtcaaatagccaaataagatgtgtctttgaaaaattcctgggcacctggtgatgcatatttcactgtataacatcgtctgttcctggctatttttctaaagcaaaaccctgttcggtctggagcactctgaaaactttgtccagcattcactttgttcttgtgtagcaatgtggtttgctattatcaagcaactaattccttttagtaccactgctttttcttaaaatttagaggactcctgataggaagaagattaagttaagatctagaaacccagctctgttaaattccat

SEQ ID NO: 116679 - DNA, 2989 bp, Homo sapiens
aacacatctaaataacagtgcactaataattcttgaaggtggaataagaagatctcatcctcaacaagtaaaaatttagccttaaagcttaatgtgctttcccttcattgtagctatttaaatgctactttttgaagaaagtgattcttatttgatacagctgcagcttctaaagaaaccgcatgcctaagaacctcttagaagaaacacagaagtcacaagaaaaacagaagccacaaaaattctaagaagagacattgcaggtttaagaccatagtttttgtactgaatgctgtgtgtttaaaaccagtatttgaggtattattatctaggagaatctgtgtttaactgaaggtttttaaaaatgaaaaatatttatgttaaatttaatagaaaatagagtaattttatattcctttggtttaggctcttttttaaaaatgtgggttttccgcacatacaaatgcacataaggtgcattcttttctattctacaaatatttcttttgagttttaaggtttccttttttccttttttaatattgtgttgtcttatctgtcctatgaattgtcatttgactcttccttttactttttatttcccctaactttcatgttatttccatctttaacacatatcatggacttacccctcccttcatctttagttcaaggaacatggtgaaacaagtatcttctgacagtgctttaccttattttctgggcctctgtgcagaacacctacacctctataggtgctggtccgtttcctctgtggaatttctaggctccagtggtatgtttttatagcttctaaacatgtcagcagggtggctttttaaattgctgcgctaaccctttcattgtgcattaaaggaaaagtttattaaagataagtggaaaaaaatgtagtctagaggaacttaattatattgtcatttgcctgttataaaatctagcaggcaaatgaaataaaataattgctataaaagatttataaactttgtgaggaaagaagaaaagatctcatcgttaagtttagtgtaatgcaaagaaagggtttgcgctcatttgcatgaatcttgtacttctaaaaaatgtaacagttgtgcaagcctaatttctttagtgcttaatttaggtgctttagttgctgttatagtatagttttgtttttgtttttgtttttaaagtatgtgtaatgttctgtcatgctttggtttgcacctgaaaatcagacatatcacttttgcaagtcctttggttattttcctaggaagattagattctcttttaaccaaagtttccttattctaactgagaattaggcagttcttgggtcaatatttccttcaatatttaaatgaatcaaacatcagtcaatttaaaaatgagcacacgcctattgaagcagaatgttgcagtctgaggttaattttgtacttttaatgatatttgactttatataaaactttgagtattataagtatttaactgcgggaaattaatttgaatttttggaagagtagatgcagaaagactcgttatttttaacagtatatgaaagcaattttaaaagccattcagttgaatgaagtttaaataaacaggcaattttcttttttaaaaaagtgaataacctatatcctatttgtttaaaaacataaactgtgtatttaagtgcttttgtttcactgatggtattaatacatatttgcatgattgtttcataaaattttcgtatttctgtgccattgttaaataggaacatatttgtatttgtattgctttttacttggcctaactttacacagccagtgattcctagtaatataattatgtgttaattcagtaaaggtaggtgaaatacgttttggaatttttattccagcatgaatgaatgaatgttgtttggggttcatactagagagtatcattggtcttggcacacctggaaaagtatctaaaataattattcacaagtaattatataatttttcaacaagaacttactgttagcgtcctggcatcagggatacatcatgtggcatcagtttattcacctattgaatagacctgacttcaaaaaataaaaactgaaaacttgtatttctttgtttttttttccctaggttttttaaagtattattcttagattttaccaatatagaatgaaattgtgtgcatgcgatactacgtgattacatttaaaaagaaatctttgtcacatcttgttccagctccatattgcatagcatctggtgtcatgacttcagagatattgtgtgtttgcatgtgatagactgaaaagacctaaactgtccagttctaagcagtagtcttcctttctaattactgatttttaaaatatccatcttttattttttgtttttggtttttttctcttctaggctttgaattgtattccatggtgccatctatttgtcctctagaaactcttcataatgccctatctttaaagcaagtggatgaatttcttgcttccattgcttctccatcatctgacgttccacggaagaccgctgaaatttgtaggaaatttttctttcattgttattatttagttgctgggcaactacatactatctgagtataacaggaattataacaacataaaagcaggtagtggtaatgagtaggagtacaaaggggagtgtaaagggacattattaggaattctttggtgtaatgtgaactgtacctcttttttttactctgccaaaatcttttcttcttaccaaaaaaaaacaaaaaacaaaaaaccaatagcagtagaagtcaacaaaatatagggttgtggtcttttgttaaaactatgtttgctagaaatctcatattcctattgtatatcattttatagcaaagttttttaaaactgcaaaatatcagtccacattaacccattcatacacactcatctcctgactacctttggtaagtagttagaaagagcttttaactaaagaca

SEQ ID NO: 116680 - DNA, 1064 bp, Homo sapiens
taacacattaaatatcatgtggctctattctgagggacatcatttggggaaatgctcagggcttcctttttaggtgtgagaagtcagctgccagttgtcgttttcagctctataggattcctcagtactttggaaattccagtttagaaagagttagttttgggagagagtgctttgcttagagctaagaatcttactattctagtcatatcttagaaagtgacaaactttctttgtgtatcattcctctttttctgagtgctgtaaataaattttgctcaataataaaatgagatattagagctctcggaatgaatgccacttttatgtctgactgtcattctcttctctttcctgggccatcacatcgtataattctagagagctctattctctttatattttgtctaaatgataccccctgcatttatacaaagtagtgacctttcccttttcttccatttttggtagtagaggccagctttcaatcattaacagtaatagagatgtatactggtgagtgttctaaaatacttcactttagggatggttttaggaagtaggtcttaacttaaaaatttgcatataaatgtgtccgattatgagaattgataatacttcaaatgaaataacttctccaagtggtaaacgtcagagacaggaaaatgaaggtggtaatctccttttatattctctataacctgctagaatggacaatgctgttacctcagaatgcagtagagaacctgaataaattctagtttaccccttcacccttaatgatgtttcattgcttccctggggcaaggatttgaaatcttaaaatagagattaaagaattattctaattagtaaataagagtttaggggtagatctcaacactatttagattgtagaagacttgcaatgaatgatttgaaggtaatagaaatagtagtgacatgtttgttatgaaaggataattttagtagaatatttacaaaaagataatattttaaggtttgttctgtggtactcttgatggattcattttgtagttagtgaattcagttcatcagagtgt

SEQ ID NO: 116681 - DNA, 2044 bp, Homo sapiens
aatataactagcaaaacagaaacgcatgaacacaaaaaaaacactgggaaaaagaaatgaaatcttagcagaagctggaactttttatacttataaaaatagtatgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaagagacttaaatggtaaatttttaaaattttcttatctcttactttttagttttcaaagtagaaaaaatcaggaatttttttattaactagtacttacatattaaataaaatttattattggctatatacatagcaatatattactttccaaactagaaagtacagtacaactaactttttccattgttatgcaagaactattactttcctgtagtcaccaaactcagtagtattgctctgtagactagacactctatttgtaaaaatcttagaatcactttccaaaacaaataaaaagtctactgtatcagagcaaaatgttatagttatcactgtttagtggcagtttgactgaagcatctgtttctcacttgattctgtcctgagaagatgtgggattttttggttt

SEQ ID NO: 116682 - DNA, 1077 bp, Homo sapiens
aaaactagagcaatgggtagaaactacaggaatgtatgtgtatctatgtctatccatctatctctgtatatacctatatttatacagttgtcccttggcatccttgggggattggttccaggacttcccccaggtaccaaaatctgatgatacgtaagtctctgatacaaaaatggtatagtatttgcctataacctatgcacatcctcttgtatactttaaataatctgtagattacttataatacctattacaatgtaaatgttacataaatagtggctgtactgtattatttagggaataatgacaagaaaacagtctatacatattcagtgtagatgtaattttttgctttttcaaatattttctctctgtgattggttgaatccatggatgcagaacccgtggagacagggttgactgtatatatgcatgtacatacagatatatgtgtaaataaatcgacattctagcagagctgcacaaggtgaaatgagtcatcttgggaggcagtgagttgcctgtcactgaaggtgttcaaacatacactgggaaactattaagattccttttgattccaaaattatacggtacaaaaaaatttaaaatttggaggaccatctgaaacgtggaaatatgtgacaaagagttcatttatttttaatgtcaggtttattataacttagtaaaatccgtccttttaaagtgtacggtttgatgcattttgacaaatgtatccagttatgtaatgaccactacagtcaacaaatagaacattttcatcaccccccaaaattccctttttcccctttgtagttatcccctctccccaccctaggccttggcaattaatgattgattctggcaaatagttttgccttttccagaatgccacgtaagtagaaacatgtagtatataggtgtaatgtctgcttctttcacttaatgtttccccagattgttccacttcattgctgagtggtatccattgtagggatggactgcagtttgtttatctctttccctgttgatggatatttggattgtttccagtttcggtgtttgtgaatgaagctg

SEQ ID NO: 116683 - DNA, 1002 bp, Homo sapiens
aagcatgagccaccgcacccggcctgggatatatttttaaatgtgtaagttggacattttcagttatcagaatgcagccatatattgtgtgtgaaaatgagtatattgtgtctttcaggtaaataactgaaatacgtgacaaagggggtagacattggcccatgcttagcaggttttagaaaagcaaaacaattccaaatatttatttatttttaaaaaggatgcacgttgtaggaagcaacgaacaaatgaagacaaagtcacggactgaaagcttgataaaagtttgtggagaaataaaataacaaaaattgagaaaaagaacctttaaacgtttttgctgagcccagtgtgcaatttcattgtacttagcactggtaaggttggtgaaccttgggaaggtgattagggttttttctcatttatatagtataagccccagatagttgtgtagtgataaactgaattttaacctcaattccatactatctactttcaaggccttcatagtgtgaagttattcctaaactgtttcactagtgagtcttcacattttagagagaaaaaatatcaaaactaatttatcttcttggtggccatagtgctttgcatcatgatttgctttgctgactctgaggactgttgtgtgtgagtgacagaccgtgtcatgcagtctccacctcaaatgctactcaggctgcataggggtcaagcaaggacaacaggaatctgcaagagtatattatttttaaggaggcttcagatggaatttcacttatttatttagagttcatttgaagatatatccagttttgaaatggtagcccatttgtcagacattgatatagaaaagcaaaacaatagtgatcaagagctgtctttagtgatttgtgagacgtattctatttttctatcatgcgttgtgactttctacaatttattctggtagagttcagaaaaatcacacattgttgggtattaaaaatacccaacaatggttaa

SEQ ID NO: 116684 - DNA, 1747 bp, Homo sapiens
atcagtaagattctagagaaagcaaaacatagtagttcacaattttgcaacatagaaagtcacattttgaaaggctattttgaaattgatttaatagctattatagtttatgaatatcaaaatttgtataatttgcatctttactaatgtatgctagagctacaagagaccttaaggataatatatgaaattagctttccttattttatagataaggaaaaagaaattgtgaaaggtgaatttacctaattagtgaaagttacataactaattacaacagtctgtactatataatgcagaggacgattctccctgtaaaaggaactagaagctattactaaaaatatatatagacaaaattaaaagaaggaatgataagaataaatttaatttaccaaatattgttaattaaaattttagatacttaacatttatttaacttaaataaaagataactgtcagataaaactttattttactaatgagcagtgattttcttaggaattgatgaaggcttattggtatcaagaatttaaaccaaattaaaactgacagaggacatttagatacataataaaattcgagctacataagtatatggaaaataatgtaccttgattattatgaaatagagcatcttgaaattcagttttactctaaatgtacttttaatacttgcagattctaagattacattgtaaaattccaggttttcataatgttaaaataggaaagtagaatataaagtatcaacaagtgtagttatacattttgttttggatatttaatccttacttgggaaaaaatcagcatctaggtaaattattattttaataacaactcttaaattgccaacctctgagaggtgaaaagctatgtaaatagaaggaatggccagttcaaaagaatagtagatgtgatagtgccgtgaatgtattctactggaaatgaatgtaataatacattaaatttttaaaatctattttgttttgtgtgtgtgtttaacatgttttgacaagtgtcctgaaaaatgagaaaagctggatttcagtcgttaacctgtttcgaattgataatgtacaagaaatgcaaaagcctttttaaaagtgtctgtgtttgggagacttaaaactttgatttgaatcttaaagtatagtttggggtcaaatacaaacagacttacatatatacatacatatataaagtcaataatttttgttcttcaggtttaaagcgatatatctaatttttattacttgtctaatactgctaattgttggattttgatattttcacatgttgatggaacatgaagagttagaagcccacatattttatttagttggaaaaatgagaaattcttttaaagacccagttagggatttggctgaagacagaaaataataggataacaaagggagagaccaagatggaaggaggaagaataagtttgttaataagccaaattaatcccacataacaacaatagatagctggtcctggaactgtgttgctaatgtggatacaacaaaatattaggtgaagatgttctataaaacaaatccattaattatttagagtaaaattttcacagtgaaaattttattagggctgagacccagttattaggttctggggggggggagggagggggagaaagagagagagagagagatgggtggtgggtattgagtgaaatttgtgtatttgttgaggttaaaaggggctgttatctctattagaaaaa

SEQ ID NO: 116685 - DNA, 1888 bp, Homo sapiens
atttatccattctgctgattggacatttagtttattttaaagttcttattacaaacagcactgcaattaatatttttatacttctccttgtgcacatttgcaagagttatctaggttatatacatagagtagtacgaccagctcatgtgttatgagcatcttaaccttttctgtatgttgccaagttgtctctgaagtgtttctgccaatttacacttcctccagcagaacatgaaatgttccattattccacatcttcaccaagttaggattttcagacttttaaatttgtcattctgaggagtgaatgaaatcgtatctcgttttcattttcattttcttgcctatggaacatcttttttcaaatgtgtattaggcattcagttttcttttctctgaattttagatgtttatcttttacctagttttgttttcattgtttatccttttttattcattttaagaattcttaaatatgtagcatatgctaatcttttgttagttatggttttgcaaataccttacactagtctataattatatttttactatatgtgttcttttgattattataagttaattttcatgtaggaaatttatcaatctatttgaaatagaaagctatatttaaaatatattttgctaaatacagcaatatttagcaaaatgtttctaaacttccagattttacttagaaatgattttacttagaaacaatttcccctattctaattcttaattccaacaaattagaaatataaagtacatttataggcatcacttaccatagcagagtcagcagtcatctagaggaaaataattgcttagaaaaagtattaaatttcatcttatgtagtttgtaatcttgtaatgacctgaaaagagttacctgcaataattgtttgacaacataataaaaaaaagtttcagaattttagtgtgaaagagctatttgtaaaaatcatgtaatttataactatttcgtggacaatatatacatgagataagatataaagtgtttgcatagtgtttaaccagtattaggtattggatatttttagatggtatcattatttttaaaatgtaactgacaaatttgtaccttaaaaaaacgaaaagtttattgttggcattttgatattctatatgtggtcatgtactttaaaaaaattgttttcttcaattacagtctagttttaggcttctgctttctgattatttgcattgggtttctgtccaaagtgatttccagatgtttgaaccattcaggacacaaagtgtcccgggcatgttcatcagcaacttgttcttttgctccatttcattaggagagacaatagaagatgctgttaggagagaagtagaagaggaaagtggagtcaaagttggccatgttcagtatgttgcttgtcaaccatggccaatgccttcctccttaatgattggttgcttagctctagcagtgtctacagaaattaaagttgacaagaatgaaatagaggatgcccgctggttcactagagaacaggtaaagttcaatttaatttccttcttctattgattgttccctgactgtattggtttggtcacagagcaaggatgcatattttcagcaagttgaatgatgcctttggccctctcattatgcatggattacatggtaattagtaattccatacaggaggagtatgtttcactaatgtgatctatattaacttattctatgagatttttctagtagagatgattctgtaccatttcgagtttcagattccattccttcacataaataataatacctatcagtgggtttagaaaaacattaattcatagatgagaaacaggaatattcttatacattttatattttagtttataacattaaaac

SEQ ID NO: 116686 - DNA, 1062 bp, Homo sapiens
gctgaagataaagcaggttttcaacaactgtttcagggactatttggtgagtttttcatcatcattttcagctgcaagagggtcctgaccaagaagaggtaatacttttgttccttgtgctctaaatattttgccaaattgccatcttcatatagatgagtaactctacatttatttggtacaagcaacagggcccacagaataatttatgatctaagtgcagcttgaaatagcagaattgctgttggtgcttagaaattaattgagaaatcactgtctgtaatgtaatgatttaccattgtttttgaaccatgttgtggaacctaagaatgttaattaagaattatggcatagtccaaatagaatctggcaaagtttcatgttgaagcaaaacaataagctattaaattattttgcatataatagacattttcatatttacagattaagttgtgattgatactatttaatgtctgaggacttgaatcacactaataccacatattattctgtaatttatgttgtctaagagatgagtatgtaccccttttatgaattttttaaaaattaaaaagaaaaatgtaccaagttagaagcacttgaatggattggaattgaagtaagctttaaagaggataattttataaatcagaaaaagagtggtgctttttaagggttggactgatttgaaaaagtatcaagtaaacaaaaattaatcacggtgaaaaagtgaagattcatgggctgtttaaaaaatgtggtctgtctcagaagcagtgtatccctgaagcaaagctcaaaaacttttcttctaggcagctacctgaaaatccctactagaagcagtgatggttatgataatggccattagtattttacagcatttttcagtctatgatgccttttctcaaaatgaagctcatttgattttcatggtatctctgtaaggtatcttgattttcctaatttctttaattatacttgcctctgcttctatcggtggtacttaccatggatgtatgtctgtgtcagctgggattccagttcagtactcaggaagta

SEQ ID NO: 116687 - DNA, 1058 bp, Homo sapiens
aaatgcctcaggatgacctcaccactggcagccctctttctcctactgagatgtttccaggactaatgccaatgtttagtccacttgtaggaatctaaaatattaggcttttgatttcaagaacacaaaataggctgaggtgggcggatcacaaggtcaggagatcaagaccatcctggctaacacaatgaagccttgtctctactaaaaatacaaaaaattagccgggcatcgtggcacatgcctgtagtcccagatacttgggtggctgaggcaggagaatcacttgaatctgggaggcggagattgccccgagccaaggttgcacctctgcactccagcctgggtgacagagtgggactctgtctcaaaaaacaaacaaacaaaaacaaagggatccattctggaatagtacataactgatttaatcctaatgtaatgtcaaaacaactttccccagcagttaagagaatgcctcatctatcacagatacaattgctttgtagatgccatgagctcttccaacaaattgttgggcagttctgttcgtgaattcacagaattctccatcccagacacatttctttggggtaattaaaattaaaatggtcttttcatgaaggcagtatgaaacaatatgcatcatctatatacgctgagctgaaaaaatattgtattcataaattaaattggacattttgaaaggttaacacaaaatgctactttgctcttggtaatcaataaggaaaaaaagacttcaggtaattaaaatctgtgaagtgaacatttctcatttggaacctattaagaatataagcagacagaggcaagagataaataaggaaaacaaatgaatcaaaattttttgttatgttttggcaagggaatgtaatgatatatagcctgaggtctgaagtgatataacctgttattgcagataatacaacatttacattacacggtatgtataaaacatatgtatattacttaatttaaatattaggccgtgattttaaaatatgactgttctatatgtcaggctccagtttaggttgttt

SEQ ID NO: 116688 - DNA, 1027 bp, Homo sapiens
agcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattggatccctccttctacttgtttgttccttgaatgatgcctttatttcaggggctacttgtactctgctgatttttcaaaatctttgtggacagaaaagataatacaacatgcacaagagaaggcctgggaagctcaaagaatgcagagttagaaatggccaagtatctgggcgcattccagttattctgatgagagaatagtgagatttcagcctagtctctgtatttgagccttaaaataggcactatgacaagccctgcatcctaaaacgactgttaaatacaacaggagccaaatacaaattgtattcttttactttagacatagttttttcaccccatcaagaaaaagaccaaataa

SEQ ID NO: 116689 - DNA, 1007 bp, Homo sapiens
aacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaa

SEQ ID NO: 116690 - DNA, 1043 bp, Homo sapiens
acatttttcaattccttgtgtcaccctactcaggacgcaagttcctgggagaaggaatttgattggcttatatgcctgtgctttggaaagaatagagaatactttgaccgacagctccaagactgcatgagataaggaaagaggagttcttcagagtattttttttgttggtttgttttttagcctaaggaagttaggtagtgatgcaaaataggcagaaacaaccactggccaaaaccagggtgtatttcactgatgaacagtactgtagaatatgtggaatagttcaaaacaaagagaagatttatgcagttaatcctttaagtgcaacaggggcagaggtcaatttaccacttatatttctagtgtgttgtacagtattattttatctttatctagtactcttatatttttctagtgcttttgcaggtttagctgtggtcaacaaattaaagaatgtggtttatatttttcagttaagatttatctcaaatttaattacttttctttcttttaatggatataatatgaaaaatcaacgactccacgacaaagaatggaaaacatcctgtttcttaatttccagctttatttcattggcatcaacagaatataagacatgcaatagactgggttaagtctcatttctgccactgcccaactctaatcagatctagggccagtcatataagtgagtctgttttctcaaatgtaagagagggagttaggctagattgaggatccaaagacagttacaaggaacaagaaaattattaagatgttataatttctgtttaaatttaagttaattttgttaaagttattttttttcctgaaaaactttctgatgccttaaatatgatactgtgtattgttaattcttcaaagcgagtggtgcaatatacagtgctcaccaaatttattagacctgggaaccctttttttatggagcattttgagggaactgacttccatggattaggttagattatttacaaaatcccattcacatttaaagtatactaagtatatagttctcctgg

SEQ ID NO: 116691 - DNA, 1034 bp, Homo sapiens
aacaaataacatgtgctctgaatcatttttaagaagaatgtatattgtttttaacttgcccaatttttagtacctccaatatcaggcttctaatgtaaatttgctttgtctgattttttttttcacagacatttttaaaagttcattttctcctccagtaaattgttacaaattctgactaaaatctgaattgattaagttttactgcatgttttgctttaacagtttctgttggtcctcaaccttgatttcagacatacttgcttcattttaggtggaatttttaatgggcaaatctaagtaagcaaggagagtaaattggaggctaaaaatgtgaacaggcaaattttttacttttagtatattgcttagaggtcttactatatacagtgggggcagttcagttcagtcagttttgaagcagtatgatgaatactgcaatgatttaaatgaagtttagtttagccttttgctaaaggtttactcatgctttaactaataactcctccggtaacacttgttctgatggttgtaattagagtgatttagcatatattgcatgtactaagtggcaggcactgtacctagcactgtatctgttttaaattgttgaatcctcatctgtgaggccggtactatcattatctatcatatagatgaggaaactgaggctcagagaggttaagtgacttgcctgagatcatgtagttagtactggggtcaggatttgaacccatgtagtttgaccccaagcctagagtctttattcaattatttcataataaatattttaaaagacgttaaaagtagacagatttcaagcatcattggcaagtcgttatctaagttctaccttcaccttggaacttaggtagaccctgttctcaagacagctaatgggaaatgtatagggaaatttcatgtcaacttattcctgaaatttacatactaggaagtaaatgggtttatagaacaaagcagagtactattgaatggtttgtggggtcagacatgatgacataatgaaatgtgtc

SEQ ID NO: 116692 - DNA, 1048 bp, Homo sapiens
ttttgcattttttgaaaagttaaggcaacttgaatatcccagattgatattttagttcagtaaaaaatttcataaatgcataaagattaagttttaagaccatttcctatattcttaaggagcattatgctaggattactatgcataaggaattcttcattcctcttgatgtctgatttttcagtgccttactttagtcatctacattaagaattgttttgctctggacagttcacaccaatcaccttttttacatagtttttcttattgaaatagaagagtgtcaaaatggcacaattatcaaagcaggaggtagtctttttcactgttcattgtcttttactcttgcaggggaaatgacttgtaagtacaatgtactttctgacaatgaaacactcgatatttgcttcagtgtgtgtgtgtgcattttacttttgttattgaaaaatgtttttgattactgaagtcttattttagcattatttactgtagcatcaacttctctaagattgaagaggtttataactgaaatgttctgtaggactgtggtcaaatactggtgcacctcctctagtttttcaagtatgtgtactagcacatggtgttttaagacacacttgtattaatacagaagagtggaagggcagtgttgggaaaccgacaaattttaacgttttctaaagggaagagaatacatatggcacaaaaatcagatagtaagtacccagatatagatgcaaagtacatcttagtcaccaaaaactatttagtttttctttgtaagttttgtgttattttgaaaatagaatggaacaattttctccccttgaaagccagcatattttttaagaattatatcgggtctctatttgaaaatagtccttctattcgctttgtatactcccacaggtctttagtgaagctgcaataatgcacctttttatttaaagaatgagtttagggaattgtgtctgtttcaagttgtccctagtcattttttaggaaagcatgaatgaatttcaagggctcttaaatgaaggttaaataa

SEQ ID NO: 116693 - DNA, 1048 bp, Homo sapiens
ggttaaaagtttacttgttaaaaaatacatttattggacagcttaatctgagctgagaaatgctgggggatgcaagatgaaaagatattccctgttcttagggagtgacctttcactggggagcagacatgtaaataggcaattaaagtataagtcgacaattgctgatgatgaagataaattcagggagtagtgagaacatggagaaagttgtgcctcacctgcttggaagaatcaggaaatgcaaccacacacagtgggtagagatccaagttataccactcagtatgcttagcatcgactttcaccccagcttgccagacaaacaagaacattcttttttctgactcatttcttcagtccaaatgtccctacccactcacaacttacacggtttaagtctacagggatttctagctcctctccttctccagaaaacagaattttataataagtcagatttcaccatcacaatgataactgtcacttatattggaattgaatttaaaaaggaaattgaacagtaccagttttattatttcagtacatatttcagtcattagtcatgagaaaacatgcaaaagccttgatactatctcacatttgatccataaaacaagaaaaggaatattgagtcccacagatgcaggaagcactggcatacagtgaattcacacttctcaggcagcatgttcttgacttttattgcttttttactttgtgaaagaatctcattcagcatatgagaaaaaggaaagaggaggacttcatttgtgggacagcaactcattagttgtctcactgtaaaatactataccaatgtaagagaaaattcttgctagttttgaaattttcttactggcttctcagattaaaaaaacaacagcaaaagcaaaaatcaaaaatgaatagagagcaccaagatgaggaacatacccactaactaactagttgattgcctgattattagaaattatagaattcattcagcttcataagcaagatgttattattcaaatatacccatagcgcttatgactggtttttc

SEQ ID NO: 116694 - DNA, 1790 bp, Homo sapiens
aatttttgtgtggcatatcccgttccctctctcacaactcccctccttccttctcatgtggaagtcgaggcatataaatatttcacggctttctgccgtcgttaatacaaattttttggcaaaaataacccatcgtttgcaaggagatgatttgcttcccctttgagatgtgcaagtctatctgccatgcaaaacaacaaaaacatttatgtcagcatctccttcatcagaaccaaaagggaaagttagagaaacaaaagaaatcacctccgtctgcttaacatattgtcaacaatttcagacctggacaaaatcttaaattttccctgcacttaaggcatctcattacccttcaaaagactttggaagaggaaaagtttacttctccagagacagtaatgcagatgttttcttttctatcatttttagtaggaaggagcaggtgtaaaacaattttgattaagtgtacgttatttatttatattcctctgtcaggaatgttggaacttagagagcttcttaaggactttggatgtgacaatactccatgaaacagtgcagaaaatacttggggaaaattattaaatggtgacctcactggtttttctcatcattatacttgtcatttcctgttgtgctgctttggctgttggaagggttcagagcaggtgtagttgggggggcggggagggatgatgtgataagctacatcttctcttgtagcttttcatcgatggtgacatttctattagttgtcatcacctaaagtgtccctagttctgccacttaccatcagggaagagtagaatccttatttttttttttttatggttttagccatatttttggcttccacccttccataccagtcactagacaatcattatgacctccttgtgcctctaggcgttggacactctgccagctttagccatttggttatagctgctcttcacttgttgaaattgatgtgatgaatggaaatccaggagcagaattagccgtagtctcagtgttccactaaatcgtatcatttggcttctgaaataattcagtcaccaaatatgtggtgactattttctgcatgttccatgtgtgaaactgaaagtgttatagaacctttaggacaccttatttttcatttatttatttaaaaactgaggtataggggaagtatttaaacccaggtctttaacctcacatgcactactctttcagaccttcacccccactccaacccaccccacattgcccttcatggtgatatgtaagagctgcaaaataatgaacaaatgttggggattatttttgtttttattttattttatttatttatttatttatttatttatttatttatttattgtgagacagagtttcacactgtcacccaggctggagtgcagtggcatgatctcgtctcactgcaacctccatctcccgggttcaagcaattctcctgcctcagcctctcaagtagctgggattacaggcgcacaccaccacatgcagctaattttttgtatttttagtagagatggggtttcatcatgttggccaggctggtctcgaactcctgatctcgtgatccgcccgcctcagccttccaaagtgctgggattacgggtgtgagccactgcgcccagccctggggattatttttaaccttccgatgttcctccctctgtgtaacttttctcttgtccatctccttttccttaagcccacaaatgacctactttaggctcttgtcatgtctatgcagtcataagaagctgaagtgaagcctt

SEQ ID NO: 116695 - DNA, 1008 bp, Homo sapiens
tgatgattctttttttggaaaatgtcacgcaattcagggagatagaataattgtttaactgaaagcatgggtgggatgtgttaaaagcaatagctgggcatggtaacgtgcacctgtagtctcagctacttgggaggtggaggcaggaggatcccatgagctagggagttggagtctaacctgggcaccataggaagatcaggtcactaaaatacataaataaataaacaaataaatgacatagtgtgaagcaagttcactatgcactggttaccaacttctctgagtctagtgagacagaacacccaagcacacaagttatacaaagcgggtttattatctatagataggcatcaaggaataacataatcctagaattaattgctagctagctggtcccccatggttcaagcaagctgccaaggaaagatggaatcttgtccctgcatgccccacttgtaccccagctgagggaccctggagatccacccaccctgggttttataccctgagtcatgagatcttctgggctaaagtgttgaaggacatcctgttctggggacattggaactaagtccagctgtttcagccaggtcccctcttatctcaggatgttgcattcctagcacactggtacagttattcttgagagctacaagcaagaaagagcataactgagtcagtgcaaggccactcagagaactttcctgtacatagtccttgctatggatatgttttctcattttgccacaaataaatgatatgaaaaactgataatgttcagttgcaggaatgaaacattagtgttagatcttggtggggggggtaggtggggtcaaatcaatcacaaaatgcttggaagctttagggtccagtgaaggcacctgaggttccaggtaccttttagaatgtgaacttaggttcacattggactaaaacttttttaggtatgattttaacattaacccacagaaaattttaatctgttaagtttggtttaaattttat

SEQ ID NO: 116696 - DNA, 1134 bp, Homo sapiens
aatactctgaaggcaaaatataccagttgtggccaagagagttagaaaaaagggtctacagctcattataaaccttgtacaggtagttactgaagttaacctgtttgcccatgaaaattccttaaaagtacatgttaatattctcctgccacttaggagtttacaaatctgaataagtacattgtaaatgtaagacttcggttttccagagtcttgtaatatacttgtttgtttttgtttttgttttttcttggtaaaggaatttaggcattggagccatggtatttaggcaactttttcttttctgcaaaagcaggctggtaggaacagtgactattggtagggcctagctaaagagaaacaaggtgtggaaaacactgcagttaccgcacacattcagcagtctgggtcctttaacttttttttttaatcagtaattcacttcagataacaactctagagataaaatatgccttaggggttggctgaagggagagagaacaaaggttttattggtctttatctcctatttagtagaaaatatttggttgtaaaagataaaaaaaaaacaaaaaacaaaaaacaactatggtgtttgctctagaaagtgaacaaataaaagtaattattctggagagacattatgtaacaaataggatatatctccttttctctaggtggtggcttcaaatctaaaataatgtatatatttttaagcatttttttagctttcctgttgaaaaaaaatcttacaagaatagatcttaaagatgtatttttttttttttttgagatggagtctctgtccccaggctggagtgcagtggcgtgatctctgctcactgcaacctccgcctcccggttcaagcgatcctcctacctcagcctcctgaatagttgggattacaggtgcccgccaccacactctgctaatttttgtatttttagtagagacgaggtttcaccatgttggccaagctggtctcaaactcctgacctcagatgatccgcccgcctcggcctccgaaggtgctgggattacaggcatgatccaccgtgctcggccaaggatgattttctttcagagtgaaattgagagccctaaggtatccttaattttgttaaggttctggt

SEQ ID NO: 116697 - DNA, 1044 bp, Homo sapiens
tgtgtgtttggctctggcaaaactttatctcattgctctattttaatggcaataatcactggaaatcagcacaaagtcttcagcttcttaacctgggtgacatgcttcagttttgtgccttctgtgactctctgtaatgatggcctacaagaactgtaaacctcctagaaggtaaaaaaaaacaggctagagtattgatttcaggttgtgtgaggaagaaacaaggtgggggtttttgtgttttttgttgttgttgttgttgttgttgttttgtttgttttgttttgcccctcagcttgcaaatcagttgcttatacccaggcgattgcagccatttacaccctactgaggagcctatgtggggttctttaaccactgagccaggattgattgacagccactgtcttcaactacaacagagatggagtgagcgcttatacagactcagtggggtgggacttccctgttgaatgctgctttatgtcttttcaggcaaatgccatttacatctgcccaccatttgaagtctcttttgactttctatttctttcgaaaggaagtaaaacaagtgttgcaggagccacagatagcatcatggcattttcttcattttctcaaaatgcaccttttgggtgttttgtgagcaagatcttaaggaaagtaggtcttttcagatgaaaattttgtgaagtcttactatgatgtaagctaatgaaaatttgggggaatgcattgtgagtaggcagggctataattgttttttagccctttgaacaaaccatgtctacatataacatgttcatggtgccacattattagtcaggttttttttaagaaaagtaatatatgtatgcattgatagataagaactattttttttatgatagttttgatgttaaataggcagtggtgataaggatgaatttagagctatgctattagatgatttagggcacttaatttacagattaaagttgaaactaaaaagattgttgtacttttaaaaaagcttcaggttggaatgtaacactttataaatggata

SEQ ID NO: 116698 - DNA, 1044 bp, Homo sapiens
gctgccatcctgcacatgtctagtccttagttcctgccggcattcacccatgcaagctcctagcttgcaggcagctctttgttagaaaatgatttggggctgtttttctgtttttcattaaaaagaaaagccttatcaaggactcccatgcccttgctatctgcctaatttcttcttaactcctatatcataaggagaggtaggagattaagtcagtgaagtaaggaaagaggagacgggaggcaggtcacgtaggacctcatagaatccttgtagagacttgggcttttactctgaatgagacaggaagccattggagggtctgagcatttgtttctcctcctttgaagaataatttttttatttgcttgacaataaaaagggttagcacatttccatttttagggttaccattggcctttgtgttgatggttccttctggcagaaaaataaatctgcccttgtatgtcagcttccttgggtctcccacacactcgtcaggttgtggagaagtttgaatttaaaacaagcatttcacaaatgactcacgttccaggtgggatgatgtgttctctgcctaccacagagaagggagaaatcagttcacatgaaacagtaaccttttctttctctctgcattttcctaggagcagaaaagcacacaaatgctttctttctgattgtgtatttggaatgttccttaagatggatctctgttgaattcccaagtgaatactccaatctgtatttagtctcaaattctgacaaaaaagaaaacctctacctgatgaggagccccgtctctctgctgttttctttaggtctggaagatcagggatgcttcataacttggtgccagaagagaagggaagattgattggggttttatgaggtggcaaaatacatagctaaacctggggacagggatgtcatttagcatgacagaaacagcagaaaacaggaatagtgctttattttgttgtttttgttaaagcaatgtgagacttgttatttctacccccgtggtcctggttgtttttgtgt

SEQ ID NO: 116699 - DNA, 1037 bp, Homo sapiens
ctgcccaccagtcccccaggctttgcctgttccattgttctccacagtggctgcccttctattaagcatgatcaggactccggagctctcctctccagagatgtgtgtgcattatcaactctcctactaacaccaaaatcctgtcaatcacagtgacctccagggcctccagcaagcctagtaaacaagggaccgatgtctgcaatggctttttattcacttttttttttttttttccgagtggggctttctaattactcagttgtgtatgcaaacactgaaggagcattaggcgcatcaagtgggcctctgcttttattaggaaacccttttattttctaaatagaatatgtcaaacatagtctttcctttttagacagttaacctttcatctctcctgtagcagaaattccagtctctggggcttgctaattttgtatttgaaatattctaaagcagaaggaaaatgctgtttacagtgccttcattaaaaagcttttaatcctgttttgttgttgcatatatagtttggatccctgctgagtacacttcattgcataagaaaaatacagtatttttaaaagatataccaatcaacccaacccaattctactttgaccctgacaattgagtagacaaaaacgcttttatagtgttcatacttagcagattataatgaaaatatgagtttaatagatccttaagaatgtgtttctaagtgatgtacaaccttatttttgaaaaagtcttttacgtagcctgcttcgtttgttctcacacattatcacatacattgcataatataaccgtaccacttgtaatatgacttgtcacagaacatgattcagacataatgcagcgcaatttgtttgacgttgtttcccagtgattttcatatcttggcatatacagaaaaccaagatctttattgggcacacaagaagaggctaaaaggataataatgatagtgagcacttttaaacttttctcatatattgaatttaatattcacaacaaccgtatgaggtcagtactat

SEQ ID NO: 116700 - DNA, 1044 bp, Homo sapiens
aatattttccttcatggcaaactttcattatgcttttatttatttatttttcatgaaagaaattcaggctttatagaatcaggctccctttgaagatatactattttcctttgtatcaattttgttttcctttagaacatcatttggctgataaatttgctagtatcctgtttagctgtcagattttgataagctttctggggagctcacatacactgttcatttcaccccaattcagtgctgttctccttatatgtggtctaccagaagtaacttgaggttaaggtttggcacttctgcctggtgttttggctttggagctgcaaaacatatcacaaagcagacataatatgtgtacaaacagctagagacactagtagaatgttgtcagctaaaaagaagaaaagcctctgaaatgtgaaaagggaaaaattgtgctgagtgtatttagaatagcatgtttgagtctattattgcaaccacaactagtattatgtatttaaagatgacctagatttacattctttattgtcatttgctttccaggactagacataaaactaattactagctcatgcagtttgcatgtgttgctttctcttagctcatgtgtttacatggaagcagtcccccatatacacaaaaggaaagaagcctcaagtaatgttccttacagaaggaagatagtatcagaccccttatagtttatacatcctcaaactctatttacggtgaaagtcaagatcttgaagtgtttgctgctcttaggtttaattggttttatctgctgttatcataacaaccttatctctgcagacagttgcatggataatatttggagatcagaattcaagctcagacacacagtgtcatccagcaattaaatgttatttgatatttctgtgtgtggctcaggtgctggggagatcctgcctctggttaacagtctttatagcatcataaaatagttctcaggggaaatccagatatggaaagctttccgaatagaaatggctagaaaagccaaggtaaagtgtggttcag

SEQ ID NO: 116701 - DNA, 1091 bp, Homo sapiens
tgaggtgcctatatatttaaaagcctcagtgtttttgaccactattaattgttaatccgaaagaaaaataaagcattctggaaaaactatcatgtaaatcaattacaatttgggctttctttttttcttactctgaaatgtgtcaggaccactattttaggaagcaacattcttggcatactttgaatgaatttttacttctctagagctagattgcatagaaaagaaatatccagcctgcaaagtaaagcattctggaaaaactattgggtaaatcaattacacaattgtaattgcaaaaatgtgtatgtgtaagtgtatatgttttcttactaagtgtgagaattgtgtcattttacttaattcagacactggagggtttggggatcttaatctcgtctagagcaaatcctctcgaagacttttacttggctagacttcttccactttacactgttgaacttggtggagtactagtcctaccaccataatccaccaaagccaacacacctttgaaagactgcttcctacagatgaggaaactgacaggtggtttcacattttgcacatctggctttaaaacaaaggactgatacaacagatactcagcatcagcctctttacttctgctagacactgctcctactaacagctcacgtcagctgtacatttcagtgctgtgttatttatgtgacagttccttgtagcccgttgtacaacaggaatccaagcacgtatttcccaaatttcaagttttacctgtcaatctttttagaaacttactcaccttgcaaaaaaactatctgaaggtatatctacagcattcctttatttttagttattgctcttataaaaataatcatattaaatgtgaagcaaaatttcaggaaaaaaatattttgaccattaatgtagcattgcatatgtgatatccaatttttccatactgttctggtgtgaaagggggagagattgttttaaaagtccattgtttaataaaatttatgttggttctaaacttcaaaaaaatttttaaaaagtgtaggtagtctttcctcactccacctcaactgaaataatgaattggattc

SEQ ID NO: 116702 - DNA, 1049 bp, Homo sapiens
agcaaaatctctgatattagagcctctttttaaatcccctttgtacagaggagaactatagtacacacacagataagagccggcagcgtgtagaagaatgtcacactaaccaggattgaattcacttctgtatatgtccattgacaaatgtcattgtttagacatgaggaaacaaaaatagcttttaccacattgccccaggcaccgcagtctcggaattcctgtcaaccctcaactctgccagtgggctgcgtggttcctgaggcagcgtgtggctgaaactcaagctaggatgcctgccacctgacctccaggcttccctctctcgccccttctcatttaacaaatgtttgctaagcacctcccacgtacctggctgaaactcaagctaggatgcctgccacctgacctccaggcttccctctctcgccccttctcatttaacaaatgtttgctaagcacctcccacgtaccaggcattgtgctggggaccaaggcaaatatgtttacagccacagatacgatctgtgccctgtgtagcttacagttcaaaagggacatataatgatagacatgctgtgagaaatgagggagatgtaggtggttttaggagagggatttggaacaggagccttaaggtttgggcccaaacagccgtttaatttcttcctaagtattccaactttggtatgactagtctgccacataccgggtcatttagggcaggtaagatgtgctggagggacctgaatgagatcaaaatttagattaaaaaaaaagtcttcctgtggcttttcattagtggaatgtgaaatggagtaatgaattggctttatgagggcatttgttcaggtgacttcctcttgctgcagaccactggatttgagatagttatttattttattttatttatttatttatttatttatttatttatttatttttattttgagatggaattttgctcctgtcacccaggctggagtgcaatgctgcgatctcgactcactgcaacccccgcctccccggttgaagcgattctcccgtgc

SEQ ID NO: 116703 - DNA, 1047 bp, Homo sapiens
caagcacacacgctgagggtatgtggtaagattactaagaatgaaaagttggaactctttatgttcagttcttagagtcagaatttatggaacccattcagctagttaaagacttcttagatcagacagtgatataatttaatgtttgacatttattaccatgtatccttaacaaattaataattttaaatctgaaaaaggacccttgagaaaactagaagaggacaaggatcaggtaagaagccctgcagggacctgcccaggtcattacagatggggctgttaggatcaaaaaaaaaaaaaaaaaaaacaaaaacccaaacaaaaacaaaataaagtattccaactgtggtttcagccatttcttcttcaatatcttggcacttgacaaacatttgttgggtacctgtattatgagttaggtgcttttggggaatacaataccttttacatcctaataacagacacaggacaattagagtatcatccgctaattgcagggcaaatacaactaataccatcaagcacataccaaatgctgtatatgtgtgaaagaggaagccccatgttggcgggaaggtcaggaaggatttcttaggagagaagggtgtgaaatggcaggattttgaaaatgcagaatggagggaaggctaggagccaagacagagacaagaagttctgcctttaacagtaatttgtcaagccactttgcctggagcatattccagaaaatgatttatgctggacacttgggtaaatagacccagctgctggagggtgggaagcaacaggcctgcagagtgtccctccccaaccccacagcctccctagctcctgcccagcccctgcccatcccctctgcaggctgaggaggaaaatagcaggcgtaatccttgtagagcacagtagttgagaccactttgactgagggagggaacctgatggaggcaaatagtagtcccaaggaggaggttctcaaatgataaactgagaagttgtttgtaccaggaaggtagagggagggttctgatgacttgcgaacaagac

SEQ ID NO: 116704 - DNA, 1049 bp, Homo sapiens
tccaggatatgttggaaacctttttttagagcaagttgaggacccttggtaccttttatagaagccagagtggtgtgcacgcttttcactttgcactgcagccagcgcacctgttcagtgagaggaatcagctaaattactagacgtaattgatgtttgtgcaaaagatagaacatttgtttttctctccttgtggttaatgctcaggttgataatttaaatgagtctttttcctctctcttcctatccctctctacattctattacacacattgtttccccttagcctttgtctcctgggcactaacagttgctaaatgtttcttacagaggataatatatttgggaaacaatttccattcaagattgtaatgctacctggcccctttctacaacccaggcaatgaaatgcagatacgatacagttatctttcccaagtcattttaaagtgtatgcacgtaatatatagtttttaataatctctctgctgtggagcataaactggtctatgaacaggatggcctgatgaaactcactttcctgtaaacatggctcgagcggaatcagccaatttcaaggcagattagtgtcagtgcagagagactaggataaataggggatgaacatcacttgaagaaaagaaaaatcatgagaagatcctcttccaggacggaaggatacaattggggtgactagaatgggccttctagttatgtactctaaatgtggaacaataggccagtggacctggtgtctatctctgttgctttttttttttaacgaaaaataatatctggttattttcaagactaattcagacaacataagcagcaagtagaatttgaacactctttccagataatgggttggtttgattaacttcttgccaacccatatttttgtatgagttattacatcagccaagggagagagtcattgggagtttttagcttcatctctgcacaggttaaattatgtagccttcttcccaatttttctgggttagttactttcttttgtgcacgttggtttgcagcctggtgcctgg

SEQ ID NO: 116705 - DNA, 1022 bp, Homo sapiens
gagcccaggaggttgaggctgagtgagctgtgaccattccacggcactccagcctgggtgacagagtgagactgtctaaaaaaaaaaaaaaattatgtctatatctagagttcctagatcaccaacatttgacacagaactacaaattctgtctcttaatggaactgctttggaagcattccaagaatgttattcttcctcaggttgctgtttggaaggtagagtttagaatataggaaggaattactccaagagaggagatgagttgtttcttttagcatttttttctaaaggtcttgaaagccttctttagccatttctttcgtcctcttacctgctttggtagatggctcaatatgactatgctactctttataccgatgaggaaacaaggtatggaagtatgatttgtctatccaaatcaccgtctccaatgagagtcatggaagacaaatggctgtatctctggtcttacgtaaattctctgcggtccatgtgtttacataagacaagggaatatagctattcattcttgagaaaaggcaggagcactttttctggcagggtttctagaaggagatattttggaattttaactaaaagcagaagaagaaaaacccaagtcatttaagttttcttagcacacgggtaaaactcagtggaacagatgctttagtacctgagaccattgttttcactgaaacccctgtcctcttccagaatcaacatcaataatcaaggtagagagtaaacaaagagtgttaaaggatgctgtctctggccttcttttttctttcttatgatgatgataaaataacaaagaaacagataaatggcctctttcactccgcattgtgggagctgcagggaaacaagttggtggatgcttcattcactagcattgtacctctttgcagaagaaactccatgtatttcaacttcattctgcagtttttaaatgctaactatggcaaagagtaacttactcctttgttggtgtgtgtgtgtgtgtatatatgttt

SEQ ID NO: 116706 - DNA, 1059 bp, Homo sapiens
ccgccaccaaatctggctaatttttctatttttagtagagaccaggtttcaccatgttggccaggctggtctcgaactcctgacctcaagtgatgtgcccacctgggattccaaagtgctgggattacagtgtgagccactgcacccggcctcaatacatttttattaagcatctaccatgggttaaattccttcatctatatgaggggatctcatacatgccaataaaggcaaagcaggtaacacaaaggaagaaaataggatgctgtggaaagaatagggagaggtggggactgtggtcagctggagagtacagctcccacctccaggggtacctggtgttcagctctatggctgggcatgaatgttaatatggacagtgttgccagatgctaccatatttttatgagaagctagttacctaaatttttaggccatctccacattgacttttaaatgttggctcaagtttttaaaaacattatgtgccagccgtgtaagatacctatgttggctgagggctctttgtgacctttgatctttgtagctcccctgcctcccagcccaccctacccaaacacgtggaaaacatttgatcagggtagcttactttaaaatttattctcagcactgagaattccatgttaagtaattaaaaattattgaaacaacagatggtagtaaaatatgtacaatgatagctttgcttcacacatacactcccctcttgacccacccacacaactgttaaaatttttgcattaagaaccaaactggttacaagcgtctatgattattggtgtggaaaatgcacataaatacaggcacataaactatccagatgactaaaggagttatgtttgcattatttctcaaaacaatttctgaaagcagttgtggttgcagtgagttttgtccagctttatgactatggaacaagtaagattcttcctttatgtgtgtacaccatttacctttaagataaaatcatgtccatgaggccaggtgtggtggctcactcctgtaatcctagcactttgggaggctgaggtgggagga

SEQ ID NO: 116707 - DNA, 1100 bp, Homo sapiens
tccactatggcttgtgagctgaattccttcgcagaaaagaatggcagtgggctctccggcttgtcatttgggtggagacattaggaagtgtgatggcttactcccagtcacagatttcacttcacctccctgtctgtgtacagctccactgcaagcactgctcacagatgccgattcgctcacattgaaaaggtcctattccagctccaggatcctccttttctgaagagcctgtccctgcatctctttggcagtcatgttctgactgcggcctggtgctcccctaacctgcatggaataaatttaaagctaagagataacatattgttggtctgtctcatttcctcgacatcgagaccagtttttaagtaattttagaagcctagtttgagagaggtctttttttcagattaaaaacatgagagtattcatagactatttaaagcatgtccatgttgccaataatcatgtgatatttcgcttcactttactgaagaatgaggggtgtatttgcatccatcagttgacttcttggtcaaatttatataccaaaagtgtactgtgatttagtggagattgatcattggtataattgaagtttatacaaacttatttttaaatgttggaaatctatttgaaaatatacttgaatacatttataaaatttatagtacaaaaagtaactgctttggaaataaactggaatatattttgggcttgcctactctaatgatatttaatgtttgattcttcattgactcatttattctatatattctatatataatatatataaaatatatttttattaaaaattaataatttattattattataaatatatgtttaatgtataatatatataatatataatatatattatattatatatattatatattatatatattatatattatatattatatatattatatatattatatattatatataatatatatattatatattatatatatattttttatattatatattatatataatatatatattatatattatatatatattttttatattatatatattttatatatatatatatatttttttgagacggagtctccctttgc

SEQ ID NO: 116708 - DNA, 1014 bp, Homo sapiens
aaaagatacagagtgagaaatcttgctttctgtccctgtctccattaccctattccccactgccccatatatgaagccacttttattagttttctgagtattctatttttgtgcaagcatatgcaaatatatgttttataatccctactttcttacttaaaccatatcatactcagagcatatctctgttctgtatcttgctttttaaattggaaatatgtccatacctggataaagagaccttcctcattattctttacaacttcctaccactttattgtatagatgtgctatagtttgtttaggagctccctagtgatggacccttggatcgtttgcagtattttgctgtataaacaatgctgtaatgaataaccttgtacacacatcatttcaaatatgtgtctactgatctttatcctctggttcccgtgcccatttcctcgtagacttcttaagtcacagaaaaaccaaatatgcatgtttttatttcccttaatatatccacagtgacttcctgactagggaagccatgctttgaactgtaggatgcccccaatccaggcgtttagtgtttcatttgactcagtcctggtctgtttgagcatctttaactcagtgaattaagctaagagagaatgaatgtaattcaaaagaaatggttcacagtcagatgtaaagagttaaacattgtggaattttgccatacagtgaaatattaaaatttcatttagatcattcggcatgttagataaaaagcatgaaaaaatgttgtattgagatttaagagtagagaatttaaatataactggccgtgagcaaaaaattagtgtcatagtatactggtctgagttcataattctgattctgaattctgacctttataagaccacctgtatgtttatctgtatgtatttatgggttcagaagttgctttgtgggtacatagccttccaaaggaaagattataaacttttcaagtaaataattctgtttcattgtccagtctttctt

SEQ ID NO: 116709 - DNA, 1026 bp, Homo sapiens
tacccataagaggcattagggggaaggagaagaatataaacacagaaaccacatcctaacagctgcctctagttagctctgcttccccccccatccccacccccgagcttttaaatcttgcagcggcacctaatttgtcccacatggctttcctcccagtggaaccactggcccttttcttgctgccctttttgatcaaaagcaaacagttatgaagaatcaactagtttaactagtttaggccactgtctttaggctgctggtgtgcaggtgcctatgaataggcaggagataaccatttgtagattgggagagacttaaaacagtctgaacctagttaggtgccagtggacctatgaaaacatcccgcaattaagcactaagtgagacagtgaaccgctgagtgaactaccgtgatgggaatagatgagtgatttttgacctagtggggcagatcagaatcatgtagggcgcttaaacatttcgtacacatgccaactcctgccactgacattctgcctctattttaatacgcctggcagtgatgaatatagatactacagatctgtgttctgacatgtctgcacggcaagtgggttgcaacttgcattatgatatttatttttttaagttctaattatttttttcttatatgtgttactcatgtctccattcctttttccatgttattttttgaatgcagtgagaccaaagacagatgcttgtagagcagtgtgctgaattaagttatttccttcactgagactagtgttctgtttctctcttccagctcatgtttatttcttattgctgttgagaagtaagacatgaaagccacacaaccaatgtgctcttcttgtgacttttaagataggaaattggtttggttaaaaaaaaaaatcagagccaggtgcaagcccatacatggtcccagctactcgggaggctgaggcaggacgattgcttgagcccaggagttcaaggtggcagtgagccgtgatacaccactgtattcccatctaggtg

SEQ ID NO: 116710 - DNA, 1098 bp, Homo sapiens
tagctgaaaagatacaagttcagctaccaaatatcatacatagtctatgtcatgatgagtattgatttaaacagtagcaaaatatttttaaaagtcacttgtaatataggttagtaaaatctgaaatctgtgaaaaaaaatataattcgttttaaaggtttgtacctgaaatggccagaaagcaaactagacagtgttgtcttaaaacaggttttttaaggtattgattaactgggctcaaactctactgcaaatgtttgaagaaggaaaagaaatgtgtgcagtgccctctctagcaggcagcgagttagcctactcgccgttttatttaagtgtgtgcgagtgtgcttcccacccggggtgggagaaggatcataaacctccaccattttctattctaatgtatcaaattgtgttattagtcatagcagtctggttcagaaatgttttcatttgtatttgcagacaatctcttttaggatatacacttcatattggctttcactgcagtggcagatttttagcattttaaacacaactttgaaactcaaggctaatggcagagtgaccatattcatgtttttgtttcaattgtttacctattattaatatagttatattagatctctgtacctttgagaaagattggatagagaaacaaagaaaatatcaatccccttaggataggagaatacagatttgtgaaagaaggggtaagaagtattttaaaaagaaattaacaatggagagaaaaaaattagggcgctgttcctggcatcagcaaactccaggagaaacccttttctattcattgatctgtaaagtctgtatttaaaggatatcagagtgcattgttcacggagagaggggaaaagatgggaactaatatttatagagcgcctactacagctgtgatattttgtagccctatgaggcaggaattatcatcttgattttatggaagaggaaattgaagttttagagatattatgtaaccttccaaagtcgtacagctaatatgtggctcagataaaaattctgctataccgcattactagctctgtgtgtgtgtgtgtgtgtgtgtgtgtgtgtgtgtgt

SEQ ID NO: 116711 - DNA, 1069 bp, Homo sapiens
agcggcaatttttcttccctgtttttgcatggatcagcattgggtacacttgccgtgttttaagacctcttctgcttaggaattatttttctgattttgacgtggatctactactcctgccgctaatgttaataaccaggagagaaagatcaaaggaggccaagtcacgggaaggcaggaggagggctggcatggcagacggttagctttaattaccagtcttataggtaattttaataatgacagattttagttgttgcttaagtgaatggaaattattgatagtaaattctcattgcttttgtttctttgtgtgatattggatgctggggtagaaactgtacccaaccatacatgataacaaccaagtgcgttttattagaaatgtagagaggatacccttttaattacattgtataattttagttggtcttcttcctatttccttcttacttaatttaacagccacttgatgatttgagattttttcttttataaattattgtagctgtatatgtatgtgtatggaatatgcaaggcccatgttttgcaggaagaactataacactcagaattcagtagatgaagagagcaaccaggaagttttgtagtgctccatttattgaatatatcacaattagaaagccactatttagggtttaatgaaaaagcctagagccctcccaattctagtaaagtgttctgttggctgggtatttggacattcacagaaactgatctctttattcagcttctggaataaaccgagcgttgggaccagcctgcttggggccatcattaatgccattgtggataaagggtgaaggctgtggccacatgcagctctgctgacactttgtgaaaggtgagcccagccatgaagtcgtgggtgtgtcttgcccagtaggaagataaagcacagccatgaagttatagttgacttggtgcctccatctcctgctttaaggggcacctctcttgggagctcaggaccttgctgctggtggcctcccggcaccatgacatgcaggggacaaagggaatattttgcaaagaacatattcagctg

SEQ ID NO: 116712 - DNA, 1042 bp, Homo sapiens
atttttgagagagaaaatgttacacaaccaggagtcttacaagaaattcatgtgaaaatcttggcatgactatcctgaaagctaagacaaccattggtcttggagaaaagactcctctccagagggagttgcaggtactcaaagatggtatgtgtgtgttgtcttcaaactaggcagaatgataaatggacacatgacaaatggtctgaacaccttcacctgggagaaaaccatctaaagctgagtgttatctcatatgactaacttattttttaacagtatatttccatgataatttaaaaataaattgcacattttacataaggtaatactttgtatatgatttgacattctttaaaatactacctgatgttatgaaaacacttgaaatttaaacattgtcaacactatgttaatatgtcgaatattcagttggtttatggtttaagagtaaaattttaatttttttctcagtatcacaaagcttccttctggaagatccatccagttttgtcttatgcctggggaagagactgaagttgctgtgaactagttccagcaagaagtattatccgtgtaatgagcagagcaatgatattgtggggatatggattatgtgtgtaaactacacagggtgtgatagttgggtgttaatctgtttttgaaggttcattagatggtgagtaggaacaggttctaggacgactgagttctctgaggatcaaaaggttagataaactgcttttaggatttatgcagggtactgattttcatgtcagtttaattatccttatattttacaaaactgtcaatcaggatgcctagaaatcgtatggaattggaggctctgaaaacttttgagtcttttctgattgggtttatctgataatcattcttttcatgatgaccttagttgaaatgaagagctgttagaactacaaggcctgctttagtgtcagaagaagatttaatcaggagtcttatcatccagtgagaaaaatgcctttcattctcttttcatttatttgaaattacttagtga

SEQ ID NO: 116713 - DNA, 1096 bp, Homo sapiens
ggattgcatatatactatgcacataaagatattgtaccaagaatgggcatggtacatagtaggagctcagaaaatctttgcataatgaatgaatgaaagattgtaggttgtgtgctgggtcttttttttttcttgaaatccatgattttttttgttttaaacagagacagcgtcttgctattttgtccaggatggtctcctgtgcctgggcttctagcagtcttccccacctccgcttcgtgagtagctgttatagtaggtacacaccactgtgcccagcttgaagtgcatgatttttgaatctgagttttttataggtccacttactttaagtagatgccctcctatcaggcaaaaaattaaactgtattgtgtttccacttctatttgaatttcactctagccgcaacagagcacttcagtccaaatcctgcattgcccatctcaagttctcccactagaaggtagaaaagaagaatagtacttatattattaatagttattaattcttcctatttccttttgaacaagtggaaactcttcaggcaaacttgcctctcaatacgcattttcttttcttcctattttacttactttcccgcttcattgtcatgtctgaaattgcagataatggtggcggggaaagctgttgtgagcattgggtggtggtgctggtggtgactctttacctgcttctctgattagaaagcaaacttccccaaaacaggcagaaatctattctatcaactttgatatctctccaggtttttaaaacagtgaccagcatctggttggtgctgaatgaatgttcctagaattaatggttaagtgagtaggaaatactgttccagttccattttctcctgtatttggagactctgtggttctctctctctctctttctctctctctctctctctctgtgtgtgtgtgtgtgtgtgtgtgtgtgtatgtgcacatgtaagtatgtgtaatgtttagtttttttatgggtttaaatttatggtaaggtaggataagagtagcggtatctgctgaattagggttaatattttctgtgttaaagctgaagatatgcagtgggcaaaagccttta

SEQ ID NO: 116714 - DNA, 1597 bp, Homo sapiens
ggtgggaggattgctggaggccaggagtttgagaccagtctgggcaacatagagatatcccatctctaaaaaaaattttttttaaattaattagccaggtgtggtggtgtgtacctatagtcctagctactacctaagggaggaagatcctttgagctcaggagtttgaggttacagtgagctatggctgcgctacttcactccactctgggtgatagagccagagtaagaacttgtctcaaaaaaatagtaagaaaaaaaaagaagacatactgtgtactattctgtttgctaggatgatgacttgtgaatttcaaatggtggttctgcatttactaaagttattaacaaccatttgtacacagcaccacattttaattggactaggacttctatttcactccagtacctaggtgcagccagtgcttcattaaataacactgataatcagttcataagatcttacttcagtgagtgatcatctgtcatgacagacttgaaaacaggtttgtaatgcatgaatttatcagttgtcataagcaagcaaaggaattggctttcaatgtgtctgtagctatagtaatgaggagatttgttgagcctatacttaatcttctatattgtaatttaagaaaaccaacttaactatgttcaactaaattgtacatttcattaaaatttgaaaatcatagtaacaagacagggatttctgagttataatcaataagactaatttaatttaggggtagctgaggagaaagatgaaaatcaagtactgtagtttgaattatggaaagtgtcatattttaatttcacaattggttctggtgtgtttggggatttagaataattttataccttaacattcaatctttattttccagtgaataagctaattttagatgattgctaaacctgtttctgcttgctgttatgcaatattagctttggaataatctggtaattcttacttaacaccaattaataaggaattagagtaataattttagatgtgaataaattgcttcaaattataacatgttttgtagtttatataaattgttattagtgatgggaaaataatcaacaaggcatgctgcctgctggtgattttttttttatttttctttgttctgctttgtacatatatattgggagaaattggtgattgaattcaataatcattctttcttacttattggtggtagctgcatataagaatgcatagacaatctcaaaaacctcacctgtgaaattagagtatataccagctggccacctaatgtcaaaacagccaatgaaattttctcagttgagtcaaaccaatggctattcagaaataaaaattttaaaaagtttccttctttattagctctgcatagtatttcaaaaattagttgctacagcgtaagtttggaagttattttggtgagtttccgctactttcaattaataaatctctcagacatatttacatgttcacattttgaattgcgttaaggccagcattgtgcatgcatgctggataaaaacacagaaagctacaggaatgttaaagttaacccagtacaaattactgaagctatttttgtttggc

SEQ ID NO: 116715 - DNA, 1377 bp, Homo sapiens
tttaaacaatataatggaagttcaaaggtagagattaaaaacattctatgcctttgaacattctttccttcctttcactagagacaaataaatgacactttaggaaaatcacttaggatgccgaagaaactacagtttcagataaaatagagctcttaccatttattttctgtatttgcagaaaatacaatgattatatgagatagtttgtccatcctttcttcttcgtctccttatatgacttgtttttagtattgtaataatgaacagaagtgatatcagcatcttccccagacctcaaaaatactacctttctttgtcctaaataaggccttctcttttcacagccttcagaagactaagggacagcttgcatgggattcacatccattttattttggcttcatattccctctttgagttacattgtagttttgctttcagcccattactcattatcaatgtaatatttagtatttatctatggttcccctggtataatatgttgtggtattttcaataatgtatagattagctacttttctagactatgtctagcttatagtctaaataggaaacagtaacaaaaaaacccacttccaatgttctatatacttagtgacaaattttcataatgaatggattggggaaagtggagcaaaatattaattctaggtactttttgttttgagtttcattttatatgctataatatatttttaggctatgtctaacaggaactgtctaaagtattacaatatgtgtaacttaataagcctatttatttttaaaattaaagttctccaggtgctggtaatatagagcatttgattcatatgagacttcttaagaggcatcatgacataactggcttattttagatgttagaacataagctttagaagcaattatcttccactagctgtgtagtcttaatcaagttctttaccttcttggtgcatcgttattcctatctgtaaaatagatatgataacaatacctatctcacagtgttattttatggatgacattgagttattatatgtgaagtgcttagtactgtacatggcatgcagtaagaaattaataagcattaatttttattatttgaatgatatattactatagatctagcctagttaatcttgatgctttattttaattcattctcattgagtaatgacatgtattttgaaactaagtatcgtatagctctgatggagataataaatgtatttcataattgacagtgagcaatgctaatgaataggacttagtctcttctagtaaaaacaaatgtttgcaacttgtgtaaacatcattgtggtaattgaaatggaaattcatcaaatataaaatacatgattcaacaaatga

SEQ ID NO: 116716 - DNA, 1024 bp, Homo sapiens
atgatgggatatggtaactcttctggaaatacataccttaaacagataaatcaaacacatctttcagattttctgtttcattaatagcttgagggtgtccagaagaaacttacatgtcatttggttaaaacttgtcatggcttcctgaagtttctcaccgttttggattattaatctataaaggatgtgataaagcattttcttgtattgaatttgaacatgctttgtgctttgggctccatgaaatattaaattctgttcgccatccttgcaggcaagctgggcaggaaaacttttgcacgcatatgcagcgtgtggggaggggattgaagttatgcatcttgattcaaggactttttttttctcatttaacagtgatgttaatctggaatacctcttgaggagagtcttaggagtcacacacatatatgcaaaacagatttatgtacacacacatatataaaatatgttttcatggtagttttattactagcattagttaagaactttagatgccttttgtctgatactctgatttcagcatcagttatagcatgcagaatatctaatgtggtagcttaagtgactcatttaaacaaaaatattttaaagtcataaaaaggataagaaaggagaaaatattttaagcattgatgctttaataatattttcaacccatgtcccttaggtttaactgtccctgagaagtttcatttgcccacaatctgggtgaactagcatgaccttgttgaatgttggctcactcctgagaccatccatcctaaggatgaatgcttttactaacctggacttcactgtcagtgtgtctgcacagagctgaattgatacatctccatttcttaatgaggagtttggtcttaaatgtagtgaaccctctcactgtgaggctgtctgttacctaaggctcaaaatctatcataattaccatttctcttaaacacccatcattaaggagtgcacaaaatgcttgccttaaaaggatagtttcatggagattgcttct

SEQ ID NO: 116717 - DNA, 1318 bp, Homo sapiens
ggttattctgtgtgtggtgggtatgggatagagaaaaatgggaaaatgttaaatcaccgaagtaatatgttgtgttttaaatgaaacgcttttataactgaaggctgaatttttactacctgagtgctttctatatgcttttacagtattctgcaacacaccacatgtatcttttttctattttattaaatccatttattttaattgacaagtaaaaactatgtatttatggtttacaatgttttgatgtatgtatacattgtagaatggctaaagcaagctatttaacatatgcattagttcacatacttatttttttgtgtgtgtatatgtgtgtgtgtatgtgtgtgtatagtgagaacgcttaagatctattctgttagaaattttgaagtacattcatccctcggtatccgtggaggattgtttccagaaactctatggataccaaagtcctcagatggtcaagtcccttatataaaattgaaatggtatcatgtttgcatataacatatgcacatccttctgtataatctagatcatccccaggttacttataatacctaatacaacatagatgctatgtaaatagttgtcatactgtattttaaattttgcatttttgtattgttatatcttacttttttaaaaatatttttgatccatgcctgtttgaatttgtggttgcagtaggtcaactctatacaatgtattgttattagctgtagccaccatgttgtataatagatctcttgaacttatttcacttaactgaaattttgtgttctttgactaacatctctctactttcttcacccacccgccccagtccctggaaaccatctttttactctctctctatgagttctacttttttagcctctgcatataagtgagatcacgcggtgttgtatctctgataagatttcttgtgtggattggaaagcaggaacccttaggttatctatgattagaagtagttgaaatgcaaaagtggactaaaaaagtaaactgttggccgggcacgatggctcaagcctgtaatcccagcactttgagaggccaaggtggacggatcatgaggtcaggagatcgagaccatcctggctaacatggtgaaaccccgtctctactaaaaaaaaaaaatacaaaaaattagccaggcgtggtggcaggtgcgtgtagtcccagctacttgggaggctgaggcaggagaatggcatgaacccaggaggcggagcttgcagttagccgagatagtgccactgcactccagcctgggcgacagagtgagactccgtcaaaaataaataaataa

SEQ ID NO: 116718 - DNA, 1298 bp, Homo sapiens
agaattgcttgaacccaggagacggaggttgcagtgagccgagattgcaccattgcactccaaactgggtggcagggcaagactgtctcaaaaaaacaaacaaaaaacaaaacagaaaaaagtagacagtagtcacttaaaatttgttgaggaaattcacttcttaaactcttgattgagcatctattatgtgtcagttaccaactaggtaattaacaaagattttttgatgacaaaataaacagttattcatgaaaaaataactggatttgtctgcttgttacagcaaaaaatatacaagtttctatttacatatgagatttctttggatgcaagtattttttctgtttaatgagcctattccgatagaccatgttttgttcactaatttgaataaataatttttgaaacgaagcaaaatgttctcatttttttctacataatgattcttttttttcctcattttttaagtaaacactaaagtttttctgaaggttactagaagataacaagtagcaatatagtatttgtctgacgaatctgagccaaggtgactatttatcactaatggaggatgacgacgacggatttaagaagtcatcccctgtattgtctccagcacaaaaaccttccgcctgcatctttcagcttgtatcgccacttctaaaggatccatgggcaaactgctgaatttttattaatcagcttaacttaatgagatgaaaagacttttcccaaagaatggagaagggagagacagatactgagagctactctaattcttttccatgaaaaaaacattttcctccctgattttctagggaagacatgttcagttgtttccaggtaattcatccgaaaagtctttctaattttcacacacagactttctctagccatgtgctgcctttattattattattattattattattattaaagaaaatagacagctataaagaagaattaatgagagttgaggggggaaatacctttgggaaagaaggcaggaaagcttaagctgataaaacatgactcttttttgatgggggctctctttggataacttgcccttgtctaaattcttctctcttctggtccttcctgtccccactcccccattcactccccctctcgtcaagcttacttcataaatggtaccagctggagatcttttagtggcattcagggattacttcccttcggggttttaataagccctgatgcttgaaacacagtgaaggtgcttctggagacaatcacctttcaggctgggaccatgggacccttttgggggc

SEQ ID NO: 116719 - DNA, 1077 bp, Homo sapiens
tctcaatttcagtggaatatatataataaaatactatttctggagaaacttagagaactgacccaaatgtctgtacttttctcatacaggaaaatcccatacaatgaagctttttaaataagctttaaaaaaatttatttgtggtcaaggacattctatattaagaaccactttcagtgatagtacccactgatagtaagtagaagtatccccctcaccatgtaaatatttttttcagaagcagttgaatgttttctcaacagcttcccatttcaataagatatgcacaaaatgagtcaatatgtgtgaccctttctgtctcagtgtttacagggagatccaggaactcaagtagatttgtaaaaggaagaactagtaccaacatgtttaatcagtattaccctttactatccctcagtaatatttatctcacctcactggacattaataccagatacttataatctacttggtttctttttgtttacagtagtcaacatagtgcttggcacacagtaggcatgttgtagaatttttaaaatatgagaatgataatgcctttaagcatatagtatctttaaatttttcaaaaatattttgtatataagatgtacgacatgtacaccatgatatatgtatatcatgttttgatatacagagtgaaataattaccatagtcaaggaagtcagtttatccaatctatcccttttagcatactttcagtatacaacacaatattactaactatagtcatcatgctgtacattccatctctagactgcaactgcgtactcttttcctataccttagatactaattactaagcatatagtgtctgttagattctgctcacctatcatttcacagaaaaagagctgtgctttagttaaccaattttttatttgttaattggaagccagagctaacctatgattattcttcacagcagaagtgtaaatagatccttatccattgtttctctcagctgcattggtctcagcctcttaggtatttgaaaagatagattgacgatggcaaaacaggtgacggcttcaggccacagggaatatgtggtc

SEQ ID NO: 116720 - DNA, 1888 bp, Homo sapiens
aagagattcatttttgctttataggccacagaagtacttatgtgcccctctaggaattgacttgaatagctcccatttattgagcacttactgtgtctgagcacagtcctttatagactaaatcatcatttttaaaaatcctgacaaaagctcttgtgagggaagtattataattcttgttttgctgctgagaaaactgatttttacatactttatactagccaaaggtcccttggccagtaaatggcccttaccactcagctgggctatgtggagtgatacagtttgtctaacagaacttgatgaaatgttgaagggtgaccttggggcagaatttccgaggaggtgtagtggaggagaatggtagggactatatgctaatatgaaaagagcattaaaaatgcacatttttattcctctttgttgagcatttaatggactgaggtagcaagccataatttggcatccactacaaataactagtataaccggaggttaaatgtttcgtggactggttctttggagctaattgtgaggccatgtgtatgtacaatctgtatatacaaccaaattgctagggattcacataccactggcccttcttgcctgcatgcaggtaagcttggttcctgaaggctggcaaaggtatagagctatttttgaagacgttcagaagaaattctggatattccctgaataaaagttttagaatttagcaatcatacagtcaggaaattttcctctatagtcaacctaaattatttcacttaaagtcagttttggtttacataataacaatatacctttacttaagaattttaaatgcagattttgctttctgtattataagcacattttgagcaagaaataatcatttttaagctatagggaacaatacatagatgcttgaagtgactctgcgttattttgtgtcccaaatccctcactttcatcttagtttcccttccttttgtttcattccttcacaagagttcttgccatagagtttaacagccagtaaattcttcctgattagtttcaaagacagaagtctcctgataggcagtgagtggatcaggttctcacctaatctccagagagacaacaagtaaggggaagaaagggtttgacactttatccattatgtacctctctgctttgccagactaacccaagtcttttcgttgaattgcgtgtctgcaaacattaggcaattcattccttagcatagctgtttgtacctctgcagtggaagttgttaccccatcttctaatttagttgtttatatgggtaatattagtatatgagttatactatagtttatatatgttatctgcatttttgcatgtgttcccattactagattctaagattcttgaggtcagagattgagtcatggcaaaaacaccatactcaagggctggcccatgatgcttaagaacttgaggtgggttggttctgggtacacttctctgctcctccactgactacttgctgtggtcctagacaagttacttaatcattccctgtttcatctttctcatttatatatggaaatactaatctatttgtctgatagagttactgtgatgattaaatgatgtattattaaacataaagcatagaaaaatgcctggcgcatagtatgtggtcaataaattttagctattaatactttcaaatgtatttctgtattattatataaaaataccatataattatacagagatatgtcaaagagagagcatagtctaactttagagttgaggtgacctgggatcaaatgctgcctcttttctccaaccctcaattttcacttatgtaaaataggatgtataatttgcaaaattgtgttgattcagtgagaaagtaaacgcatgtaaaatg

SEQ ID NO: 116721 - DNA, 1600 bp, Homo sapiens
ctatgaatttcttccttaggtatctaacaaatctttagtaattttatatagccttaatcattttagtaaaatttcccaactgtcactttgggttagttctatggcaattgacctttaaaaaaaaagtttaaacccactggcaaatacaaaaatccttatggttaagtagtttcatatttaatatagaaggtctgtctatatttatgtcaacagaaggcaatgtaaacccacagggaagctttattggctctaatatggtattagaacaaactatccatcttacctctcacatgctgtcccatagtaagcctcttttactggtgggaagagagtatttgtgacttttttttcctagtcactcccttcatagccatagattaacctttccaatctactgcaaagataacaggcatacttactagtgtttatcatagcatactcttaattcatggggtttggtaatcacaacttcattttgtaatcacatattaatagtatacataagacctggtttggaattcagtcgtggagtttgggttaacttcacctagagctcttgcattaccattctgggcagagtaggcaaacattggcaagctcttgagtggttgataggatcaggactctgctcacaagatatacatgggtcacattaagtagatttgcactgcagcctgaatatggagttttaagactgcaataatcagtgttggaagacgattggtttttcttgttataaattgctaattagtattgaaaatctaacctgttttgttgaacagcctctcttattttctctgagaaagtggtttggacagtaatctatttatctccatacccctcttccctctagttaaaataaaatctagaaacctctggggactccccctgttgagttgtgcttggaaggagctttaaaacagtgcctccaaactgaagtaaatattgactgggtctggggcttgagccctgctcaaagcctcctattgttcctccttagtcagcactccagagcgggctcaagtatgcatgtgttaggaagagaagaaaggctgtggagggaaattaacagggcccacagccgaactcataaatgcaccatatagaggaaagggaagctgactacaaagccagctggagcttacactgggttatggagaacttaggagactgaagtgcagaaacgctgaccagtctgtctgctttagtgaagtttaaggtacacaaagctgcttgtcttggtgggtccagcccatttctgagtgaaacctttgggtcagtgatgctgtcttctcaaggagatgtaaattgcagcattttggtgaacttggaagaaagtaaaagggtaaaccctcagattccagaatgatgcttctccctccctggtacctgttctgatgcctctgtcagccttccctctttcagctgtcatgtcggattacacactctcttgggtctcctaagtgccttggcatccctggggcatcagatgggtgagggagaaccatatgccatttgaaatgaaagttctgaagaggagatgttcttattatatgaaaaatttaaactatttttttttagaaaaagaaaattaaatcat

SEQ ID NO: 116722 - DNA, 1035 bp, Homo sapiens
actggaataaaaatactaccttggtccaaaaagtttaaggaggatcctgtcataaatgtctaaagatattaagcaaaccctcccaagatgtattttatgtggcaatgccagaattacaccgcagaaacagatttttaacactttccaacttaaatccgtatggttaaattaaccccaaatgttctttttacattaacataaaagatgactaacagtttttctactttcaatgtctgggtttcttgtgggtggctttcaggagcctgtaatttcaatggagttataaaagacttgggacaaaatgcgttctttctgtaaagttctatgattctagtagtcttagtgagaaacttttgctcctgtagagtctaggtaatataagatctgcaaatatgcttctgctttcctcacagcgtatgtattatttgctttttcaaagcaaatctttgtattaacaagtaaggaatggaactagttaaattcagaagattactctgcgttttttgttttttgtttttactgatcttcactctgtgtatataaatacaatattactaatctaaatgaactttcaagtctttgaaagcatcagttaagtagactgacttaattgaaatgtacctctatggaatgattatttttaaaagagataaaacggtttgtactttaagtcaggtgtatttttatgaaaggaaacagatgaacaggacagtgaccacttaagtataattttattttaaaaagaaatttttaccaacaatttttgatagttaattttaaaacagaagcaaatatttttctttttaaatcctcaatggctttaattagaacattgggtactatttcataataactatgaatattattaagaatagtaaatcaagacagtactgttttctttgtaagtttatgtttatgttcactgtggtgtaaacgagggttctcaaacagtgaatttgggggtgacaagcacttagcgtttccagttttatgattctcatagatcctgaaatgctagaaccttctgtgactctg

SEQ ID NO: 116723 - DNA, 1186 bp, Homo sapiens
gacctgttttaaaaatcgctttgctattaatgatttaaaataaccacgcagtataatatatggattaccatgttggaaacacatgaatacctacttagagattagaaaaaatatgattaagtgcttatttcctgatttagaaaagcttgttttttggctttcagttaaatcagcgtgttttttttcccccctagaagcagccatcttgttttaagaccgattttatttctttcgtgaaattggttcggaaatgaatatggacgatagaaaaggactaaaccactttatgatcattttggcagggctctctacatttaaagcgctatcttatttgcgaacttactaaaatgctatcttcttatatttagttgacagaaaaggatgttttaacttagtaataatatgcttaaacccaggcatattatatattaatgttaaatgttgggctgtaccatgtttccatacatatttttttctcgaagcttatactttatggctaacttcaaagtgatatattaatagcccctattgtcacctccaccctcaaatcctgatttcatttttctgactatgctaagtagttctttttatttgttggttgccttttttttttttttttaattactcaagtctacccggaatctttctcccgcaaaaggtactgataagagtataggtacctctaaatatgaagcagttggggttaagatgcgttatattaagtcagagcctttttgtctctgaaatataggctcttcctatcacattagaacaaatctttcttgtgggttctcatagattattttacaagtaaattcatatttgttactaaaaattatgagagtatatcaactgactgctatattttctgtcatgttttgtatttctggatacatttggaaaaccaagtgacctaataaactttactaaaaatttatactatactgcttactactgcatgtgtttgatgatggctgggaacattattctcatgtactgcagtaaaagcagagcttccgtaagattaatttcaaaagtaacctgacttagcctgattaagctgggcacagtgaaatattacttatgtcacttatgaaaaactgcttcagttcattagaggtaggattttgggtggttgtagatgtagtgtaaaggcaataaatgcatgttttaataacagatacat

SEQ ID NO: 116724 - DNA, 1557 bp, Homo sapiens
tttgagattagcacattgatttttgtcacaggtcatgttttttaatagatctgccctgcctgcagaaaactcttctgctcaggatgccatggaggctttgaacctgcccagacaaagttaatctgcagaattttaaaataccaagagtatttctaaatcggtattctaacttcaggtttgtagaattacctttctatttgatcattatcagtttgataatggccaaaagaaagaatgatgtacccctcttaaccccaagagatacagccctaacacttattattcttaggaatttatggacacatttatcttggtatgttatcacagttaaaaacttactttaaaaacaatattttaaaagtaggcagttttatctctgaagtgttgaataagatgttgctcttttgatgcattaagaaaagtcaacttggatataagaggccacatgccaaataagtattttaaaaataaaaactaacagttttccacaaacaatagtaagaaaatatttcagaaaatttccacgggtttagtaaattttataaattcactgttgtgcaattccttttcctgtatgttatttcataaagtaagctagccatgctttgtgtctttatatagaacctatctgttaaaattttgctaaactagtaagacttcaatcttttgaaaaaagaatagaggactttaattgcaacttaaataattttttttatttttccctcagaatataatatgttcagtgggcacgttaaactgatgataatgtacactgtgtctaaacgaagtaaatctactttagcttatactaacagattcaatttgaaattatgtttaggtaaaatcagaattaaatgtatcttgatcacagggattaagtacagtatcttactgtgtaacttgtgtcacttgtgtatctggtaggagtttatcttctacatggagtttcattactgcctctccattgataaatgagcatctatagatgtagtttcacgggaaaaaatattaaatttatttgctgtcagaatagttttactgttacaatctatgtacccaggtattcacttctgagaagtggatactgagttttcaaatgctgataacttttagttggtagtatttattggataggggaccaaactgatttttttatgtgttgaattggcacaaatttgtgaaatagccactcagaactatcagtttgaatagaaatatatgataacatttgcctaaatagatcttctatatttccaaaatttgaaaacttgtataagttttacctaaaagtgtaaataatcaaatcatccttttaatattattctgaattctaaactggaatgtcaccaagtaactttgagtaatgaaaatccacatcaagaagaatataactatttgtccttaatttctttaagaatgtaaaaagcttttaaataaagttaaaaagacttccagtaataaaagtttatttacattctcctttagtagctatgcttataaagagagtcataatactaagaacatgcctcttcatctgaagtatgccataagcagttt

SEQ ID NO: 116725 - DNA, 1044 bp, Homo sapiens
aggcacttacactctctcacatattcacacgtgtgcacatctacaccagggctctgatctactctagatcgtttcctgacagagaagccttcttccaggccactaaggtagcatgttatccactgtggcactgcctaactccgtgtatcctcgggtggccaacttgctatctggtgggtgacttggggactagaaagaataaagccttttctaaatttgttatatagaggcaacagtctgaactctcctggccagctcacgaaagttaattatacattattctacaaatgcattctgttgagcactaaatattttagttggttttatgttaacattgtgttagcttttatttcctggatagtaactggtcaggatatattttaatgatatttgaaactaatcttagcattgaagccaccaatgtaattaatggtgtgcagttattttaaaaactacagatcatttcattattttcttaattttggtaattattaaagtctatttctgagatacgagagggtagtcacattaatagaagattcatgagtgagatataagtagacaatctttctactgttgttgctctttttgctttgctttgggttcttgaacaggttttttggatatatgcatgttgtcattttggactagttctcatgctactgcaaagatctattgctagctaatatatgagttaagaaagaaaattagaaaatctgttcattgaaattctgtttacacttgtcagaaataagcatttctttgtttaattaaggattgccagcttcagttaagacaagacctatcagtaaatgaatatatgttttgatttaacacatctttacaattaattcataatagggactcaggctcaaataactgttcctgtgtctagatttataatgaggacatcagggagcctttttaagctaaagagtgattatctttcacagtagaactagaaacaaaaccctaacttgtgaagttgctatttatttttccctgagtgaatataactgttatttggtctttaacagatatact

SEQ ID NO: 116726 - DNA, 1045 bp, Homo sapiens
catcagagagaccctccctgaagcccccagctaaatgttgttctgtcctacagtggtcagtccatttccttcagagcacttgtcacaatttagagttatgtttactttcatgtttatttgtttcacatctgtctcttctgctagactataaacttcgtaacatcaaggactctgcttggttttgttactctgtgtctcttatacctaccccagtgccattaatcactgaataaatctctctgaaatgagtcttcccactttcttgtacttgtttttacttcagccacgtagaatacctgcggctcacttgtcctttctcatctctactttcacacatgctgtttcctttgcccagcatacctatccttgctcctttgtttatctggaaaaccattactcatccttcaagacctaactcagctgttctgtgagggcttctgatgtatccacatttccctgaagcgtgagggggctcttacacccccttagcgtgcctctgttacagttgttgctgtattcaatggatatgtttaagaaccttctctgtacgaggcatgtgctaggtgctgggcattgacagcagtgaataggagctgtcgttctaatgagggagtgggccacaaagaagtaaacaaataataacattcccaatagcaataaatgctagggtgatcagttctgagaagttgacctttgacctgagatctgaaagctaaggagttgggaaagggaagagatggggggtaagccttggattgtgactgtttactgggctgttccttatttctaccccacgtcgcacccaccccccacctccactcaactggcctctgagctccatgaatcttatattcccagtagccaacacaggcccaatatgtcacactgcagttccaccactggtggcatggcctatcagaactaccaggtgccttgccccatgattctgctgggagctggctcccaacttaaaatccactcccccacttactatcttgtgacactaggaaagttattcaatctctctgtgactccgtttcctgat

SEQ ID NO: 116727 - DNA, 1038 bp, Homo sapiens
atttggtcctttagcaaatttatttaagcaaaatatatttttgggttttgttattacattttattattagcatgaataaatattccattaaggagcccaacctgtcagtggatattacttacctgccaaaacctgagttatctagtgtttatgatgtctgtgcttttgctctaggccccaaagcaggctatttaaggagagaaggtggtttttcatcttttaaatatgcttggtataactagaaactagatatagttatatatcagatgatgtaacagaaagtttcctttctaagaaagctaggttggagtggggcaagactggagtcaagaaaccagttagacttggtcgttgactggggagagatgatgaggatccaaatagagcagagtcagtggggttggagatgctgaaagagatggtagagttatttaggagacaggatcaatagtgagttactgatttgaacttggaggccagtggcagcgggagaagggggtgtctctcctggctctgatctggacaagtctgtggtgccatcgtgagataggaaataggaggaagaataggtttagagacaaaagagtgagtttataaatggacatgttgcttttgagtacctctagagcatccaggtgaagccccggaggcagaaatgcagtggagagctctggaaaggggatctaggcttggagtcattaatattttagaagtctgtttgttttgtaatgaattatgcagatatcaaagtcaaaatgtaattctcataaatatgtaactatagatattttagagaaagctgcccttgtagtacttggatcgtataatcaatacttctctcttgccaaccagtgacatggtgctctaatggcctcaagaaaaaagcacttgagaaatgaagaacagcagaggaaaattgattctgaagttgcaccagtaaagctcaaatcatggtgtaaaaacgaatgtcccaatattttgcattttgtgttaggatggtttctatttttcctggtaattttggcattattatttctc

SEQ ID NO: 116728 - DNA, 1328 bp, Homo sapiens
actccaactccaatttttgccttttacaccaaattaatattgtcaataaatcagcattttagatttagagtaaacctgaagcttttagaaactctcaataccagaataaattacatatattatgtgtgtgcttaagtatttttattttactattgcacacacatatatcctatcctggctaaacactgtttttataataatttactatgtgttcccactaagtagtagtaaaggtaattttagagcatttaggttaatttatcagatttaataatgccaaacaaatatggctcttttaagtaatgagaccagagtaggaaagaagcatcaggacaaatctgaaaccacagaataattagatttaggctttcaaaagcacttggctccatatcctccatcccacccacaaggaaataaaaggacaaggcatttaaaaatgaattattctctgaagactttccctactgtgtctgtttagtcttcacagttttcaatattgacagtgagtttcttttcaccaccaatatggcaagttcctttgagataaagagagatttcacctttcattgccttgtgttatttcccctctactgaactatgtaaagaaaggtaaatggtaaaatggcagtgcaagaaatggagagctttggactattcactcctgcacaagaagattgttttcttttttatggtgtcagttgatatttggaaaaaaaaaatctgctttagcaaagaattctttttccagagaggtgatgaggaaatatgtataacttctgttttaagggcatgttttctacaaatggctgcttacacttagagacactgataattgtgtaattgtaggtgagcccacagctaggtagcaagtgaaagactaggactcaaaagattagggatacatgccttttgctctgcttatagtaataatatagtagataatcctgttaaaaccactacctctttctcatcaagctctctccttccccccaaaaatgaatttttgaagctattgatcagtgaattaaatgtgccaattacttatctttctcaaatctgagcatataagattacttagaagtaatattaccaggttgagtttctgtatgtacaattaaatgtaatattatttcaaaatacaatacagcctctttcaaaaagagtaactagggagtatttggggtgggggtcatctttgctgacttaaaaaaaaaaacaaagtatgtagctttttgtctcttggaaagaatcctagagccaaactctcttaagtaaataaaggtttaaaagaataaatgtttctcaactaatggtgtgatggattgcca

SEQ ID NO: 116729 - DNA, 1094 bp, Homo sapiens
tagaaggtggtgcaaggggaggaagaataattagctagaaggtaaaagaaaagcagcaaatgtatgaggattctcagcccctgggaattttttttaaaaaaataaatagtaaattaagtaacttgcaagcatttttgaccccatttaacagtaaattgagtaatcttgccacccaaaacaaataaatgtaaacagagaattgataccttgcctttttcagctattaagaatttgaaaagatttgagtgtaaaacagttatataaactttgaagatacatgatgccttaatgagagattataaaattattgaatttgaaaaattaagttaattttcaaactcatctcatattgcaattgaatgcaaactaaaagaaactatcaatacaactttagaaaaatggataccatactcctagtaataacacaaggaagtaagatttcttcaaagcagattgcatactgcaaagtggctgatttgaactacagtattattaatatatgggtgttgatgatttgactgagtgttgtaagtttaaaagagaattcccaattaagtttttctgtgtacttgaccctacagccccactcagattctccaggatttcttgagcttgcaaacagttctaattgattagcaggtggcatgcagtttgctgtcttcccccaccctttcaggttgctatggtgatacaatctttgcttcccctccattgcttccatgttccaactgatctatggaatgagatcttgtgaacctattggacaagctggtgctggcatttctattcagacttgttacctaacacttctgtttggcttagtaattggaaaatggccctttataccaacttacgtgcttacatcttgcaaaatggtccaagaaaaaataatgatgtaattctgtttattactacctctctattgttgctcctaaagtacaagaatgtaaaatgttttgaaggcaaaccttgaaagcacattcgtcttctttcttaaagattcttaactatcactgtgaaaagcgttccattaccactgacaatactttttttaaaagacgttaaacacaatattttgagataaggcgcgcaca

SEQ ID NO: 116730 - DNA, 1025 bp, Homo sapiens
attcaaccttaagagtttttgtattttagaaaagaagtttgtaaaggtcctagaaatacaatattatgaataactgggtttatattcaatgcattttaaaataattgttttcctatttaattattataaatatttcaaaacctatggaagagataagaccaaaggataaagaagggccactattattcaggtataaaagtgaagcatctggctgttttctagaagatatgtttatggaaatataacatatgggcaacatatggagaatgtcgggttggaagctctctggagagtatactaatatatcaccactaagcagatgtaaattgcagtgccttagtcacctactgactttctctcttagcaattaaaggagtttttcaatagctgaaagtgaagttatttttaaagataaaaatcatttaggcacctatttacatacaatgtatttatttttatctttagtgtttaaagttcatgctacttcttctgactacagtttgtgaagaccgatgtcactaaaagacagataaatgactaacaacccctttcaccctaggttcatagaaactagtgactttgatgcctagaaccatgttttcccacatagttttttctcagtatgagctaccccgttttttgattactgataagcaagttgatctcagcttttctgttttcccaggatttttttttttttcttaaacagcttggctgtatcattttgaacagtacttcactgggttctttaaagcatttctaacactcatccggcttacattaatcccatttcaggtcaccataaagcagttgttttcatgtctaatcagcaggcttgcatgatccacaagaagcctgtcgtcaagtgcacgtcttcaagctggtaaatttgctgcattctgggattctgatgtttgtgctcctctctcagtgtttactgttatttaaagtattactcacatgtgatgctgatgaaattgtgcagataatcagatgtggtcagttcaggtctctagccatgtagg

SEQ ID NO: 116731 - DNA, 1346 bp, Homo sapiens
ttgccaatttgctctccaaagtaagttgtgctaatttatactctcaccatcaggtataacatttctcattgctcaatatccttgccaatgattgatgttgccagactttttaatgtttgccaatccgattgctgtgaaactgaatctccttaaggtttaaatttatatttacttgatttctgatgaggtagagcctttttaggtatgtgtattgaatcttcaagtttcctcatattttagattgtccattcatatcttttttttatttagaagattcaatttttttctattgatttgtagttattcttagacagtctggatgctaatcttttgtcagttatattttttactggtatgaattctccaaattcatggcttgacttttattttattatgttatctcaatgaacaaatttttcattttaatgtagttgaagttatcttttgctttgttcagtttcttctattttgcatttttaaggccttctttattccaactttataaagataattttctcctgaaagtttgaatttgctttttatatttagatcttttatctacttgaatccaatagtcttttaaaaaattggatatacgtttattgagtagtccattcttttttcagtgtgatttaattgaatgaacaaaaaagacattccagaacatgtggcagtctcatcaaagttaataggttaacaaaattatctatttgaagatggttgtcattgctgaaaatatttctaaaattatcttttcaaaattacatccaatgtctgctgttccttacttaacaactaccaacattggtaaactttttcctttaagggcagatttgattttttgaaagattcaaactcctttagaacatgcttgctgatgaagctggagagtaacgttttggtttaatttaaaatgaaatgttaactttgaaatgttaagatggcctttcttgaatgaacataaagtgattctgagagcagacacatagaagaatttctcaaactattttgaaataaaattgaccttgatataaataagggcataaaacctaccattacattcatttggaagtttattcttggtatatttaagtcaggtcctcatgacttagcaagacaaccagatgtgtaaatagaagaatgaatgaatgaaatagtgataaatgcaaaatagacaaatgtacaaagtatatggaaataaggtatgtagggaggatctcactgttgagaggagtcaaggaaggcttacatggtgatgacatttgaactgaatctgggaggatgaaaatgaattattcacatcaagggcatggtatacaaaatgcacagcatatgcaacagcacag

SEQ ID NO: 116732 - DNA, 1047 bp, Homo sapiens
tggtagaaattatcagaacagaagaatatattttagtgagaacttctcatcttaggaattagtaggtttggcaggtgagaaaagggggaaaagagcttacagtggatactccaatgacagttagcaacacatggtcaaggtcagtcaagataatgagccagtaagcacccacaaacctaggggtcaaggtgagccaaagttgccaagtggcctggtgggcatattttagatactcagaagaaactcaggcacctcccagcccaggcaaggcctgtgccatgttacctgccagagcttaaagcccataggaaggaagaggcatgagacatttcaactcagaagctaaaactaaagtcttaatacacaagaagctgagaccttgaaatcgtctccattgcccatagcaatgccgcggtaaaggccattgtactttacctgtcaggatctgtcagccatcattttctgatcagcccgtgaaaaaagtcatgttggtgtgattagaagctggaactggagtttactgagagacgtaggtgagaaaaataatacatctttcacaatagaggagctagatcagtgcatcttacaagggctttcttttttaattatttaattaacttttgaataggtaatacctttacatggtttgaattgcaaaaaaacaaaaaggtatatgaaaaaaaaatcaccctccagatgtcactgtgcgctacccagtacccattcctgctaattgctaagcatggttcttatgtattatccattcatgggtatttttctccatatgcaagccacacaaatataatattctcatttctttttattttttacaaagtggtactataatatatacactattctgcatattactgttttcatttgataattatgattattttcttaatacagagtcatctccagcccaaaaattatgcaggggcttctgtccctgacaaagatttcaagatacaagattgtgattcaagattaaatgagattagctggaagctgtggcccatgcctgtaatcccaacactttgggaagcc

SEQ ID NO: 116733 - DNA, 1915 bp, Homo sapiens
cagatttgaggttgtaaattggttcccaaatattcaatttagggaaattatatctcacccagctctaaaacatgttctaagtgagcaaattgtattttttactatcactgcaaaattgtgccagatgagaccatatgagacatctgagtggagtactgtacccaaaagtttctaacggaatggcatatttgtacattctgtgggacgttctgctttttgccattacctcatttatctaccccatatttatatgtatctcaaattattccaaaacattttattttacaaactctgtctttatggggaatattatataatgattattctatattcagaatattcacagtgttaataacttccaattaaacttttttagtctaatggcaagaagatatttgtaaagattactatatatttttattttctctgagatccctttgttaaatagggatcaaatattgtatatttaaaataattgtatatctaaagtgatcccggaaatttgctttctaaatgagcagagaggtctcctatagggtcctctctggttgcagggacttctgtctttttcttggagggtttgcctaggctaatgttccccttcttcaacaaccctctccctttcatgtgaattgctgtacatttccaggaaatcgtacactttcatctgttcagaaaaactttcttttctgacaaatcttagtaacaggaaattaaaggcatatgggacagcagtcaacaaagtgactgcagaaagttatgtgagatggaaacatggaaattacgaggtggggggcattcacaaatcatctggtttagaagtcatgtagaacgtaaactaatagtcgaactcaggaaccaagcagcttggatttcgctcctgtttcagctacttcctgttggacagtgggcaagtcacttaacctatcaatttcctcatcagtaaaatgggagtatctatttcttggagttgttgtgaggattaaatgaataattttgtaaagctcctagcatatcattaagtgcttagtaaatgttagctgctcttatctagtctgtgcttctatccaaaaggaaattcttttcacatggttctaaaagggtgatcattcagcctgtacgtaaaactttccctgtgaagagccatttgctcctctcccaagtattttcccctcatttttggatagttctaataatgagaatggaagtcttccttcttgtgatttctgtgctttgggtccagccctgctcattaaaacatgtagaatgtgttgtctgtaaaaagatttttcaaatatttgaaatatcttgtctatctactcttccagatcttttcttctcaagggtaattacccaggtcccttaactttcatatataacattctttgcaggccccttacctccctacttgccttaaattggtcattaatgtccctgttaagatatggtacctagaataaaaccaaatattatctgaccaatgtaacatgttacttctcttgttgtatatataagtaacatcatggtctaagatttctttctttcttttttttttttttatgaagtgcattgacagatgtggtgtggaagccactgtgctcttagctacttgccattcacctaaaatccttaagatcttttcacactaactgtgaaaatgccctaagccatttttggtactattgatctttgaccccaagtgcaagacttcatatagttactaggagtctccttgttgatatagtgatgagaaaaagacaaaggttgagagaagttttagaaaggcttcattagtttttttgaagtgcctagcttagtgttacacacagagcgaatgctctgtctgtattgactattaaattttcaaatagttaacactcattgagcgcttgctatgtaccaagagctatcttaa

SEQ ID NO: 116734 - DNA, 1782 bp, Homo sapiens
atagatatagatttccccctagttatttggattgaatatttatatattatgcatcaggaaagtcaaattaacttattacctattctaagaaaagctggacttccttagtccaaactatattcatgtacactgtatagtttaatctgaatgtgtgaatatttcaacatgccatttatgccgtttgaatagttcagctagccttgcttcaatctctgattacttactccaggtctacattttggaaccatgccaatatttgaaatgtaaccactgaaaacgtcattgggttatctgagctttttgatggtatattaaaataagacaatcacatttgtgcgttcaaaatgtaacatacatcagagaacctgtaattcaaacagttccacgaagacctaacaatactttctttaagatttgaccctttaataagaaacaattatattaaaatactcatcatttctaaccaactctgtgactgaagtctgcaaataacaagtaaactttatccctaaagatgatactgaaatagtttcagttatagtggaggcagatgtagaaaattgccagcacctaatacatccactttaatttcaagactattagtgatacaaaaaaattcagtttctattctgtcaagggaaataaaccatagaaggatcattacagaagaatacaaagagtaaatgtaaaaatatttgaaagagaggagccatcagttatttattttatgtttctgcacataaattggcatatatgtgcctacttgcacaattgactaaaggagttttttttttaatgcttgtgttttcctattgtcgatgttctgcaagtgttaaaatagtcaaaattttcagaaattaattgagcttatatatggcaagaaatattcagattatcatttattcttatgagaatttactgttttgggacagctttcttttagacagttgtgagaaaaagctttgaaaagccaattagagttttgcttttttaaaactggttttgtacaagtaaaggttgtttgcacccatctcacaggtgctgtgcagagaatttttgttgctactgttgatctatgaaaatgtatttgatgcaataaactgccatttttagcacaattatgtactaaatgctttaatacactatttaatcctcacaacaacttgttttcattcttggagagagaacttgagacagagagctgacatcattgcctgggattacctaggctagtagatggcaaagccagagttagatccatttgcttagctctctcatatactgcccttgatttcttggccatctgctcagggcaccatgctcagtgccaggtacgtcaagataaaaaagactttctccctcacctcatggcattcagtctagcagggtaggtgcattgcagcaccaggcccactaggccctgccagagtatgtgcttcccccagttatcaagtgccatcagctaagcacctgttctgccagaatgcactggcagttttttatctgaatgccaatgtgacggttgctgaaagtaagctctacacataaataaaacgttttaattgttgtgacactaaattactaaattacaagtacttttcaagtcttctgatattctctcagcagaaaatagggaagaaatattgcataagaccaaaattaagcagacatattacccatatgcattgaaaatgtgtttatgccatgtgcatcagaactctcaggcacatcgaaccctgagactgagccagtaatgagacttacttttttccagcaccctgt

SEQ ID NO: 116735 - DNA, 1100 bp, Homo sapiens
tgaaagagaaattgtatagatattttatttttaatcttaaaatggttcttcctttcaaagaactatacaatagaagtatatttaacagatctatagtgaacataattttgtgctcacatttgttattccaaaggcatttcactgtctgatgagtcacatttacaattagtttcttattgtaaatgtaaataaaagtatcattttaaaaatgttaaccttttcttcttcaaaccccaagagcctgtctcctagcctgtgttccctctcacctatctgcacagacatagaccctatcccatgatcatttgaaataaaaaagtttagctgagaagcccatgcaaccatgagataggctgtctcacattgaaatgcaagcattcttgaatcaggtatcttttaacaaataaaatatttatcaggacatacattttatgattttatgttccattttatccaaatcttaccaggttttgactcattttgtcttaatcatgagtttgaataatttgtaactacttcttctgtccttgccccttgccccactcttactgcctactcccactctacacccccatcacattggttaatcagaagttgcctggccagatgtggtgcctcacacctgtattcctagcactttggcagctcaggcaggtagatcgcttgagcctaggagttagagtccagcctgggcaacatggcgaaaccctgtccctaccaaaaaaattacaaaaattagccaggcctggtgttatgtgcctgtagtcccaactacttgggaggctgaggtgggagaatatcttgagcctgggaggtcaaggctgcagtgagccaagattgcaccagtgcactccagcctgggcaacagagcaagaccctgtctcaaaaacaaaacaaaaccccccaaaaaaagaaaagaaaaagaaaaaaagaaagaaagaaaagaaaagaaaaaagcagctgacagcacctaaagttcccatgtctgtgcttcttgcatgtgttgcttattctacctgacgtgtctctcaccaacctggacccccacttctttccagccagcctgcttctccgtatcactttttactcagcttagactt

SEQ ID NO: 116736 - DNA, 1109 bp, Homo sapiens
ttggattgtaaggtactttcatgagtttccccaattagccagccatccctgacaaaatccaaaaagaagagattatgagttcttagagcttttgtctatatagttgtgatttgtatacctgggtgaatgtagccttgccttctttttatgtaaattgaggtctttggggtctcagttattagcttgctataaatagccttgaaggtaaagctatccattgtatataaagtcttaactgtgtactaatgataatgggacaaaatttaatggggactatcagttctattaagattcttaaagtatgagaattgggtacagcttcttggctcaggatttttatcttgtgtagttatgatccagtttggatatttgtgttacattttatatttgtattacattttattactcttcattctgggtaatttttttaaaggaacagataatcagtaatttcgtaatgtttattctctaaataataagttttatccctgagaataattgatggctctaattgtactttgcctatacactgcatcccctgtgatttttattgttgttgtttgatcatataaggcagcagcaattctgccagctcaccacatgaaagcacatatgacaaagtgatctctttgggcaaaattatccatttggatgaagaaaatgggaacctttggttgatgccaggtcttcactacacaaagtgaagtaaaaagttgccagctgtgcagtgaattcacctgtctgtactagagtggaaccataataaatcttataaagctcccactgacataaaaactatgctactttattcatatttctcaaactttgtttggacatttgcctaagtgataaatgtgttaggtctccattgtactggtaaagcaagatgaacttcagaaatatttaaaggatttttagatgttctgaattatctgatgattaacctcattaattagaaaagaatctatttcctacaatttttagtttctgttttataaagcctagagtgagttttcaaataataaaattgtttatttgtttctctgaagtttgagtctgacacagagaagcaacatgattttccatgctcccagagctaaatgtgcttt

SEQ ID NO: 116737 - DNA, 1064 bp, Homo sapiens
gtaatagaaatggtccttaccaataatcaagcccctataatagattcatactctttttagagaagaccacatttgctgcctcatttccagagggggcttgtgagagaaccagcgccggaagtcacagctgtcagactctggagtctcagcaagggatgctggcttggagaaccagctttccaaagggtcaaggaagcagaaactgatttctcacacaccattacgcaatttaactaacataacaaatgccaaataattactggcactaatgggtaggtggatgtttactttgtgtggttaccatggattcccttaacattgatgggtccactttgattgaaatgctggaactttaaggaaatagtaatgatatgattagcttgactcaataatttgaacaggatttatttatctgaaagatgattaaactatattatacccaacttgctttgatttaatatattatcctattctgtgggaattgtttcagtattacataattccgtttactccaaggagacatgtatatattttatgtataaagcttattgagctattaagtttattgacttatacataaagtttatagagctcttaatgtatgtcaggaactggagtaaccgtttcacatgcattgtctcttttaatcttcacaagacatatttatccccattttacagttagaaaactgagatagaagttaacttgacaatgattccacatctggtaaaacccagaatttaaactccatttgtcaccagagcctatgtttcagcccttatatgtggttctgtaatctcctgacaaattcttcctgccccctgcacaaacaaaaccagttcactgagaccatggtattgcagtaaagaaggagtttaattaacgtgaggctagccacatgcaagacaacagagttattacttaaatctcaaatattcagccagtctctccgaaggcttggagattggggttttttcaaggatagtttggtgggcagtggggtagggaatggggaatgttgattggttgggaatgaaatcatagggatgtggaaaatggtcctc

SEQ ID NO: 116738 - DNA, 1027 bp, Homo sapiens
ataatgcggtttttaagtcatggagccagaattcaaattgacagagaccaactccagagtttgctctaatcattattcacttaataatcaaatgataaatgaataaatgatgataaacatcttttaccccaaagctaatgcagaactctaattttaaaaacacatggtccttttgccttaaggaccaaatgagtttctgctcccaaacatcaatcttataattagtaaccctgttgaaataaaaagccatacccatccctactatcccagaccttgtctccctagggcgatagccccagttctgtatgccccagctgaaagaaaaaggaatgttagggatcttgaatttaccttactagtttcctgtcataggaggatgccagaagaaagcaacaaccacagtagataaagaaaagctcttacctctttctaaagtttcatccctagaatatgttgctcagttactatcccagaatccagtttcagatctgcactcctcctcctttgagagaaatgaaaaggggttaggggaagagaagaaaagaacttcacagctttcttctagagcccagcagtggtggtccttttcatgtagaagtccaggaacagttccaatcagtaaacctggtggagaaattaaccaattttatatttgtcttaattcaggaagtcacaatattttttttatttatgtagaaatattacaagctgcaaatacacccttatttagatgttctgatgaaaacaccttcttggggaatgtaaattagcacagcaactatggaaaatagtatggaggttcccaaaaaaaactaaacgtagaactaccatatgatccagcagtcccacagctgggtatatatccaagagaaaggaaatcagtgtttatcgaagagatagctgcacttctattactattgcagcactattcacaataaccaagatatggaattaacctgtgtccatcaacagatgaatggatgaaggcatggtgcatattcacaatggaatattattcagccataaa

SEQ ID NO: 116739 - DNA, 1529 bp, Homo sapiens
aatgtacttcagcttttttctgagaatcatcccttctgctctggtttacataagaaattggttgaaatcctctaaagcattcgttttcaactttgccattataacacaccttgcattcaaggtttgcaaatgattaactttcaaaaaaattataaattggaacagattaagtgatatcttcttttcactctcttggaccctgacaaaattttaagcgctagaaacagggatgagggtatcaagcatgttgatatttgcacatgatttctggtttctttgttgtcacagcttttgatgcttgtacttaccagtgtacgatttattagttatttacattcctgtgaagtgtattattgttataaagtctagtcccttattcccctaatgcatattccccccacatttctgtcacgttcttttatttccacaatattttggggctacagaaaattcagggaatgcgcatgaatatgtgccgcacatgtaaacattatccatcacattcatcattcggtggaggaacatgctgattctagagctggaggaggtccttgaggacaaataggacaccaaacagcacaaacctgatgacgctctcacatactctacattatgtggaaaggtacagcctttctatcgttatgctgtcttttgcatgaagttcatgcttcatcttcgttcctagacttcatttgaaatctacgctctcagatttatgaaaaaatatactttttaaatattgttcataagtgtggtcttgatatttagtagcctacataccgtatactcggcatttaacttagaaacctactataatttcccaagtttttctggtaatgggaaggtcctttaagacattttttacgtgcagtgggctctacaaatatttacttttttttttcacctttaagaaactggttgaaaattgtagaattagactttgaagctgtgtagtgtatttttggactattacatttctatctaaatctacaacctgctaggaaagatcggatcccttccagcttgtgattgtaatatatgatttgtgtggactctagtctgtctcacaaatgcgtttagtattttctgaactgagcttctgttgtgtgccaggcaggtttctaactgtgcgtgttcagtccactgattgactgactgagagccaagttattctcactaacacatactcaattcccaactactacagaaaagatggactccagggcctaaattggaccctcactaacaaagcttgctttctgccagtagtcatacttaaacagtgaatgaaaattcagtgacctatattcttccatttaaaaccttaaaattttaaattaaaactttgtcaacagtaattttaaccatactgaggcaaaaagagcgttccctgcaatctggcagcactaaatataattcataactatcaaaaatccgttttctctgcataacttttaagaacgctcctgatgtcttcaaaattccatgcaattttctttaaaagttggtttggaatgccactgtgcatc

SEQ ID NO: 116740 - DNA, 1049 bp, Homo sapiens
cagatgcccttttccttctttgactggacgagtagaaacatattctataggactttttgattattgaagctacttagaaattgtaaaatttgatgtacatctgatacagcgggaaattcatcctttaagagactaccccatgattctgcttcctattgctttactcgtattcaagctggtgagtctgtttttggcctcctctttctatggtggtgggtatgtacattcttttagtacagtatactgagattttttatttttttttacaggcttcattgattcaggaacagctcctcacctggcatatcatttgtaatttttgtcaagattctcacaggtgttaaatgtagtattatagtacttggtaacacctggccaggctgttacagagttatgtttattttaattgatatatgatatagttgtcataaagaaaacgatcatgctaataggcttcttactccccaaactgaacatagatatttatggtaaagggtagcaactataaacaaatcaataattcagacacagctaaatagaaaatacagtcttgggaaattgctccctaaagagaaatataatattgtcattcctttatcactgaacaaatgtatgtcattggcagtgttgtggaaaaaaaatcaaacttaggtgtcagagagttcggttaaaattccagctttgccacttattttctttgtgacctaaagcaagttacttaacttcctagttttgccatctgttaatccacgtgatgatacatgccacatacgttagtgaaaatcaatataaaacacttgtggagtgcctggtggcatagtcgacactcactaattggcagttcttgtcatacagaatcttctttctctttccctctgaagaagaattagccttctcctcttccaaatgtgacttttctgtttgtggaaatcattatttagaaatttgacctacattagtctatacctgcctacttgatctccagagctaagctagctaaacaagattattagtaggcaatagaaaaagatacagcaaaaagtctaaaa

SEQ ID NO: 116741 - DNA, 1013 bp, Homo sapiens
ttcatttgaaacttgtcattacctgctcttccagtctttttgtatatttccccctttttcactgccaattgtcaggtagctaatagccaggagttatggatagtaaatcccttataatgaactcttctgagattctgcagtgtaaaatgttgttaaagtcacactttatcctgaaggcatagagatacttcatgtcataacaaaggcagtgcccagcacctactattaagttatcaagtacaaaaagaaatgttccagaagataattgagaaggtaaaaagctctggagttgagacagatctgggatcaagttctgtctttgttctttgaccttagggaagttccttcacatataggacactccatttcctcagttgtaaaatggggaattaatgtctgacttcatgcttctgtatgtatctggtacctaacctcgtgagtagcacagtgtacactgctagtaagtgttgtttttctacaggagtgggataaaaacaagattcacttagaatttttctgccacctttcctttcctaagtcttagaagaggtttatgttaaaaccttaccaatatggtttacatttatttgtgtctctgaattattttagttcagtgtttctcaaccctgtctgcacattagactgtctgaagagtttctaaaacatattgacgtataagcctcacctaaaactagtcaaattagaatttctatgaaatggggcccaaccagtcattttgtaaaacttgcctaaatgaagataatgtcaggcaaagttgacaactgatcttgtccatttgagcggaatcggaagtgaaaattttgtggactttcctctccgtggtgataagaaattgatcatgatttttcttgcacctcagtccctccagctctcaagctctctgccccatcttaccttccttcttcattaggatttcaggtattcaaaaggttcatggtgaaagtttttgcatctgttgattctgttctccaaaatgttggcgcacaattgag

SEQ ID NO: 116742 - DNA, 1525 bp, Homo sapiens
atttggtatgtatgtagaatgggccattgttttccataattcaaggctcttttgaattcctttgatagttttgaagcttacacagcttaattcattaacctttacccttcacataaatcatatgattacgaatctattgctaaggagacagattttccctccactgaaagtaagtaatgccttctcatctttgaaaaaaaatcctatctagcttaccaaagtaacctttctgttgcttttcatatttcatcaaatgtttcaggtgcattttagaacattatcaaaaccaagtgagcataaaattacattattatcaaaaataactctggatgcttaggatactttggagcaggttttctggccctttctctgtattccaaaagagtttatatatatgtactcaacagctgttactcaagaatttacaatggtagcaatgtcttttttttaattctcttcagacccctgccaaaacataaaagcaggaaaataaactgagggtaggcaattcagaataaattaaagtatatttaaatgaaccgaagacatttgatttggataactttttcatatggagttatcttgtagagaatgatgatatagggctccaaaaaatgtacgtgattgttctgtgattccctggaggtaagactagaatgtcttttgattcttttattctctcttgttaagacagatctctccttagggtttagtaatcttaattgtgcttgacattcatgagctactttaaaagtatttgatattcctcagcatttatccactatgccattttcccatgttatgaatttttcttaattatcttatacacggatactttctgtaaggagacagttctttttccaaattttataactccttatgttgtcatacatgaagtgggaaatctttgaacctactgatccatagagaatggccatgtgatattctgagctttgcctataggagtgatggggacaaggggttggggaaaaataggaataacttgaattctagattctgagtttagagactcatggcttgctcctacagaccaaactaattcatgactatgattaatgaatgttcttctatgtagtatctgtaagaaaggtgatgaagaagtaaacattttaaatgtggtctttggttctgtcactctccttctcacttcaagattatcactttgcacacatttctctcttttattggtatcagtttataaatgcctcttaacttgctgtacctgtagtccatactaagatttatgactttgttttttgcatacatactatacagtgagctgggaattgctctgattttaatacaccaaaggttatgactagagccaagattctttgtgaaacagtggaattatttaaagtaagtatgttcacagacttgtgttatgtactacttgtaagcatgttatagaatggactctaaaagtttcaggagaaaaggatagtcaccacccacaatctctcatcatgaactgctatcaccacatgctgccagggaaacgcga

SEQ ID NO: 116743 - DNA, 1033 bp, Homo sapiens
atctcatcttctgagtgcttttatattccactaaaataatttagtcttagccattttaaattaaaagtaagcttaaaatacatgctctgttgaactgagactttcatatcaatacttatagcagttaagataaagggaacaggctgggcagagagattatcatcaattatatgtttaatatttcacctaaatttcacggtatcctttttagctatttggagccctgacaaatctctttacaatgtttctagttttcactattaatgtttttgtggtgggcatcagtttcgagttgcagaattttgcctgactctttttcaggacaagaatggtctctaaagaattacaattcattaacctagattgtagttttaaatgttttagtatttctgcttttctagggtcctgagcttttgtttccacatggtaaatccttgttacatgtagggtgacaaagtcttctcttctgctgtctgtattaaaatatgccagaacaccataaagatagcaccagtcttaactatatcaaaattttacagtatctggattccattagagttacggattatgaattgatggaaactcacaaaccttaaaagatggaggaggtttcttagcatttccttattcaaagtaactaactacatgtgtttctaccgaagaatgaataaactggtgaattaggaaagcttgcctttaattttttttctagcgtttcctttagtcctgaaatattttatttacaggactaaaggaaatgctgaccttcagttgatttttgatagttatagagatagtaatatgactttgctgctcctaggtaggaacattaatatcaactacagtcacaaaaaataaacaatatttgatccatcaaggttataagtattatgttcatcattttataataatgtggcttttgattatatcttttagtatttctaaaacatagtttacactcaatgaaacattcttgaattaagtgaattaattaataaataaagcttagcatcttttttctgcttcttgcata

SEQ ID NO: 116744 - DNA, 1070 bp, Homo sapiens
ttgtagcttcttttgaacatctgatttttttaactcctatgatattatgcataaattaccatgcttccctctttctttggttctttgaaagcttgaaattttatcccacttgtggaagctttccaggtctgaattatatgaatgccttcaggatgggtatatcccagattttattatttttctacctattttttaccctcattgcctttctcaaatatttcttttatagttttatatgaatttctaatcgaatacagctaaatataagtaaacagctaaaataaatttgggctccttagtaattgtgcaatatatggagtattatttcttttctttttccccattacagtgttctctccacaaacttaaattactaactcaactaatgcttccctgagtatatatccacattcgctaacttgcttatactgttaccttttataatttgtcacctttttcagagtgcgatatgtcattgaattgctcttacttttcccagagccccaaatgttgccaaatggcctaatagtattgtgaatctaatgaccctgtctgtgcttacctttcaataaaagatctccaaaaaatgaatttatgctctaactttatttttttctataaaattctgtcattaccaggatggaattcatgatgccctcacgacctatagaagcacaaaactgaccaactgattccaggcacatttacctgccatctctttcaaacacctgccattgctccccttccttattccactaatgacttttgaaaataataaactatttctcctgaactctcaatctttctttcacagaatgccagaatgttatgcctttatttagttgggtacttgaaaggagtgctgtttgtgtagagcagaagtttttaatacagttactctcttttgctaaatggtttgttgattatgcagacagaacagtaactgtattaattaatagtagatcatttcaaaatacgccaaagagatgcactgttcattttggtttatcctttaaaataacgcaaatctgagtactggattgggaatgttggttgtttctgctggctgt

SEQ ID NO: 116745 - DNA, 1023 bp, Homo sapiens
actctgggaaactgtctttaaattcctacatgaaaatcatactatttcttctgtcatgcttaagatatgtcattaaatctattaatttcacaacacaaatatattattggtattacagttttgctctggctattttaatgtgttttcaaattaatttctgatgtgaacttttagtagtttggcccaaaaatttaaggcatttttttgtaaactagattattctgagacatgtattatatttatcttacattatatcaaacactttttacttaaatttttcatttaaatagttaacctctttgaatagaataatgtttttgaagtcatttgcaaaatgcttttggatgcaaaatgcttttggatgcttttggatgctttttgttaaatctctattcttttgaacatttaggagaaaggtccagattactgggctatgtctctaacgacctggctgcttattctgtctattgcaactgtctattcatagttcactttccaagtgagaatagttaggttggcattttataatgtcctgtaggagttaagtgtgtatgcagaaatggtcttaaaattgtatttttgagaaaagctgtccaaacatgtaaattattgtcccatctaagatgtgcttaaattggtgacatttcaaaagttcatggactaggtgtctatttttattccattaatgacggcagagagtgctccttagctagttttctaggaggtcatcatagagtatatgaacttctatattgtttcatttgtagtcacagcactgtctcaacactgtggctgcctacatctcactgagaggtcatcatttcttatctgcatcaatatattagggttgactactttatgtatttgtaaaactcatcaccagttggctggggtgatagacccagcatatgcactaatcttgtctcagatcatattagggttttctattttgcacataaccaatcacagaaagggagtgaacaaaactagaaaactaattacagacaaattattccccactac

SEQ ID NO: 116746 - DNA, 1093 bp, Homo sapiens
gcattacactgcatctgtggggaagggccccagggatgtagaaaatcaaaggaatggggactaagaacgtcttttttccactttcccttttggtggtggtgtgcggattgatgtaatacatgcatatggaggtggcagtgaaaggactctgggaagtttggtttacactgagaagggaggccataggattgtgtgtgggagggggggatggaatgagaaaagttaaaaccagggaagacagggtctgagagagagttctatgggaactgagagatttaaatatactggttagaagttgttgattttctaggatgaatgggactttaggaagatcactttctgaaaaaggttttttcagaagtgtaactagacaataagagactagtggctacatagagtactacttgataagagattactgaactcactggcatgtgacactttttgcctggtgtaaaaaatatatcaaaaagtgctatatgtcccatgtactaatttgagatggctggttgagaacaaatgacataaaataataaacagattggctgaacagcagagggatggtgacacaatctcactgcctctttaccatgtgtaatccaaccggagtaatttcttaaataatataattacttaatcaactctaaaataaactttcttctccatttagctgaaaaatagtgtgaagcagaagtagtaataccaatcaatatatttttagtggtgatatatctatatctatatatatatgtacacatatgtggaatagagatatttagataacatgtagatttgtacttagtataatattactacaaatatagaaacttcaaatgtcctgctgaatatatatattcatatgttttatatatattcagtaaatgaatatgtaaatatatatattcaggatatataggtttttatatatattcagtatataaaaacatattcagtgtatatttatatatatttatatgctgaaagtgtatatataatttatatacatttccactagaaaaaccgctttaaaatcactctctatgtaggtatgatgaaaaacacttaatttttcccccaagttatccatataaaa

SEQ ID NO: 116747 - DNA, 1100 bp, Homo sapiens
taacagttttaaaacattgaatctatatctaggaagataactagattgatatggtaatcatgctgtttaaacagatttagagcagttttagctccttagaattttaaacttacagaacaattttatctatgtttttagaagttgtgttttggcatagagagtatgtccatgtcttgcaatgatcttacctgtctaggaaattgatttatcagtttttcttacttctgagaagacagttctcttcataaaatttcctagttcttttcaaacaatcgaatttgtgtcattttgttctgttgaaaactctgtgaatgatgccatttatcatcatattagttcttattatgaataaattgtaagtaaatttgccatttattgtctctaataataaaagtgctaaattgtacataatgggttcctaacacattatatgttcctaatacaccaaatattgttaagatttgttgaagaatcaaaaattatctaaattgtcaataaattatcaaaacagatgctctaaaatattttgttaatttatttaattagctactcaactgatctaccctatacagtatatgaggttaggactagaagagacttcttcaataatttctttgttaatagcttactaaaatactttatttaaattttatttagattgagtttctccacacagtggacataaatatcatcccctctctttcttcctgtatggtaaaggttaaataaataccacatattaagtgagaaagcatctgaggttcccaccgatatctgttctcagttctttattttcatattgtaggtaaaattttttttttttaaccatttgatggtatttataaaagttgatttgggacctttaaaagtagaattctgatggacacatggaaaatgcttaccattaataggaagaaaaattcatgagcctccccaaatgtaaatatattacgttatgatttttaaatgaatgttgtaaatggcttatttgctttttaagaggactcacttatatacaaagtagaagagctaaatatatcacttatcatatttggccagagaagcaagttttttcctcagtgtgatgattgcttccctac

SEQ ID NO: 116748 - DNA, 1052 bp, Homo sapiens
ttaaaagattattataattggggattatcctgagagatcagaaggtcttagaaactttgtgtttgcaggatgtagcatgtaactagatcttgtatacagcattcaataaatacttaagaatgaatgatagtgtagctaatttataagcatattctgctaagaaatgcttacagccttttctcttagttcccaagatagcttaaataaataagaatatgatgatgtgttttagagaaaaataatctgacttcagtttgaactatcatgaatattatttattgacaattccaaaaaactttaaatgtaacattgatatctaagttatatagtcttgttttgtttccaattatcatatcaaacaattgaaaaataccaatccaatcaaacctttatttgtaactgctgctccctctttcttctttttcttttcttttctttcttttttttttcttctttttacttatttctgttcatgttttgaaaagcagggtctgcagatagttatttatatgtatgaattcactggttcattctagtgcgaaataggtcattctgaaacagtgagaaatgtgattgctgaatttcaagcagtttttgctgctcagctggaactgtagaaaaaggaaaggggtcaggccagcacttgttgaagatttcttgttgccattgtcctagtaaaagagacttgatgctggtgaatgtggactattcaatgtattagggaggaggaaagggaggcttagtacctagtttaataattattatgatattttagtttaaccactctttagaaggttaatacaaaaaatcaaatgccatcctaataaagatgtgcagggctttttctccttaaaaagaaactaggtacagcaaataatggcactgtgaaaactttgaggcacaaattcgccccttttttttttgcatgctaatatactgaaaaagaaagaaagctgcagtaggattggcaggttatgattctcataaaaaataacaaatttttaaacaagaaaataaagaatactttgaaaaaattgtacattactcagcat

SEQ ID NO: 116749 - DNA, 1038 bp, Homo sapiens
atcagaggtgactgcgaggaacatgttgttttcttgcacatgcttttccaaaatgctctaggaatgagaccatactataggaagaggcagaggcagtgctgtctgggcagttcctcgtgggcattttctgtaaagctttttgcagataaataattcagtagacaatattaagagtcatttgcatttgcctccctgactttgagtatatgttactcaatgtcttgcttttgtgtgaatacacaattggcattcgttttacatttctgtaatgttggttttctaattatactcatttctctctagagattatttctgtttctttcctgctgtatgcattcacctcccattcatggtaaaataagttaccataaaacataagtccatattttaagggaaattcataaatggatttattaaaagattgtaaattatctttacattttgtaacaatatacttaatttgtgatattttcacaaaaaattaaaatgtatttctttatgaagtatagtactgtggttaagaacatgaaatcaagagccagaccctgaatttgaatcctggctttgttatgtattagctgtgtgacctaacagcatgttatttaatatctgtatgcctgagcgttttcatgtttaaaatggagactatcccatctactttgtaggatttttgtgagaatcaaatatatgtgcattgtacttagtacttcataaattatataaaaactatgtattttaatattatgatatatatagtacctagtatagtacctggtacataataagcccttttcaaaatgtggtttataacttagagaatattatttcattgcctttcaaagatgtttttaatatttattaatttgattccatctgttttctagtgcctagaattagagtattagtctttcaaataaaagcaaaattttggggttggagtagatgttaaaaatacagagtaacaaagtatctcttgtcatcctctttaaaaataagataaagaaaacttttaaattgtaaatatatttttgggccgag

SEQ ID NO: 116750 - DNA, 1023 bp, Homo sapiens
actgtgggcctcatcatagccttaatttctactatagtgaggatgataggcaatttgaaagcacttctacaaagacataagtgttggtgtcttccaaatttataattactttcttagacaaaactggctttagaaaatttcatgtgcatatctttctccttattcttgtttgcacaagcaaactaaaaaacaaaacatacacataaacaacaagaatgttaataaaatcatgtttaatctgaagtaaatatagtctgatttgaattggatgaaattgtattaggaacccaagggtttctggtgactttaaatggaaattttttgatgtttatagtagtattcagtgagtactgagattttttcttttatttttgcttttacttttagttgacacgatattttcttttgactctcaatggcatttttttcttctttttcttttttgctaaatgtatctttaggtgaattaaagaatagactaaacctttttatcaaaaatattgtgctgtgaaagctttttaaagtcagtgagctttgtcatctgacccttcttttagaaaataggcctttagctgactcatgttatgtatgtgtgtatatatatatatatatatatgtatatatatatagagagagagagagagagagacagagagacagagagataatcttatatagcatgagttgctccaagaattaatgatatatacacacatatataaaataacctatgcctgatggtaaaaatataaactgtcaatttcttcttttagggtcttagctgtctagaatgttaataaaatcatgtttaatctgaagtaaatatagtctgatttgaattggatgaaatttttaggcttattactttcacaggtgatttttaaaaaaatgcatagtggtttaacaaaagaaactgaatcttaaatgaaaatagagggaagtgagtgaacctgatctagtttcacctacaagacctccaaaatagtttctaagaaaatgtgcctttggaccgatgtctcatat

SEQ ID NO: 116751 - DNA, 1052 bp, Homo sapiens
tgggcaacatagtgagaccccatctgtacagaaaacagaaaaattagcttgatgtggtgacatgtgcctatagtcccaactacttggcaggatgaggcaggaggattgcttgagcccaggaggcagaggttgcagtgagctgagatgactctactgcactgcagcctgggtgacagagtaccctgtctcaaacaaacaaacaaaaaatgatagggtgggggactaaacccagattataatacactgaggagtttcactttgtttagtctttcaaagtgggagaaacttaaacgtgtttaggggctgagccaaaggagataagagagagatgtaagtgagaggaaggagaaattcatggaagaagttcaggaagaattcagaaggcatgcaaattgcacactgaatcactagtaagtaagtagttaagaataaggtaatatcagaaggaattaacctgaaggaggcggggagtagatgccttctagctctaagaaagaagatggatggtgattaaacatttccaagagtttgtggagtgttagaagctgagagaatgcaggcttgagatcctctcattattctttgaagccaatcaaattgtgagataaaaacctgagccagagaagcaattgggtagggcccttgggacaggagctaaaatttggaagagctgctattagaagtggcagagggagctgacgagcagaatgtagaattgctgagtggttttgagagcttggaaactataaatttgtagtggcatcggtccacatgattgttgtatttcctccagcagaagtcagcagtccacttatgagaactcaaaaaatgctgattgaaactgaaactggaggtgctgtgaatccaagatggtataagacacctatcaaatttcataaattcagatttgtatatgacaatagactgaattattttgtgatttctaaaattagcgaatgctgtatctcaggtgctaaatggacacaacttgttttctatgtaatgtttcctatccaggaatatcctccgttacttaaacactgtaatcacta

SEQ ID NO: 116752 - DNA, 1011 bp, Homo sapiens
gccagggatttaaagataaatgtaacaacctccattctgaaggagctgacattctagtaggagaaacacatttttaaaccaataattaaaacacagagagtgagtcaaacgtattgagctctgctggaagtatatcagagagcaagtcaatcaactcaacttggggtgggagtagtgaggtcagaaatgattcacagaggtgtgaggtttacactgaagcttgaaggataagggggactttcccatgtggacactggaggagagcagtgcaggcctggggcacagaacaacgtatagtctgattgctagaatctgacaggaggatgagtgttagaaagtgactgaagcaaacaggttcaggtgggtcttacagagattaggatgccatcttgaggtgtttgaaaatttctccagaggctccgcattgccttcagattaattaggcaagtaacctgcccagatctgtttttagaaatagaactcctgtagatgtgtagaagagtgatgggaaagagaaaggactgatgtccttcttttcattgaaaaagatattgtttaggtcctacaatggcttaggtatggtttgagactctggggttacaaagcaaagaaaacctggcctctgccctgctcagagaacagcagggatagcatgttagcaaataagtatatagtgtggaaaggtctgtagtcaatagcagtcattttgacaataggaaaaggaatgtgtgaaacttctgggtctgtgtgtgtgttggggttggtgggtcaagggaggggatccaaagatggtttcactaagaagggaaaaacaccggacctgagacttgaatgcaagtagaattttgccaggcagatgatctgttcttccaggtagataatccatcctgggcagacaaaaccaggctgtagaaggaacaccatgtgtggagcaatagaaatatctcattgttactggagtataatgcatgcaagaagcaggcaaggtagacaggggccaccgtgaaggaa

SEQ ID NO: 116753 - DNA, 1069 bp, Homo sapiens
ctgccgtcttgtgcatttctctctcagtgtcggtactgattatctctacattgtaatgaattattattattattattattattattattgtttaggcaaccgaaaatttagtgctatattttgtaagaaaaatggttcctttgctgccctttaaaaatgtcctttgggaactgacctagccacttaaagttctgatttcaaataactcttcaaaactgacctcactgttgtttagaataattctcactatctgataagtcattttctttatttgtagaactgggactaaaaatgtaacctgtttcatatccctgacttccccatagtaaacattgtaagacacttcttaacatttctgcgttagtaaatgaaagtaagtgggagaaggaaggaaattggctagttagtattgcttaatgagggaaattattaagtaagctggtttagtggggagataaaatggaagatgtctttacctatctggtgttggattttatgaactttagagttctgtctgattctagcagttctgagagagaagaaatctgtgatgctcttgtgttcagggaatacagttctgcttgttaccatgtgatctctactcatttacttttattaagttcattgttttatttctgatgtatttttcctacaagtacttccttacttgtaatgacagaagtagaaaattatctgaccagtaaacttcatgtatgcttttttaatctaaattatattcctcaatccatcattggcaagtgttataaactagagtatatcaaagtatatggaaaatttgatcctaatttactattatcttaaaaatttttgtgaaactgatagtgaagcaactgctttctctacttaatgccattttttcttggttctagcaggttttgattgaaaatgcataatcctaaaacaatgtgtttaaaatgttattatgcttctctatcacatttgcatttttaaatatagaaaagttagcaaaattatcagtctgtaagtctaactaaattacttgaatattaaacgtgtttattttcaatttatatggagattcagagtc

SEQ ID NO: 116754 - DNA, 1051 bp, Homo sapiens
tttttaaaaattgaatgtttactttgaaggatacaagaaagataaatctgatatagagcccaccctcaaggaatttatattgttgaattataacatatatgtctataaatcattgtcatcctacaagagacactgtgtacatttcacaaaacagtggtggaaagagaacaggctttggagtcatataattagaacctgtcatttgccatgtgctttgtaaccttgacaaaataacttgtcttgcatttattgttagcaaagcaaggggcctctgttttgcttgagtcatgaggactcataatgttttacataacacaggactgacatgtagttaacatttaagagattataaacatgatagtattagtgatattgttgtgacatacttttatatagttcagcattctttgttttttccagaacctgtagcatgaactgccacttagtggcagccatcagaattacatatgctactgtagaggatgaaatcacttggcctgatgtgtcctgtgagaccaccctgagatattaatctgtaatctttggatgtggatattcaatttttcagagtcttcctcactatactcttaggttggcacattttagcatagattttgtcacctgtgtaattctatataattacgttttgcctatttttgtttctttatatagatgtaatcatactgtgtgtattcctctatgacttgcttcttttgtttgataaaagataaactgaggcacattaaaaacttagagggtttatttggacagacagtgattcatgaaccaggcagctccagaccatagatggtttggggctccgctaaagggacacgaggggaagatttttacaaggcaaatgcagaagcaaggcaaaagaaatatttgattggttaaagtggagcactagccttatttggatcatctcagtggaaagtgtcagtggaatatcaggattccctggcacttatttttttctttgtttagcagttatgtactcttattatctgatattttaatgattacactcactattttaatatacacattt

SEQ ID NO: 116755 - DNA, 1028 bp, Homo sapiens
attgtgatgaaacacaagagcaaaaattaaaggagaatgacaattaaatgcattgcatgatcccttgttgcatcttggattgaaagaaatctgttaagaacatgattgggggccaggcatggtggctcatgcctataatcccagcactttgggaggtggaagccagaggattacttgagctcaggagtttgagatcagcctgggcaccgtagggagaccctatctctgcaaaaagtaaaaaagttagccaagtgtggtggcatgtgcctgtggtcctagctactggggtggctgaggtgggaggatcacttggacctgagagattgaagctgcagtatgattgggacaagtagagatagactgtatctgagaaaaaaaaagattgtatcaaagttaaatttcttgggtatgataatgataatgtgatttaataggagactgtcctagtacttaggagatgcatgctgaatacttaggggtaacatgttatgatgtttgaaatttactttcaaatggttttgcaaagaaaaatgtatgatgagagagagcaatgaagcaaatgtggtgaaatgttagcaattgataaatctgagtgaaacattcatgggtgtacattctactctttctttttttagtatgtttgaaaattttctaacaaacattaggtttttaaccacatataaggtggaaagttaaggggcctagaaacagaagtctctcaagaattctctgctgtcagcttttgctctcttatgcattggatttaggagcagaaaaataatcaaggtaaaaaggaatattttaaaaacataagccatatgggatgtaagaaaacacagagagagaacatggactatcttaaagttagggctatttttttccgttcacagtaaattaatggataattaacttaataatgagaagaactgaatatgacttactaagagtaccaagattggtatgtaatgtaaggtggttaagatagcagaagaggcttcataatgcccaactgaagccactgtacagac

SEQ ID NO: 116756 - DNA, 1077 bp, Homo sapiens
gcccgaggcaaaaatatagaagaaagtatgcctgtatatgcacttatcagtatatcccctcatattttgtaccaaatgaaaaaagttaataaaagctctacaataaaaaaaattgactatatagaaagatccacaatgcccgacctgttggacaccattgtgtccttccaagtgggggactccaccagttaagtagaaatgaccattctcattgcataatagtggaggattatcaaacaacagcagcgttaatttaaaatgttgatattttgtccatcatattgcattaatgtttatcttaaaaaatattgtactaaattattatcttgacttttcagtgttttggtacccccttaaattttgtgcttctggttaaatcttttgagagagtgcatggagttgtttcattttagtatctacttaatgtttttatgtctaagtcacctatgtattcaggttcaccagcgattcaaaatcttgaggacccattgagttctttcttttataaatgaagaaactgaccacaatgggaaggttgagaccacaatttcttacttgctgtgatttctgctgaccatttaggctttcctgtggaagaaggaatcatttaactcaagcattcttgttgcctttgatatcaaagttcttaagaataaagaatgtcattggagcatattgtgttcattattagaaccattaatgcgtgtcgatcatccctagatcacttcctttgaatgtctgccaggtttttcgcagaggtaaaaatgtaaatggaaacataggtgtccttatgtaaattgcctttccattttgcgtaatagaaagattagttttgatttttatgggtaacatttgagcctaggtcagtactttctcaaaaagttccactattgtaagtatctgctttagtaaagtttcttttgggtgtctacagatggctgtgctctgccttgaattgccctcttgacttccgatttgggaattaagattttgatagaaaccttatctcacctttctgtgtagtttgcttcattagagctgataaagtaagatccacagcaaatacagaacactgga

SEQ ID NO: 116757 - DNA, 1083 bp, Homo sapiens
gtcagttagactcagagcaattacataaattaccctgaaagacttcttcaaatacctgtgaatagagcttgcagtgggagctaggagactgaagtcctttatgtttttgtttttgttccaaaattttatcactgggtcattcactaaccttgctaaacttattaagttctcttttatgcttgtggtaatgggaacccaccttagtgaaatgtttggaggcttaatcatgtttcaaaagcaccttgagcatgaatcattagttcattattagaatggtggcttgggtggtgccatcaatcatcgatgctttatcaccatcttagcctcatggttttctgcaaattgacagtgaaggtcttaaatcaaactttgtaaagacgctagcagattcttgaaggttacttattgcttatggtatggtagcactgaagtgtgcacaattatctgaagaaaataggacaattatagtgtactcattatactatctgttttcagattaaatggacaaagtgcattcaaattcataatagagatttaaaaaaaacacaatgatctctacttatattttatgctgccataaaataagatctcttagtatatagctattttatatttttgtgaaatgcttttcacttggatttttcatccaaacatattttaatagttacatttaaaaatatatattttaacattatctgcacctacacatctaatggattaataggagattcagtgaaattcaaattattccaggaagcataccttttaatttctaatttctagctcagttgagaaaatgatctagtgactgaaaattaactatttactttgagtgtttatatttaattttgaacttgatgtattccaagaatcaaaggatctgattggaagtagtgtcaaaggtcagctaatttagccttctgccagcaagctcttgactctttatctattgcgtatagcttgttgttttttgcttttcatctttttaccatgtttttttcatatatcatctgggtccactttgttaacatatcaaatcacactctatctgatgttcaaaatgcttcttacaactaacagatc

SEQ ID NO: 116758 - DNA, 1179 bp, Homo sapiens
aaactccatctcaaaaaacaataaacaaataaaataaagctgctcttgtaggtaaaaatatcaaattagatggaaatttattgattagaaaaaatagaaaagtgttgaaggctcttaaaacacagaaaaatcacccaaccaagcaacttaaatgatggtatcagacgttgagtctggatcttggtcttctgttgaaatctgtgactgaagcagcagagtaatattacttcatgttggggaaaatgcaagctagtacctacttttgtccttcagaacttctgtgattatttgtagttgaaaatataggtactataaaaatttctctattttgtagaagatagaagatgtcaaagtatagacacaatttctggctgtatttttatatacgcactcttttgtgcaatatgacgttgcctgtcctcccatcaaaaggtggagtcttttgctttatccttctatcctcttatatctgtgctggctttgtgacttggctgtgactgatagaatatggtggaaatttcgttgtgggccttctgagctttggcttcaagaagccttgcaacttctgttcttgcgtttttggaatactgccaccaacatgtgaataagctcagactggtctctctgagaataagaaatcacatgaagatggaagtctaaacaacagccagaaccaactgtcaaacatgtgagtaaggccatcttagaccatctatattagtctgttttcacgctgctgttggggacatacccgagactgggtaatttacaaaagaaagaggcttaattggactctcagttccatgtggctggggccctcaaaatcatggcggaaggcaaggaggagcaagtcacgtcttacacggatggcagcaggcaaaaagagagagagagcttctgcggggaactcctctttttaaaaccatcagatcttgtgagacttactcaccattgcaagaacagcatgggaaagacctgcccccatgattcaattacctcccaccaagtcctcccacaacacttgggaattcaagatgagatttgggtgaggacacagccaaaccatatcactatccaatcttagtcaagccttcagattcctgcagtcctttgtagtaaaactagcagaattgcttggcaaagcccagttcaaatagccagtccacagagttgtgagca

SEQ ID NO: 116759 - DNA, 1058 bp, Homo sapiens
ttgtaataaactacatttgtaagttttgagagtgaatgtagcatttacctttttcatctttcattttatttatctcattagctaagaaacctttccagcttggacctacgtcatatcactgaactggataatgaaaccgtgatggaaattgtcaagaggtgcaaaaatcttagctctctcaatctctgtctgaactggatcataaatgacaggtaaccattgtaacatgttaaaaatacttttctagaggaaaacatttaggaaatattaattattataacaaggcatgtctataactaaaattgaatacagctgtgccttttcaaattgttatgtttaagttttgaaaaccatctagatctatacttttaatgcatctgttgcttataagtgcagcaaagtttttaggtgctttaatacaaatatttgcctcaacaattgtaacaatagtaggctgttgaattttttctttgttatccatctaagacatacctgctttttgccatgcttgtaagtttgtaatgatatattatttgtcactttaacatttttgcaacatttgtggttgattttaatgatttggagaaaccatctgaaacattaacatttaaaccctttcttaaaggtgacatttttttttcagagatggagtctcacagtgtttcctaggtacaattcctgggctcaagcaatacttctgcctcagcctcccaagcagctgggactacaggcatacaccactgcgcctatattagcccattctagcattaccataaagaactaccttagactgggtaatttataaagacaagaggtttaattcacagttctgcaggctgtacaggaagtatggctggagaagcctcaggaaactgacaagcatggcaaaaagcagatacctcttacatggctagagaaggaaggaaaagagtgaagtgggaggtactacacatttttagacatccagttcttgtgcgaactcattatcaggagaacagcaaggggtaaatctgcccccatgatccaatcacctccaaacaggcccttcctccaacatt

SEQ ID NO: 116760 - DNA, 1058 bp, Homo sapiens
aatattgctgctttgtcataggttatcatttcatttgtttctgattaattataggtgcttgagtgatattctgagatgtaaaaaatatgttcttaaattcattcagctctgaaatattccctaatgaatatgacctagtgagtactgtattatgaaagggtttttttggatgaccatgcttttgctactttttagctttttagcagttaagagttgagccaaaaatcaagtgttgagaatataagctttgattatctaggcctgatgtgatccattaattgatatttttttcttagaagtttgccaaggccagcaacgcatttattgcagtcaacaaagctaattgtatgattactgattgtatgacctaggacaaatcacctaatctctctgcctcagtttcctcatctgtaaaagaaggatagtaataccatctacctgcctctagggatgcatgaggaagagttcttggcacataactaaagaagtggttgaacaatgaaaaaaaaaagctaattaaaaaatattcatcatgatgtacgaaagttcctcataacttgttagtcctgacatacttatgttctttcattaacataagatacaataattttatgaaaataaaacttacttaaaaactttatgaccttttttctacctgagtgtcagtgctgaatgttaagattaataactatgtttgtttactctttgttgtataatttttttcttttcctgctgacccattaaaggttgcttaattatttaagttaaacgcactgtgtaactaaaatagtattttttaaaaagcatttaaaaaactcgtactatagcaatacactgaataaggggatccagtagatcccaccatctgctgtttcattttcccaggtgtcagttacctgcagtcaaccacaggccgaaactgttagatgataaatttcagacataaacacttagtaagtgttaaattgcagctgttctaagtagtgttgaaatcttgcactgtcccactccctcctgccagggctatgaatcgtctttgtccagcatatccatcctat

SEQ ID NO: 116761 - DNA, 1098 bp, Homo sapiens
tctggggagatgcaggttgatgcaaacataatttttctgctacctttaacaaagcatacacaacgtcataggattactcttagttcctcggtccaggtaccaacaggtctttctttcaaaaaaattataatacaatatgtatgtgaacaatttaagatcattttgcccatttaaatccttatggaagacattatcaggtcgtgactgagtccacctgggcacatattttggcatgagaattcctggtttcttggttctgccactttagtatctgtgaacctggaaaggatttagtcactgcctctgtttctcatctgtaaagtggacaagattacatcacagctgctgacaatgaggattacatgagatagcacctgataaatagaaattattcagttaataataatgataattattatcttcctttgctactcttcctgaactttggagctcaaatgactctcgctcatttgttctcagtatttaccctaaagatcctccctttgtcatttacggccttggtaagatttaatcaattctgtgtttcatcatggtggatgtatgcttatggaatattttatccaagtcctttgttatcattaaattattcaatgagtaatcagaaatcaacttatgatattcccagtaatccctgttttatagataaggaaactgagggtcaaagaaattaataactgttcagctagggtgaagccagaattctctattggatctgtctgtctttgtttgttgtgctgttttcattacgtcacattaaaataatttaatacttttaagtgatagctaatcagtgttaagttctgtaacatccgaaatatctgtaaccaatataaagcccaggtagtttgtgatccaagcctaatggactcctattcagccagaggctggtaactgaaacacagttaaaaacaatttaaatatttatgttgctcctgaaaatgctaaagtgacaccactgtcataatgcacaacacaactttaaaaatatcctttagtgaagaattttgtgttgaattcttgttacacgcttaaaaaactaagtaaggaaaacacagaacagaaacaaaaaaaaataca

SEQ ID NO: 116762 - DNA, 1026 bp, Homo sapiens
gcgagactgtgtgataccgatattggtgaaatgactatagcaaacttgtgcaaaagtcctgggagttgggcacagagcggaatctttcttggtcctggctgtagtttggtgccatctagtggccattgcctcctctgctcctctggcttaaagttccacaggcacaatacagtttccttttgtgagctccaagacagtggcagcaattccaagaatctcttgattagttgtctctcattttgtgggcctgattggaatgatcggtctgggagaaatgtaggggtataggaacccgttctcttcttccctccttgtaatacgatgttgcctggcatggttttgccgtttcctccctttcctatgcctactgaaaggggaagcccattatgttacatgtttagatagttgtatttctttaataggtagatgtttttattagttgatttttagatcaattcttatttcctggatatagctaccctgtgtggtaatgtgaattgggaagggcggatgaccagcctctggtcattgttatttggcagagaactataggaaccacccaatctcccaatcactctgatcaccccttgcctcttcactacctatggttttcaccttcacttcacaagagtccttaagctgccccatattactaattgttaatgctgacattaacaactagtcctctcctgtccaatgcccatgccgtggtgaagatgtatgctttacctatctttataagagaggcaagagtagcatggaaaagttttccaacaaccggtttcctcccaaattaggctgcagcatcctgacttcaacgtacataggttttttttttgttttttttttttaagtttcttataactatttctctcactaagctagtttctccagtattgatttttgtagaggaagccagtagtggacagagtttaccatcctgataggaacaataaaatatattaccttatagataactgcacatttcaacttagcctaggttttaaaaaccgttagtgccaagta

SEQ ID NO: 116763 - DNA, 1043 bp, Homo sapiens
agttatcctgttatagcttatcaatacatatatctcccattaagaatgagacatatctggatttcattgttatcagagttaaaaatcataataggcatttattggtatgataggcatctataaaatttatagaaattatcattcttgggattaatgtgctgaacttttttggattctaaatttttgatggttgtcctaaatggaaaaatcctgtctcttggtggatagttattaatacacatcatttataccaatgactgatatacattttccaggaatgttaaaattttatcactcacattccatccaagaataagtgttatttgtccagtgtttgtcttttttcttgagattagacctatggtactgcaatttaaaacaaacaactgccctagaagttaaccacagttcatttttgttgcattcaactatatggcagttagcataatatttactttttttccccattagaaatgtagctgcaagtgctgtgtgagaaagatgtaagaatcttgcagtatagataagctgttgtaaatatatgtaaaaataaatttagtaaaattactgacctaacatcgttttggaattcaaatgatgccaacagttctctatgaaaaaatgatctgcattgtttttaaaacttctttttattatgcatttttaaagctcttgaattcatcttaggtttttatcacttaattcatctatatacatatgtgtcccctctatcttaagacttggtaatagaaaactgagcaccaaagtccactgaattaataagtggcaggaataataaattcagagatctctgagtgtttttgtacattttcatatgctcagaggcataaaaaatgcagtaagaagctataattaaaatgctatagtaatcacatcatgaatcaatttgattttacaaaatgaaacttcagtaggtctgttactttttattgtgtacatgtatatgtatactatattttattctctgtgatctaattatagactgcattttaaactactattttagactttaaatatatata

SEQ ID NO: 116764 - DNA, 1060 bp, Homo sapiens
ggctgctgcgaatttatttaaaacaactatcaaagtgtttaatgcccatcatagattatttgttttgaatttaaaagtgtaataaaattaaaatgggtggagacacatgtctttgggctgtgaaaggtaaattagtaggaaggaacatggtataagataaccccactcccagtaaaaagctgtatttgatttccactagttcactgattctcaagctctggtctgtggacccattatactcttaaaagttatttgagatgccagagagattttgttacgttgttatatctattgaattttttttcacttgaaattcaaaatgagaaagtttgaatatacaagcatacattctattagtcatcagaatgatgatgttatcacaggtcatgtagtctctgaaaaattccactgttactaagagaatgagagtggaaaaggcaaataatgtgttagtattaaattattattaaaatatttttgacctttgcagatacttggacagaccacaggtaagaatacctggaccaaactccgaaaattttgctgtagttaaaatacttccactttaaaactttgttttaaatgggagaagcctctagttgaagtgaaaaataaagtcttcagaatacatatgttgtatgtggtagttcagcaaagtcatcccttttaaattcagaattatttccacagtgaaagagaatagtttgacttgtctttatttgcctgtagtcttaaattggaagaccaacatatgaaaaaggggaataagtagtgttgcttgtgtgtgggtatgtgtgtgtgtgtgtgtgtgtgtgtgtgtgtgtgtttatgcctgtgtgttttggaggaagttatctggtcaaggggaattgaactgagactagaaatttgttctggtagctcattaagttaacatttgtggtggtaatatatgcattttacagcctgtttttcgtcatacattgtggtttactatacagctgttacttgtgccctatactcactaattaagagttagtagaggcactatattttgaaacatttttatatatatacaagt

SEQ ID NO: 116765 - DNA, 1023 bp, Homo sapiens
cagtggcgcagtctcggctcattgcagcctccgcctcctgggttcaagcgacagtcctgcctcagcctcctgagtagctgggactacaggtgcccgccaccatgcccagctaattttttttgtatttttagtagagacgaggtttcatcaggatatagaatacatgtttgtaccagtctcaatctttaggagattgtcatctaagtggaaagctcatgtgggcatatgtatgtgtgtgcacgtgcaatgatgtgtgtgcatgtgtgatgatgtgtgtgcacgtgtgatgatgtgtgtgtacctgtgatgatgatgtgtatgtgtgtatgtataaaacaatataaggtgatagtgtgagtttattagaaggggagttttttttgttcccttggtactttatattgcgactatacttctttgctttacgaagtgttctaggaaatctatatttgttgatttgtgtgtgttctttaaaatatatcttggtgagattgcttatgaattattaataaaacagttggcctagaaggttttgggttgtagtttgagaagtttcacataattaattgcattgaagtttattcagtgttgttttaaacatatgaaggacctaaacagtaatcccttgcatactttttaaaacaatatcaaataattttttaaagataaaatggtatagctgattggcttttctcgatgtagatcagtcatttgaataatttaatggaaaaaagttatcacgtggttcatagcagtcatttctttatggtatttgggagaagaaacagatttgatagtggtgtgacattattttataccctagaaaactatattgaaagctagggcatacatgattctgttgttacaggtagtatgattctggatccataaagtagtctttggctacttcatggttattagctatatggttcagttatttttttgtaaccccatagcctattgttctctcatgcattaagtatttattgaatactaaccacatatgaagcagtatgattccag

SEQ ID NO: 116766 - DNA, 1103 bp, Homo sapiens
acagtgccactaggttgataggctaggtagtagggaagtattcatatttggtctggaaaagaaagaaaggaccaggttgttaaatttttttcagtgtcatgctgtgaaatttgaaagtctctaggtaataagaactatagcatgagattttagcaagtgtgaaatgtgatcagattttaattcttgttttatttatctattttgagaaattaagaaaaatatagaatacaaaaaggagtaataacagctgtatgcctgtcacccataaattgacagttgttaacattttattaaatttgctgctgctgcttgaattaataaagcaaataaacttcaagtctctgttgtcttacattcgtactgttgtcccattgttcccttccagagcaactgctatgatgatctaaaatgctttaaaaaatattttaatatgtatgtggatacccatgatgtggtattatttagtttgtggtcacatgtaatttatatctagtgacatatggttaaatatctggtctcacaaagtatatatgagtctacaatttgcatgtttacttttatttttgagatctagccataatgggtataattcattctttttcattgttagtattctattatatgtataaatctctgggttattcatttcctattgaaggacacttacattgcttctactgttttactatcagaggcagtattgcaataaaattattgtataaatctcttgtgctcatcttcaagagttctctacggcatatatgagaagtatatacaatatggtactaagatatgtacattttcaaatttttctatatcatgtcaaatcactctctactggtaattgaaatcatgttttagagatgtatcttgctgatggagtgtcaactcttttgagggccaggaatatgtgctcatctttttattcatccctcctagtgttggaatataatagacattcaataaatgttgggttagggacagatgggttactactgcattgtgcatgctttaaaaaatgtatcacttcaaatattttggtgacatattttattaaataaaagcttaaaatagcttaaagagtcaaatgttttttcactttt

SEQ ID NO: 116767 - DNA, 1290 bp, Homo sapiens
aagttgtctagtacgaagtctgacttacaggagatatgtaaaacatagtagtttttatggcatcacaactgtatttgttacctaacttttggttttcactttacatccaaggtaaattaaaggatggtgatctcaatttagaagttttctgtttctcaagcagtaggatatttgttgacttttatttttcttgttgagtaaacataaagaaatagttttattggcaatcaaacaatttttagccaatggtttcccaaagaaagcaactgtttatgtttttaaggtttttgttatgttcacattagtttttttctagtattttggtacattaaaaatatgttatatacgtaaatgctaagggcatcagttttgtatttttttttatttaacattttcatttcattggaaatttgaggtaattttgctaagtcttaaaggctaattcactacagttcttcccatttaagtttattacaaaaggaaatttagaataatttgaactctttattggataattgagatattgataactaacctcctataggaagtttgtatttttaaaatttatgaaataaagagaaatatttaaatacttgcgaagccatagctttaagtaattaggatgtttttactttgacacctattcttagtaatgtaacaacaaatattttaagttagcaactaatacaggtacgtacagagaacactgtcagaaagaatgccaaaagaatttcaactatgctttgacaaatactgataatcagtcaaattattttgctaattctcttaataaactgaatattctcaaaaagagtattatagcttaattgcagagtctaaaaataatcatagcatagttttcatataaactttgctgacttaaaatatcaagctattttggtagtatttgagtatacatacatcttttcatattatatcttggcctttagatggcagcattgtctttgtatatttctgtgacatagcttttatgtccttgatgtaactataaggatgtaatgcctctataagtttctgctgatggtttctgctgatgttgtggtttattttacatttttgttctttatgtgaccttaatgggaaaatttcttcttaagttatttaaaataattgtatctagaatgccacaggatgaacttaccattttacacaaagtagtaagatagtagaacatttttatttgtggcactagtttaagtaagataaactttagaaaaggggaaggattcctgtgtttatgagggagaagttttattcatgtggaaagtg

SEQ ID NO: 116768 - DNA, 1479 bp, Homo sapiens
ggtaacatagcgagaccctagctctacaacaaaatttaaaaagtagccaggtgtggtggcacacacctgtactcccagctactcaggaggctgaggtaagaggatctctttagcccaggaggttgaggctgcagtgagccatgattgagccactgcactctagcctgggcgacacagtgagaccctgtctttaaaaatatatatactggagtaatagatatgtaattttgaactgttaaggaatatacataccttggagggcttgtaatgtgagttggttgaaacgggggtaaattagaaggttaaaaatgtttatacagtactgttttaagttatggattgcttacattctatcttattttacaagtaacataaatatttaactctgacgtggttattttcaaaaaattatatgaaaatctcacttgaaatatgttgcctttgttattttttgagcattcagctaaatctgtttgtttacagctgggctcaaaatgcagagaactcaaagatattcatttcggccagtgttacaagatctcagatgaaggcatgatcgtcatagctaagggctgtctgaaattacaaaggatatacatgcaggaaaacaaattagtaagtacttgttatcatccttgtattgttcattttgttcctaaccttcgaattctttcaagtttatttataattttttctgcttattttcttgtgatggttcaaatactacttaatcaaaagcaaaaatccttttaaagtgatgattttataaattgatcttttaactgaatagatggtgtttgtgtgtggtacttgcatgttaaaaatccctcattagcatgtgccaatgcatcttttctaaatgtggacagtgaactaatactggtaaattggaaaaatcaaatttgtttgccaaacataagtctgtggttgtgtagttctttctgatatctctagggattataataattctagacagttagaattttttttattgtccagaaaaatgtactcttgtaaaatagagtcttttacttagtatcataaaaaatgggattcaataagttagagcatataatagggcaattacatagattttatattttaagcacatacatgggtaatgcagacacatttaatatattgtgcttaaaaatcttacaattttttttgagagataattcacataaaatacatttcacccttttaaagtgtacaactcatcggtttttagtatatttaccatgttgtgcagtcattaccaatgtctaatttttgaatattttcattacccctaaaaaaatcctgtgcccattagctatccctccccattttacccttcttctagtccctggcaactgctaatctactttctatctctatgggttttcctagtctagatattttgtataaatggaatcacgtgatacgtggtcttgtttctggtgtctcagcatgatgttttcaaggctcattcgtgtt

SEQ ID NO: 116769 - DNA, 1193 bp, Homo sapiens
gagcaagatgtcagctttagcactcagaaaatctaaggtggagaaggttgcttacaaacaatgctaaatgggattgttaacctgactctggagtttggctaactgactagtcattgactaggctgaccagcagagtggccccaaatagagaaataaagattgcttgctccctgtatgcagtttattcacaaggggaagaagtatacatatgagctgaaaatatccagtttattaaatacagaataatcagtggagagaccgggaatcagactagttgggcttcctacagaatgagaaaacattttcccctggcatgtttgtttgtattttttaaaaaacttacccacttttgactgtttattgctgattccttgtatcaaagataaggatttagctcacttatacttccttccctgtgtcttatcctctcatccttccaacataattctattataatttttgttaaataagtattcagtatttacattctataattatgtacctatcttttttctctaaagcattttgttttcattggaattaataaatgtctttttatttctttacctagtttttatactcttaacactaatgaagaccaaagctttcctccagttgcattagtatgtctatatgtgaatacttaattacatttactgccctacagcagatttgcctgggatagtctagtctggacttctcatatacaagtgtgatggcattagtggtcaccttagtatcttacgaccgttatccttaagattttctttctcttgctgttgggttagatcttctgttacccagatgtcatgttttctttcccttggtgtattctcgtgttttatagagcacagattccagtaccttcctgataaagtgtatatgggaggtaaatcttttgataacttgtatgtctgaaaacatctctaattctgctttcacacttaattcataatctgaatcccgagtacagaattctgggttagaaataatttatcttcagaatttgatggcattggactgttgctttcttttagttttgttaagaagtttgatgcattttcatcctaatcctttctatgaagtttatctaagtctgtagaatctctttaaactcctgtttctgaaactttttgatgatttgcattgccatgtgtctatttttgtcatttatgctggacaagtggataagc

SEQ ID NO: 116770 - DNA, 1008 bp, Homo sapiens
attctccgtgaagacctggtagagctcctgtagataaaactcacaaaagcatgagtgttgtcttataacctggtccccctggaatttttaattatcagacttatccacgctgtgcctccagtattttgtcaaatgcagagttcaggttttcctactctagccctggttcccgctgaggtttctggtagtagtttctcttctggtgagttgtgcttctctgcatctgtctgtctctgcagttttgtggcagtggtttggtctgtgtcttcatttctctgatggatctaaaaagaattgttaatttttcagtgtgatcagctttttattttttagaacagattggcaacttctaaactccttacatgccagactgaaaaccagaaatcttttcttttaaagcaagcattacagttactgaatgatcatccttgtcttgtttgtgttcagttttatgctttattatgtggaaagcccaaggtgtttcccaaatccctctaacttggatcatctagaataggccttattctagggcatagttcttgctcccaaggtaccatctttttggtgtctcagctggatgccagggcacttcacaggatttctcccttttgacagagtagagctccagtgtctctagcactgtcttcctggacagataattttttatttagaagaattatattcgtccaggcgcagtggctcacgcctgtaatcccagcactttgggaggctgaggcgggcggatcatgaggtcaggagttcgagaccagcctggccaacatagtgaaactccgtgtctactaaaaatacaaaaattagctgggagtcatggcgggtgcctgtagtcccagctactcgggaggctgaggcaggagaatcgcttgaaaccagaaggtggagtttgcagtgagccgagatcacaccactgcactccagcctgggcgaaagagcgaaactccgtctcaaaaaacaaaacaacaacaaaaaagaattgtattctatttctat

SEQ ID NO: 116771 - DNA, 4390 bp, Homo sapiens
atgaataactaaagaaattctattgcttaggaaattccaagagttttgggaaatatgtggcaagaattcaggacaaagaccaattacaatattattattataccaaattcttgttatgcttcaatgttaagacggtttctcttttgattatatcgttcatgctataatctaattagtatattgtttattgtggaacatttaattaaaaaatggaaaatacgtttttatttttagcaaaagtttaaatttattgctttttctcttacaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcaggtaaattttagcatttataaagtgattttacttgaattaattaaaaatgttttctagcaacaacattttaaatggttacgttaaaaatagttcccagagactcaagtgaatcatcttttttacctattaatgaatatttgtttagattagttaactagagtgccatggttataatcagtaaattaactgctttgttttatagtgagagcctgaacttctgtgaccagccattttataaatttatgcttttgttacttaaattttttaccacattttgctttgggcaactgcgtagttttggtcagcatgaggttttaaaaattaacattttaattccccttttattatactagatgacatacatgcttaaatatctgaatgtttaagggataaatggacgtccaaattgaagattataaaagttagaacaaaggcctaattacctctatttggtacaataactgggttaaaaatagtattatgcataccttctgtttattatacttcctttggaaatggcatttaaggtttcttggctcggagtggattatttattcaacagatgaatatccttaaatttaaaccttatgtatgaattaactgaaagcttggtatgaaaagaaatttgggaagactctatcctaaatagtgagtactgggtgtgtcagtacaacttatatattaagaatgttaccaacttataagggagcctattttgtttgcaaaggcatattgtgcaaaaagtcttatttgttttaatatttttcttgattcatttctgctatgtacaggattatttactagcaaagcatttcatgaagttcttaaacatattaaattaatcttttatgaagaaatatatattttgtgtatatagcatgattttatttactttgatggaaatttctcagcaatttatttttcacaatgaaacattttaaaaaggtgtatgtattaagaactggattaaatctatttcatatttaattctgatataacacaaataggtagtagtttagcagacttcttagggtatacctagtaatttttgtgaaaaagaataagatcgtagtcatggttgaagtagagaaggagcaacatttaatatgctaatcaagtattatgaatttatcttatatttacaactttgagagtaattatgtaaatcttctctagaatgtgaggtattttggagcctgttacttagatgtttccttcggatatttatggtttctgaattatgaattagttacacgtgaggtaatattctgataaaagtagcaaaacaaatttttttccccttaggtagttttcttcttaagtaattacataggatctcattgcagtgtagagaatatttttctgtacttaagaccgctatagctgggtatgtctgatttcataatagactctttcctctgatggaatagtgttatgggtatagtagaaagagaatggctttcatatatacataaaatagaaattaagttttatgaaacaatacacatccttatgtgcaatgcacatggatattatctattctgttctatactattatgttaaatgttggccttgacccactcactaaattaattttatgacctagtgatatttcataaatccgaatatggatttatattatggttttagtaaactgacagtgctatgttaaaatgtataatagagttacgaaagcctaagagggaactagccataattgatgatttgcctgggactgttattttttcttgaactcattaatttagcaattgactgaattgttgattctacagattaagttgttgcagggttctgttttttccctcttctgtcagtaaaaattgagaaatgttttagaatgatatatgtaaattttattgataatttctttagaatatattttctttataactgctataattttgattgactttagcggataccaaatatgtgtgccttttgaattctgtcagtttgtttacaaaaacagttgcttatagcatttcaatttggagctctaatagatgtagactctaatgttttaactattggattctgcttaacaatatttcttaagcatggtgaagcacctaaaaaaatcaggctggttttggttgaatactatcctctttgtgaaataccaccctgaaatatttatatttttattttcataatagtcactcaaaataattttaccagtggaatgtgttcctattgtatatatcttttaaaactacaatcatgtatctagaggaaaaatctatttaagaataaagggctgtttcaattttcctaatattttgttatcatctagcacttgccagtaaacaaacgataatagtagtcaaagtattaaaatatatctaagaaattgtatgcattgttactatattatgtgactcaattatatgcagttttagcagtttaacactccagctcatggagctcagtagaaatttctgtaaataagtcactgtaggcttttttcagataaaatggtacaaaaataataaatgttacattagtaaattttgatctggctatgctatcaatttttaggtctttaaaaataactacttagagtactatcagcaaaatgttggagcaggcagctccaaaagcctgcctctccaaaaaaacattgaaaaacaagcctaaactatcagatccaactttgtcagaactctggaaacgtcaaaggtttatagcaaccaaaggaatgctagacaagaaaaatgcaactgaaaggtggaaagaatgctttgtgggttttttacttgcctgtgcctcacccattccccagcttggcaacagtcttgaagatagcagtccgagttcccagtgtgggacccagatccctggttccagagggaacagagcagaccttatttgcaaattattcatttgtctgatcaacctacctgagagctatttgaagggctgatgcaggtgcttatatatctgttttacctaatttagaacccagtcagggaggaaaattagtgggcattgattgaacacagtataaggcaaatgaaagaaacttgcttttgagcaagcttctttgggcaatagattatggtgagacatacaattgacctaggagaaagagcctgggagagagtttgtttttatttttgtttttgttttgaaattaggacaatcagcctcagtgtatagaagggaattttgaaagccgcatgcatgcccagggcaggacacttgttcaggaacgacctaagaagactgtaaactttatcactgtgtgcttgctaggtccagtacaagcaggaagtaaaggccaaggcagagttgtgaatggtatggctaagtcttaaagaaatatcccagcacagagccagtctgcaaagacttgaataagtgcttttgttttttgttttagttttgtttttaagctttggcatccaaggaaatctctttcaaaacactggctgaacacaagctaagccttgattaatcaaaaatagtgaagcgtagggaagtggggagaatctaatttcccaagttaccacattataatctaatattttaatatttagttttcaacaataaattacaaggcatgcaaagaaaaaagtattacccattaaaacaaaaaagaataaatagaacccattcttgaggaagcctggacattggatttactaaagattttactaaagattttaaatccattatctgaaatatgctcaaagacataaaggaaaccatggccaaagaaatgaaggaaattaggaaaataatgtatgaacaaattgagaatgtcaatgaagagctagaaattatggaaagaaccaaatagaaattctggagctaagaagtacaataactgaaataaaacat

SEQ ID NO: 116772 - DNA, 1179 bp, Homo sapiens
ataagttgttccctttctgtttttctccttcattggtaagaggttaaaactattaagataatttgttatttacttgcttgggttcatgacctttatatccaaggagaatggtgagggagttagttgtgggcagtagaatggagagcagatatgtgtaaagcaatctatcagcttgttacatcattactcttgaatgtttgagttatttattatgaactcaggctaataatagcttcctcccccacccaaaccccctccccacccagcccgctactggtagtaaggtgtggagatgaaaaagtaaaaaataaaaggagaggtatgtcagagttataacttttccgagaactgtgtttatgctgtttccaacaagcataaacgaagatagttttatctttggctgttactccaagtgctgcttaacagtgtagttctttccttctattctaaatttcatttgcattttctgtctccattatttttactgaaaggacttgaataacattaactttgttttgtattttggaaatgtggtgattgggcacagaatatgtagaggctggttttaaaacaaaaattcagatggccatctgagtttttcaccagatgaattgagtcgtctgagaaaaactttttgatgtggacgttcctatatagtctttggtgttctgatatgcaaaatggtgtattttccaacctatgaattatatgcgaggtattgtttctcatagaaacagtaaaagattaaaaacttacacgctgtggtatcatctgatatcaagtgtaaaagtgaattttcatataacattattactgatgtatactatttcatgggttacaaatggaaagtgaaacattgaaaatctcagtatagttttatttgtggtgagtttttgctgaatttgaattttcccactaaggatagatttttaggcttttaatgagacgaacacatatcctttgttggtgttttctgataccacttctgacatcaaatatgtggagtttttccacactaacaattttctaacactaactggatgtacaacaattcagttcaactaactcccagaggtatcactgagtttaagggctcagtcccacaagactacccacacttcagatatcagttgcaagtcccagaagccacctgaacttctcactgaccaattataaact

SEQ ID NO: 116773 - DNA, 1001 bp, Homo sapiens
agtctgactcagtgaacctgcatttttacataaacaatatggcagaggaagcaatcagatatgcatttgtcttaggtgagcagagggatgatggagttctgtctgtcatttgtcccatatctgtgaagagaagctatcaatttacatggtcagggtgaaattcagcagaactgctttagggtcaagatcttgaggtccacagagaatttccttttggtcaaattgtgagggaagtatgtagcttttttttttttttttaaatccttgtagctatcttatttaggaataaaatgggaggcaggcttgcctgatacagttcccgccttgacttttgtctttggcttagtgattttggggtcctgagacttatttttctttcatacttgtttacttcccctgattttattttcttctgacactgtggtacatttgccaaaactatgaaatcagcattgtacattactattagttaaactccagtctttatgtggtttcaccagtttttccattaatgtctttttctgtcccaggatctaactggataacattagttgtcattctttcttagtctcctctgaattgtgataattgctttctttttttgttgtttttcatgaccttgaattttttgaggagttttgatccagtattttgtagaatgtcccacatttagtatatatattttattattagattggtgttatgaatattttggaaaagataccataaaggtaaagtacctttcttatgatttacttttgtttttctttttttcttaaatcacatatgaaaagttcacgtggctccaaggtcaaactgtaaaacttcagaataatctcaagtttatcactctttcttccctagtcttttttcccttcccagaaaggtaaacagttttttttttattagtttttggttaatgctttcaattcttttttttttaaatataagcaaacacaaagatatgcatgaacacgtgtcagtacatgcctgttctcttc

SEQ ID NO: 116774 - DNA, 1003 bp, Homo sapiens
caagctgtttgagcatatctttggcatgtacatagctgaaaactaagatattcagacacagaatgacttctctagaaagccaggctaaaacatatatatgtgaattaaaatctgaacagatgtagtcacactgcccaggacacagattccacagtttagggccagacatgttaaaaggctcagaaatataaaattctacactggtggccaggtgcggtggctcacgcctgtaatcccagcttgaacccgtgggtggaggttgcagtgagccgagatcacaccgctgcactccagcctggcaacagagtgagactctgtctcaaaaaaaaaaaaaaaaaaagaatatacactggctatgttatccaaaatgtccagtttttaacaacaaattttaagacacgtaaagagacagaaaaatgtgacccatgctgagggaaaaagaaagcagttaatagaaactgactgtgagtgagcctagatattagacttagcaaagacttcaaactgctattataaacatggtaaaagaaaggaaacattatttaaataattacaggagaatatgatgacattgacccaacaaattggaaatctcaataaagaaatgagagctgtaaaaaaagttttattctttttgatgctattataaatggaagtgctttcttaatttcatcttcagatgattcattgctagtatataaaaatatttgcttattagctctaaaattaatttttgtgtttattctctgggattttctctatataagaccatgacatctgtgaatagaggatgttttaattccagctccccaatctggatgccttttgtttatattccatgtctaattgccctagccagaatctccagtacaatgttgcatagaagtcatgatgcagaaatccttgttttgtttctgattttggggaaaaacttttagacttttaccattaagtataatgataactaggggttattggtagatgctctttctcaggttgagga

SEQ ID NO: 116775 - DNA, 1305 bp, Homo sapiens
gtgaaagagttcctttctgttggtttctgttttgcttcagatagagcttggttacctgctgaagggtggaagagaagtggcaggtgtttaaaaaaaaatctgctaaggataacttgagagagctgactgaggaagaagtattgcaatattcaaggcccagtggcttggagaagaccactgttggaacctacattgctattcccactatagtggccagccccacccagcctgctctcaaacatgctgtcaaacaattgttaattctggcctttttgtcagaaatgaccaatcttaagtctgtcacattcagggatcctttcagagcctaatgacagttatgtggaattctagaagcaaatatttgtcaaaagatttcacagacatacacgctattcactatcaaatgcattgcctgaacgacatttacgtacacatataatccacataactttcatccatttgcctgtaggagaatcttccagggccccagagcagtgcttgaggacttattacagatcctttgacatctctactaggctgcactttcacaaaaggcaagagtattataaagtgttttgtaactttatgtcaaaaatatgaacctgtcagagccagatgtggtggtacctatcattcaaactacaacagggctggtgaggcgtgaggatcgcttaagcccagcttgttatgattatgcatgtgaatagccaccgtagtccatcttgagcagcgtagcgaaacacagtctcttaaaaaaaattgcgacctatacatttcatataagttaaatacacatcttccctatgagccagcaatcccacatctaggtatttatccagagaaataaaagcatatatcgataaaaagacatgtacaaaaatgtccgtaacaactttattcatggtcaccaaaaactataaactgcccagatgtccatcagtgggagaacggattaataaactgatatattcatctaattaaatactactcagcaacacaagagaaaaagcatggatgaatctcaaaaagttaggatgttttatgctttctggatacggggccctcgaatcgctacctggtaacaggctccctatgtgattcctgtacagacagcctggcaccatgcaaatgtatcagaactacacataccatccaacttcaacttcttgtttttagagatgaagcaactgactctgagagttctgaagtcgttgctaaaatttacaatatttgtttccttactcccagttcctaaaccattcaaccacaagcaaattgtctttggtctacctattggactctgtg

SEQ ID NO: 116776 - DNA, 1037 bp, Homo sapiens
tcaaacctttatgaatttgggcaaaagaaggaagttaggtatgggagatgcaggccacagagtaccttcagggattattttcttcatggtgatagggtgaaatctgtccttatcttcctaaagagactcataaaactctggatgtaatgagttctatattgagaaataaaccaaaaattgaaatttagaatttttagtgctgtactccagtgatctaaagaaaataatgagttgcatatttgcaattactgtaatgtgacttagctacactattgtaatctgcacacagatttaagacataaaatccctgtgctccctggtggcctcaggggtgacatcacttgttatgaaattgagagggagtagttcaaataatgtaatggaaaaatcccaaatgcaaatgcagttggttatgaatccaggaagatcactgtgtttatacccagaagactgactacatctcgtaggaatcaggagagtcttttgctgttaccacaaaactgtctgttcacaatcctgttcctcctactcatggagccagattttagaggttaggaaccagaccttagtgtaagggcccacagccactgcttttttggcagaatgggaagtagggagtctaggaacaaggggtaaaactctactccttttctctaataatctctccttactctcagaatgagagaatttgtgcaagtgtccaagaagtgttcacagtaggcctgtgaaataggcacatgtactggggtcacacagcacagtaaaacaagctctgctctggcatcaaactccctggactgggtttgaacccctgaccattactagattcatgaccctgggaaagttctttaatctccctgagtctgtttcctcatatgctacagtgggaatcaaaatatctaccttgcaaaaattattgtgaaaattgaagataaataattattttaatgttttccacagggtagaaattcataaccgataatagttaacttataattattactagtattatcttctccttaccctctcctatcact

SEQ ID NO: 116777 - DNA, 1001 bp, Homo sapiens
aaattagctattgttttaagccactaattttggggagagtttattacatagtagttggtaaccagaccatccaagcttattgctgtccttcctagtcacctctcttgtcactagcatccattttttccccttcttctctccaagacagcctcatagcatctccaataccaattttacccaaatgacatttattatgataatggtggttcaaggaaccatatagaaatttaattgtcagacaatttgcttaatagcctaaatgtgaactgtaatctttatgtttggatatcttcaagatctgggtctgtcctctacttagtgagacaatgtattccctcagaaataaatttttgtaaagccctaatcaacattatcattacttattctgatagaagtatcagtattagtaaaccctaaacagcctcagggcttaaacttcttttccatttagaaatgtcaggacttataaaacacaactttgattaaagcaaagaaataagtttgatattcaatgatgtaattagtgtccaaaagcttagggggaaaaacagcatttttaaaacaaagcagaatgaagatttgatttctatgcttctctgagagatttagagaggtgagaaaggaagagatgaagaggttgcaatatgtttgcatagtcatgccattttgatttttcctccaatattttagaaccattttcaatcaaagtgtttcccccactactggacttcacccatgtgaaatagtagacaaatctgaggtatcaggaccccctaccattggatatcaactgtagcagacccaagacccccttactttcctgaaatgaaattcacaggtgacatctatacaaataatatgagctaaatatatagtgccctaattttaatgtaaaaaggaaataaactaaaagtaatttataatcaaatatttcagtaagtaagaagttgggctcaataatactacaagagtaatgaacaactgggtgcctgcacatacac

SEQ ID NO: 116778 - DNA, 1021 bp, Homo sapiens
attgccatatggccttgtgacttgatgtgaccaatgaaatgggagtgaaaatgttgtgtctttaagagtcagggcatgaactcttatgtccatttttgtgtgtgtgtgtgccttggtgagtggtagacagactttcagatggcccccaataatccttgccacctggaattcacatccatgtgcaatcccctacccttgagtgtgggctgatttgatgacctgcaacaaatcactagaatatggcaaaggtgatgggaggccacttccattattgtattacataaaactataaactctatcttgctagcacattctcttcctgcaaggaactgaaatctatcaacaaccacataagcttggaagcaaatccttccccagaaaaaccttcaggtgagactcccaaccctgactaacaccttgatagcagccttgtgagagatcttgaagccaaggacccaattcaagccatgcctggattcctgacccataaaacctgtgagaaaataagcaggtggtttttttcttaaattgctaagttggtgataatatgatacagagcaatagaaaacaaattggcaattgtggcaacacagatatggagcctcctttaagctaggttccagctgacccaatggacatgtggtgtggttgcaaaatgaagctttagtatttaaagcaactatgattttggagttgttactaaagcatactttagcttatcttgactgaattataaggcagttttttgctctccctgccaggctaccacattattgaacaaagaaaaaacccagctatgatagtcaccttgagttatgcagacaacagaattttgcatggatccaaaacttagtttaaaaatcttacctcctcccaaattaatattcagctataataacctctgtgcctttctcagcactgattttaaaatatgacctcatcaaagttaagacctattcaaatctcatctttgaaatgcaaatgatgctaatattatgccaaatttcagagtaattgcctc

SEQ ID NO: 116779 - DNA, 1094 bp, Homo sapiens
aaaaatttagctgggtgtggtggcgggtgcctgtagtcccagctactcaggaggctgaggcaggagaatggtgtgaacctgggaggcggagcttgcagtgagccgagattgggccactgcattccagcctgggcgacaaagcgagactccgtctcaaaaaaaaaagattaccttcttttgttgatataatgcagttcccttaataaattatgctttagaaaaatgttttcagctctaatttttatgttatattattttaacaggtccttatattcagccactccctttgcctttattgccaatttacaaaggacatcacctccctctcaaccagaagtggggctttctcaaaactgacacctctggtttgtttgtatttttaagagatgggggtctcttttttttttttttacaactggtaatcaatttattgaaatagttgacttaagcatctgcaatggtgacttccacctcaactcctggctcaatactgatggaagtaatctgcttaacaatctcagaaggactgtgcaagtcaataagtcgcttgtgaattctcatttggaaacgatcccatgtcttagaaccttcaccacaaggagttttttttgtagtgattctcaaagtcttggtaggcattcgaactcgtcctttcactttgagattcttctcctttgcgcttctaatcaagtcagcacacaccttttctagggattttacactgcggctcttagggtgattcgaattcggtgaattgccacctccggctccacgggtgtttttccagtatccttaaaagccatggttactgcgtggcttcctgaccgacttgttcctcggcgagagcgaacggcggtgagtcaggagcaggagtgtgcggaccagagatccacagcacctacgaccacgtccttcctttttcaaaaagcgggggtctctgaaaggttcagcccaggctgaacttgaactcctgggtaagcaatccttctgcctccatctcctatgagctgagactacaggtgcaagcgactgcacccagctattctgatttaacacatttcccagccccttacttttgattaattagtagccag

SEQ ID NO: 116780 - DNA, 1022 bp, Homo sapiens
cttcttcattctctctttgcctgctgtcatccatgtaagataggacctgctcctccttgccttccaccatgattgtgaggcttccccagccacgtggaactgtaagtccaataaaatatttttcttttgtaaattatccagtcttgggtatgtctttatcaacagcatgaaaaaggactaatacagcatgataaggattatgatatctcactttaaattcttctctattgtgtgtgtgtgttttaatacagagaatatgttggcaatttagttataaaaattgataataaaaatatttaaagaagagcacttctctcaacaggctatatttcaaatttagttaagctctagatatagatacagaaaaaaatccacactactttgcaaattaattaatactcaagtgagtaaaattaagaaaggatgttattaatagtttctatgtcattactgggaagttaaataattgccaaggagttctcctggagtctgcatattcctattgtgaaaaaaatgctaaaaaatgagcaaggggcatcctgcaagacttcatgggctctgatagtcagagatgagaaaggaagaaaaggaaacacaaatatttgtgaatgatggagaaaatgaattgttcattgaactacagataagaggacatctatactttagtcatgctgtccaaatgcatttatttttcatattgatttgagaacctatcccttgggtgattgtgactccacttaagggagcttaacaccaattcccaaagccatgagtgtgacagcagttcagcagagtcacaagaaatgcgtatttgaaatggcaagcagcaggtggctgagtccttctctattactttttaaaatcagtatgcatgtggtcctgatcaaacaaatcttagactcaaaatcagcccctatttatttattgaggaccagctatgtgctgggccctgggctggatgctttcacatattacatacctcattaattccacaatgttaaaaataaatgtgctttctgcta

SEQ ID NO: 116781 - DNA, 1034 bp, Homo sapiens
gagaaagagaaaggataaattcactttttatttcatataatttcctcttttaagtgttgtttgccatgtccataaagttcataatacagtatttatataatattattaaagcttgtgcttatctcattctatttttttttttttttttacacagagtcttcctctgtcacccaggctggagtgcagtggcaggatcgagtctcaccgcaacctctgcctcccgggttcaagcaattctcctgcctcagcctcctgaagtagctgggattacaagcgtgtgccaccacgcccagctaatttttgtatttttagtagaaacggggtcatgtcggtcaggctgctctcaaactcctgacctcgtgatccaccaacctcagcctcccaaagtgctgcgattacaggtgtgagccaccgcgcctgacccattctacttcttttagaatatctgaaatcaggccatttcccaaatgttgatgatactttcctgcagactggcaactaatattgactcaattcattctgacctctttattcccatgttagtcattgatctgtacactcttcaccctcacctagatgtctgcaacttcctacttgaatctaccaccttcattctttctctttttctacttctccctgtttgggccattgtacctccttcacgaaactccttaacaacttctgatggttctatagatcaagttcaaagtctcaattttatggtgtatgactgtagccagaatacctactgtgtggagtcagacctgagttttgatacctacctctgtgtcttgaataatattacagcacagcagaaaagtagcatcacaaagtaacaagaatcacagactctgaagctagatccactagttaaatcccagctctatcacctattgcttgtgtgacttaacctatccacatgcttcagttttcccacctctaaaatgagggtgataacattaccttgactcatagagttgttgtaaggagtatctgaagtaaagtgtgtaaaacttttggagtggagcctggca

SEQ ID NO: 116782 - DNA, 1044 bp, Homo sapiens
cgtattcaccaaccacatctttctacattttgattccctttgtataaatggagaaattctaaggttcttgggaaaggtattcagtcatgaagcagtctccaaagttgtattttggccttacctaaccaaattttcattcatttcattcttattgacattacatatactataacatttgatgttcacagaaaattaacttctattttaagaagtttactcacagaaccacagtttgtgcatttaacaatcactatgaaatacatatgaaacattaaccatcattttagagaacaatttaaaaactccgaagtaactactttccttaactttgtcatcccaacattctgggtataggcattgttggaaaaatataattaaaaaccaaaatctcccaacccagaaatcctctccacaaacgttagtagacaaaacacttttattactgaataagcattaaacgagactgtgatacacatcacaggcaatttgctaagagattgcaaagacagaaatcttgcccttttgtatagccaagtatatacgacccattacatacacgttttcaagttgaacaataactagtcctcaagtaagaggacctgacatttgtgacattaactttacttaataattggggtgaccatctgtgttagttaattggttttatccagaggaaaaacaaacttctcctgtctttatgacggaaggtagttttgcaacacggagcaagttgctcaccgaagttacgctcctactctctcacagaaactgggagatagggaaggatgctactccgttgatatgtgcagcatttcaaaaaaaaaaaaaaaaaaaaggtccagagacattcctgactgagcatacagttgacaagacctatctagtcctcaagtggatttatacacatttcaaagagttgagaaagtacttaacaattaagaaagtacttaagttttctaagacaaatgctcggagagaaagggacgggaaatctcatcctccattttcaatagggagaattaagcctcttatttaaaattttta

SEQ ID NO: 116783 - DNA, 1017 bp, Homo sapiens
aagttgcgtatattaatggttgtctcactatcactttgacataaactgctgtaaaggtgtactccattttccttttctccagatatgttaagataataaatttctcagatgaggttaccatatataaaagtgtagtggaacatcaataagagaatagatcaaaactattttagtgattaaagattagaaaatacttttcaattcatatgtggaatgagaataggataaaaaaaaaaaactattgcaaaatctttagtgcagtatttgtagtcctggtatatatacctgtgttgcccttaagaagacatttgtgagtagctccaggtttgtcagtcgggaaagcagagtgtatctttttgtagtccaggaaagcttttctgctagtacttttgagccaagagaattatgcttccaaagatgctgggaatatattaagagagtacataggcatacttctgttttcatctttgaaagacctttagtgaagatctgtttctcttctgcattgattgttgacagcattaaatatacataatctaaaactatgtagtgtcaagttgttgcagcttctgcactgcttcaaaggttgatgtctttagttcagaagaaataattcaagctttggtagacaaatcatttacatttcatcttcgatgtagatgttactgtaactctggaccgtgaacatttcaaatttgccagttttttctcaactattttactatgaaaaatttcaaacaatgcagaagagtcgagttgaacccaccacctatatatttagcaataacgatttcaagaccactgttacacagtaaacattaaggaatagaggaactgaaatgatcaagcttaaaaaaccagcgtatgtggccgggcgcggtggctcatgcctgtaatcccagcactttgggaggccgaggcgggcggatcacctgaggtcgggagttcgagaccagcctgaccaaaatggagaaacatggtctctaataaaaatacaaaattagccgggcatggtgg

SEQ ID NO: 116784 - DNA, 1076 bp, Homo sapiens
gtaagtataaatattttagtttaccatataaaactgctgtatggctgacaaaatatgaggccatattttttctttggaattcaaagtatctaggtaaaacaaagttttcttggttcttttcaagaaatagttcagatttcttcatttttggaggatattacataattcagctttaaaaatttaatgtcatgcatgtttggaattattttaaaaatattcatatcagacaattactaatttttattcatcatcaccattcattataaacttgatattgtcactttttttagtaggtattaaaagactggacattttatgtaggttttccttgctaggtttcaaagtgtagtgaaaagaggagccatttattttagagtcagataatcgggttttagttccagtttctgttctgtgggatcttggacaagttattttatctctttaagtcataattttctcatctattcaatagggatagtaaaattgcttcactagcttgttacatagaagaaatgagacaatgtaggtaagatttaggaagtattaaactgactttaggaagtattcagcttctgtattcagttctttatgtgataacattgattttatctctccttgtattaatgtgtttattataccatccacaaagtccttgtttcagacataagaaattaaaatataattaaatttacttaaatttaaatttacaataaatttacttaagttgaatgacatttgcatttatacaaataaatagttagaaatatctcagattagctgttctttttataaatcttagcttattgtatctcagcagggataattataaatttactttaaatgatttttaactccaaaatatctccagtttgtctggattcctgatttatttttctttttgcctagatgatcatgtgtttttggatggttgccctaaattcctttcatttaaaccacaggtattagctacacgttactgtcttaaatctctaactagtgcccccgcaaacacattttctcaatctgtttaaaatttaaacttcatttttaaatttaataatacccttatttgtata

SEQ ID NO: 116785 - DNA, 1040 bp, Homo sapiens
caaagtgctgacattactggcatgagccacctcatctggccatcattaaaattttatatttaaaaataattttgtcatgaattttatcgttttatataacaactcttgttgatgccttactttacaccaaagtgtacaaatcagaggaaaccataattcattttggaatttcattcatttggtagtcacttgtttgatggctactgtgttccaggtactatgcaagtggctgactgtgttaagatagaaattcttgtctcatttatgtcacagttttatggaagaagagaaatgtattaacactttaattacatatagattagatttccaaccaattctagctttaggagctttgctatatctagaagggaataaaatgttttcctaagggcgaaggcaccctttggaaatggttaaaagattagaaaagtagacttggagaatatgcctgacatactgtgtttgatctgtttgctgaccagaaggagaggaataatcttgttggtaacatttatggaatgtcatctgattgatgtgaaagtcaaggcagtagaggaaatgatgggagacagagtaggcaaacaaaaaagaagaacttggaagaaggggagagtttatgataaaccaggaagttgggattaaaaatagtatggcacaggcaaaaagtgagacgttgtaacagggctgtaaactacatatattgacctcagtgataaaggagagagtgaccaagaaaacctctcagaagagttcacagttttcaaggactgaagggagaacagccaattcaaggatcatactttggcatactgaagcctatgaggcagaggccaggcgcagtgacccatgcctgtaatcccagcattttgggaggccgagatgggtggtggatcacctgaggtcaggaattcgagaccagcctgaccaacatggtgaaaccctgtctgtactaaaaatgcaagaatcagctgggcgtggtggtgcatgcctgtaatcccagatactcaggagcctgaggcatgagaatcacttgaacccag

SEQ ID NO: 116786 - DNA, 1061 bp, Homo sapiens
gtgttgggattacaggtgtgagccactgtgcctggtgtgtttcaaacttgaagttagttttatgatgtaaacgtggagaaaaacatgaattacctcttgaaaactgagggaataggttggaggagaaggtaacaatacattactgtttcggaaagttagagaaagataggggagggagtaagcaatggatagataagttaggtaagtgtagcattcttatttttaacgtagcaattgtcataagctgtcacagttaatttccaggaatagccaagtatactgaaagtgtacatttttatctctttctctgtagtgaacagttctgactccttgaatttcttcttgcagctcatgttttttggctagacctatgaccattttcgctagacttcactgcacgttttctcaagtatcttctttgtccctaatgtgtgacacctcatcatggacacgctactttagctaaggcatgaccagcaatgaacagtagtaaggtaggattactttattcttcttagtaagttactaaaccgttttttattttgggtctctgaaattgtgacttgtcttgattttgtagtattctttatgttagattattctactgtctatgtaggctgttactgttttatatttgtgtttatttattttttgcttgtcatctatcccaatgattttacctcatttgtgacataattatttttctcaactaacacttataattagcagaatcccaatctgtatctcttcctcaatctgtgtgcccaccagtcctatattttcaaccatttggcaccaaactgaacatatcatatttttcttctcaaatacttgcactttgttctgatttctgtatttccattaatagcattattaatctcattgtctaatataatcatatattcattgattcattaattcatttgaggtacattgatattcttctaagtgtcatacagtgtgctgcctctgaggatgtaatgatgaatacactggatgttccatccttatttctatccttatattctgggggaggggataggttaaaaataaattgacaa

SEQ ID NO: 116787 - DNA, 1019 bp, Homo sapiens
cagcaaccctatcactgtctcctgtagctgggacaagctggtcaaggtatggaatctggctaactgcaagctgaagaccaaccacattggccacacaggttatctgaacactgtgactatgtctccaaatggatccctctgtgcatctggaggcaaggatggccaggccatgctgtgggatctcaacgaaggcaaacacctttatatgccagatggtgggggcattatcaacaccctgtgcttcagccccaactgctactggctctgtgctgccatgggccccagcatcaagatctgggacttaggggtaaatatcatcgtagatgaactgaagcaagaagttattagtactggcagcaaggcagaaccaccccagtgtacctccctggcctggtctgttggtggtcatttgtttgctggctacacagacaacctggtgtgagtgtggcaggtgacatgggcacctgctagaagtttatggcagagctttagaaattaagaaacgaacaaactggaaaaaaaaaagtggggagtctcaggccttatggtgaaggagagtgtttcccctggctgtttgtttttgttgaggttcctagttaatctctcttgctggtggtgtctggcttccttgatatttgtcagagggacatctattctattctgggaggaattagcctgcatgggctgccttctgcccctaggctgtggctgggaaaaaccaggtctgtgtggccttcttcacttgggtgaggtaggcgtaagtcatcctgcctctgtgctgttcttcttgttgtagggttacaaaggagtttgccttcttctttccaccttccagagttcttcgtttgtctcttgcagtatttgtttatatttgtgcttagtggggattaactggaaaaaatggtctgtgccatcttgtctggaccacaagctgggttttccttctaatttcagtttctgtggcatgtgagtgtgcaggtaaacaagtggagagatactcagcaacaccctgagtttgg

SEQ ID NO: 116788 - DNA, 1090 bp, Homo sapiens
gtacagtgataaatactatcttcaaatgatgcaaggtacttaaaaggaagtattgccttaccttttaaacatgaagtgaattgaaatattggtgatgttacatataccacataggaataaaaagtaatgaaaaatgctttttgatgaatcagtctgattatttagtagtcacataatacatatataatgtaacttgagcctgtacaactagggtttcaactatatatatttttaaagcagtaatttttaagcctggctatagagccacttctgctataccaccggatttgaaaacattgaaatcttggttgaaatcatttcaacatttaaaaacttggttaatgagaggatcacctgaggccacaaattgaagacgagtctgggtaacatagcaagaccctgtcttaactaagtaactaactaactacaccaccgcccccccaaacacacacacaccacacatatatacacacatgctttaatctatcaaaaaaaaaaccatgagtttgttcccacacaattgacatattaggaacgatttgagcttaacgttaattttgcatttgtttatgtctgaaacctgaagaagcactaggtgaatgcagaaaactataactagcttaaccatgctgcgtaggaatacatagtagacacacacttcagtcctttactggctaccttcatttacctttttgttgtgagccacactcatccacatgtggcatttcaactttctgtcaaattttgaataactctcccctttacagaattcgcaagttgcaacctttctgaagtcgactttgacaagcaagcttcaggtcttttcaaaatgaagtgccatgttaatatagtagtcatgtgcttcttaacgtttaatatgtgtaaaactatgcaaagttttttctgttaggtttctgtttttaaaaaaatgtgtccctgattagtttcttgagtattatgcctttaaccccatttgtccataagccctgtggtttttattctgtaatttttgtacaatctcatggttattaggcacaaaaatattttgttacagtagagcttatacattagaattagttgtggagcttta

SEQ ID NO: 116789 - DNA, 1107 bp, Homo sapiens
gcaggatcagatgccacagagagatgcaggttaagatgtggatgggacaatgtctgttgcatttgaccattaggaactgaagaccatagtgggacattagaatcatgtggcagagcagtatttcagtgtgctggaaaacaaatgagaagtgaacaaatgaagactgcaagtgtggactcttaaagagtcccgtaatctttttcttagttttctgtgttgtctgtgattatagaattttgaagcatgtgtagttgaagttgaagacgttaaatatgaaccattcatagatctttgaacagttgccagaaacctattttttatattaatgtaataatttacataaaactaaatatttaaagttttgaactcttaaagcacagctaaatggaaacctttaatgcaaatgtttgtttcttttttttttttttttaagtcttggctacttatgattcagcagacagaacaacttagtaggataatgaagacacatgcagaggacttgaactctggacctttacacaggctcaccatgatgattaaggacaagcagcaggtgaagaaaagttacataggtgttcatcagcagatagaggcagagatgatcaaggttcgtttttccatattgaagttctttcttgaaattgttttccaaattcacagaaatattttaccttatttggctttaaaaattgtttattcatcatttcccaacaagaaataggtttatggtctctaataagtaatatcttattgaacataaaacattgattataggatatactgtgactgtatatactcctatgaaagaaaaaagaggctcccaattaaactatgacacaaagctttcttatcacttaggatttttagtttttatttactgaaatagttctttgagacttttaaaaataaatttgtcttatctaatactttgcataaataaaaaagaaaatacaggcagaattacttttggtattcttaaatttacgtatccctcattttccctacattcggagtctgtctcttctgaatgacttttttcaaattatttttattatagaaatttgtaaatgtataaaacaagagaggatagtaaaatcaacttccacc

SEQ ID NO: 116790 - DNA, 1087 bp, Homo sapiens
tgagtcaagtttcagccaggctggagtgcagtggtgtgatcttggctcattgcaacctctgcctcccaggttcaagcgattcttgtgcctcatcctcccgagtagctgggattataggcatgcgccaccatagcctggctccttttttggtatttttggtagagacagggttttgctgtgttggccaggctggtcatgaattactgaccccaagtgatctgcttgttttagcctcccaaagtgctggttacaggcgtgagccaccgtgcctggcctgatttgctattctcttaaaaaagtttatttgttttcacatgctattgaatttagtactgatttttaaaacatacttgtagtttattttctatagttgtatattaaaggacaactctgacctgtaagtagtgaaatacacatcagttaatactttggaatttaagttcttgagcaatttaaatttaaacaatttaatacatttatgcattttgtttctttgacaggttaccaaaacagaattggagaagttaaaatgcagctatagacaattaataaaagaaatgaattctgccaaagagaaatataaagaagctttagctaaaggtaaggcaaaattttaaaaattgtttacttaggtgatttttattcttactgtttgaaagttatctttgtaagtagtggaatgattccatttagagcatttcacatataaaaaactcaaaataaacccacattggctaattgtcaaacagtgtagtaagtcttactaattttccattgctttaaatgactcaaagtattttcgaatagttcatactaaatggaattatgtagcatgtgtaatagaattgaagggatgtttaaaattttctctcttgcatcatatttacttatttaattacagagtgcttaagtaagaaaaataggagtatatttatttagaaacttttaaaatcttcttttttacctgtattatttaagtcattaaaaccacatcattttatagcattatgttctctttatagcttaattttatgtgtctatattgccctaaaattttcataagaagtcttaaaaataaatggaaaga

SEQ ID NO: 116791 - DNA, 1964 bp, Homo sapiens
aaaattcagggaattaattaggaataatagttaatataacaaaataaaatttttaaataagaggcaaaatatggaattcagtgaattgattataccttttgaactgacagtaaaaagtaacatcttagaacacagtactcaaatacacttgcatggtaactgcctgttttgttttcttattatgaacatgtggactgtggaaagtgtctttattacttggaattaacttatctggttaattgtacctgaccttttgaactgttgtcagaattaatttgttcaatttcaagtagttaacagaaacttaaactagcttaaaaatggtgagtaaaaaaaaaaaccagactaaaaaccaaaaaccttgaaatgggcctcagaaaaggcagcttctgtagcaggagttagtgaacttttactcttattcaggaattaatatgacttagcttctagccaaaatattggttcctatattgtcaggtatgtaccttagatcttggatgtcagctccatgtaggagcctcctcctaacttgtgtgggtggggacaaaaaggggtgatcacttttagatggaaggctgtgggctggccatagatatgtcagttgcactgacctttttttttgtttgtttgacagagtctagctctgttgcccaggctggagtgaagaggcttgatcttggttcactgcaacctccgcctcctgggttaaagtgattctcctgcctcagcctcccgattggctgggaccacaggcatgcaccaccacacctggctacttgttttgtattttagtagagatggggtttcactgtgttggccaggctggcctcgaactcctgacctcaagtaatccgcccgcctcggcctctgaaagtgttgggattacacgtgagctgctgcacccaggcaattgcattgacttttggggacttttaatgaaatatattctgtaagaagaatgctaagtagtaatattcatggataaaaatgctattgtattattctatgaaaaattattagtaactgatcatgtgggaggatatgttccttagaacattaaaaatcattcatggttagtattactgaagttattttattaattgctaagttaaaaaattgtgccaagtgtcatgcagagtgagataaatcttctctagggatttattttaactgaggcaaaaaatttactgatttctgataaacattaaaaaaattcaaatagattagaatttttgaaaaaatcactgggcatacctcatagtaaggagaataatcattttatattacatttatataaacacatatttgattatttactggttcatgacataaaatatattatcttgtgggtggtagtcaaaaagtttgaaaagtattactttagtgattcaagtttttttctttctttctgattttcttcaggtgagaactaaattaatgtacttgcttccctcctgccactctagttttagaacatgtttctcttcagcagtgacaggggttagagatactcaggtgaaaagattattttcttattaagaagttctttatgttataaagtgaaatagattatctgggtaacattttgttaaaaacttggacagttattaatatcctcatgtgcaagagccagtgaatggacaatgggtacagaattaaactctttaaaaaaattatgtgttgctccatagaagtcagtggtgattctagtatttgtgaactctagaatttattgatagtagagacatacaagtctgccagaaggtttgtttctgtttatacgatgtggatgtagttcctgagcatcagaattggagggatgatgagaaagcaagggaattctatttctcattctgttgttcttcctaggaatggtctgaggtctgaaattgtccctctttgcaaaaaccctcaccttttctctgctctttgctctggggtactgagattcttaaatgaggaat

SEQ ID NO: 116792 - DNA, 1064 bp, Homo sapiens
ggatatctcaattgaagaatggtaattctttatgtggaaaagtgattgtcttggatcttgtagggcatgagtcagcaaactatagcccatgaggcaaatccagctagttgcccatttttatgcagcccacgaggctaagaatgctgtttgcattttaaatggttggaaaaaaatcaaaggaagaattatattttgtgacacacaaaaattatgtgatgtttaaatatcagagtacgtaaataaagttttattggaacacagccatgctcattcacttacctgctatctgtgggtgatttcacactacagtggcagagccaagcagttgtgacagagaccatatgtggcacactcattacttcacacatctgcttggcactatacaaatcacagtgacacagttataactcaacagcattttgagtgccacacatatcagtatactgtggcatcttatttttattatcagttcatgcctatagtgtcaaaagaagaagagaaaatagatttcaaatgtggcacttttaaggcatagcagaatgtggattattttgttattgaattagatgaagaaacattgtgtttattatgcaattgcaccatgcctgctaagcactgaatatacttaattaaaatcttatggtcatggattgctattggtatttggcagtactagtctatgtactgtacaaatgtgaaagacttaaaattttattaaatatctgcattaataggtgaacatttatagttgattttgattataaacactaactttgaactgcagtgataggaagtattatggccatcaaaaaattttcattcttctcattaagagacttgcattacgataacatgtgcccagttattactgtattttgaatttgccaacaaaatatttgtgaatctttgttttctcttttgttatataaatacctatgtaccatgcttgattttgcttcttggtggcaaagtctaaaatatttgctttctgtgcttttatcagaaaatggttgctgactcctgttacagaggatgataccaatttaacccatccaactatctga

SEQ ID NO: 116793 - DNA, 1037 bp, Homo sapiens
ggaaagtaacatttcttgagtttttactttgtgtcacatattatgctgggtatttatatatatatattataacatataaacatatatattatatataacatacataaacatatatgtaacatacataaatgtacatatatatatatgttaactcattgaatgttatctttctgtgccttttgtatagtagcctgtgttttaccttcaggtctttgagactttacataacttacttacaatcacatacatagtaaatggtagaaaagacatgagttgttgactccatagcttctgtctttttgatcatattatttgcttgatcttatgattttaacagcattctttagagaataagttagcaggggtaagtatgccaagcttttcaggggatgagacctgtttaacccaactcttgttaacctttgttaccatggagttattattgttagagtcaaggtataatcttgaaaatgttaagtatatttatatgactaaagagttactgctaaatttcattaaatgcagacattggtagggttaagtttgcctttgaattatatgttaacatattttgctaaacacatagtctgaaagggattccagggcaaatgtttgcattttaatttcttaatatttcttgaatatttccttttattgtgtacatgtgtatataactacacatgtatgtttaaatatgcatatataattaaaatcaatttttatctggttttaataataaacttacattatctttacttctcaacactttgttagtttcatgtactgtgttacttgtgagactacatttcttcctaaatgtcaaaaatagtctatgttagatatttgcattcttaaattatttttaaattaatggaattatattgaatgtttacttaatagaaataacagtatttgttgtatcaaaatatgagactaaaaccacatttttataatttgaatttaatatatccatgtctctaaaatatctaatgacagtgaaaaaataaattatatgataaatcatttgatggctttga

SEQ ID NO: 116794 - DNA, 1065 bp, Homo sapiens
acaagacaaaaggcaactgtgtggggcaagcaaaaggaaaggaaaaaaaggccttatggtcataagagcttgatcttggatggttctaagagcataaaaatcaatgaatagtcgtcttttaaagaaagtgttcctacttacagtggaggactccatgaacagatatttaaataacacataaaactggtagggggctgtattagtctgttttcacactgctaataaagacatacccaagactgggtaaattataaaggaaagaggtttttttttttttttttcccctgcatcataaattttattcctgatgtgggacagattccttccatctccaaatgaatcacatgctgcccctgaaagacctaggaaactcttccaccatctccagggaagtagcaacaaaggcaggtgctggggactggaaggctttgaagttttccatcctactttttctcaccttctcaacagaggatagctgttctctattattcctctcatccactcatcccttaaaaaaccccacaaaacgatcattagtaaacaaacaaacaaaacctcttcaagtattgggcattaggggttcaggttgggacttgggggtcaccaatgaaagaggaaggggaagaggaggaggagccatcactgtttctgctgcaagggttccttccttgctgcatcctgtagcaactgtttgtggacctcgtctgctggcaactgcatgtatcggaccactgagccctgaatgaagcagttcttcactgataacatgtgaggatatttctcagagtctatgacactgatattagttagtttgatgttgagataccgatccacagaatggagggttccacagatgctcaggtcattcttgagttccacgaccacatgcttgccctcaagggacttgaaaaaataatagaagagcgtggtgctggtcctgcgggctggaccagaaagaggacaggggaaaggaaagaggtttaattgactcacagttccacatgcctggggaggcctcacaatcatggtggaaggtgcaggggaagcaagacacgtcttacatgg

SEQ ID NO: 116795 - DNA, 1053 bp, Homo sapiens
ggtagggtcttattcttaagagagaagtaagcaataagaagaaagctatttattgatttttttcttcttaagtagaatcttatttatctgagattgctggtgtatttattgcttttaaaatacaaaatattgatttagtttaagaattttttttctgctcataaatgtgacccttagactacaataaatacattcaaattcaccaacttgaaattcaactttatttcatagttttattaactgtttaagaatgcctagtataaagtctttcttcttctctcctttcctttccactcctctcctttcttctcttctttgctcccctctctcctcttcctttctgtcctctcctttcctttccttcctctttctctctcctttctccttcttccttcctttccctcccttcccctccccttcctcccttcccttcccttccctcccttcccctcccctcccctcccttcccctcccctttccttccttccttccttcctttctttttctttttctttcctttctctcttcctctttcttttctctctcttcctctttctttctttatctttcctttttctattatctacctattgatctatctatctatgtatgttggtggttctcaccccctgccacacacatacctgggacatttggtagtatcaccagacactgtgattgtcataaccagatctagtgggtagagattggtgatgctggtaaacctcttagaatgcacagaacagcccctcccttcacactcccagcacaaaattatccaggctaaaatgtcaaaagtgccaaggttaaaaaagtctgagctacatccttggcatttcctgtgggtaacttacagaactattatagttatgctatagctgatattttagtactttttactttatgttgttctaaatagtatgatttgattaagtgggttcatatgtctccatagcaaaaaaaaaaaaaaaagaccgtatctgagaatacggtaaatgtagtaatgaatatgaagtatttaaacaattgtggttattactattactattaaat

SEQ ID NO: 116796 - DNA, 1049 bp, Homo sapiens
gaccaacacacaacatagatttttcttctctgcacatgttacttagttttgcttaattgagcagcagtatcagtaaaatcctattttgttacattttcaaccaacaacacatttaatttgttggctaaaaattgtcaggccaggcctggtggtttgcgcctgtaatcctagcactttgggaggctgaggcccgtggatcacttgaggtcaggagttcgagaccagcctgaccaacatggcaaaaccctgtctctactaaaaatacaaagattagccagacatggttaagatcccttaacctttctgagttttcttttccgtagagggaggaaatgaatatatacctcttttgccttacaggatttctgtgacactgaaatgagataatgtgtataaacatattttgtatattataaaatcctgtagaaaaatatcagcttctatttcagtttttctaaaaaatgtaccttagtttacaggtaaattaattgatattcactgagttcttaagtatgaattgtagattttctgtaagattattttacatatttcttattcataaaggaaaaaccttaatttctttggataggtagtacatgcacatttacatgggtctaagtgtcctttcttagtgtcccagttctcttccttagaggtaatcttccagaagtgttgtatgcaaataaaaacacaagtgtaaatgatatgcctgctgttctttttacacaagtgttacagcatacaacagtagtgttctgtatcttgcttttttacttaatgcatcttaggtatcattttataatagtgaatgtacagttacttcagttttttttcatttatccattcaaaaagcaaatatttattgaatgtcaggtgtcaggtatcattttaggttttggggatacagtagtgaacaaaatagaatttgttttcactgttatgggccttttactctaattggaggggacagtgaataaacaaacaaataaatacatagtatgtcacatggtggtaaattcttttgaaaaaaagcaagattgggggcaata

SEQ ID NO: 116797 - DNA, 1027 bp, Homo sapiens
ccacaaaggacttttttttttttggcaaggggataaattactctgtcctaattaaaatttaattttgatgggaactcttttctctcccccagttttttgttgctaaggccattaaggaagaattaagaaagagggaaaaggagatatgtgtcaggagaaaggtagcaaaagaaacaggtgagggaaggaagaagatcagtaaagaaaggtgaggaagatgaaaggtaaagaacagaagagaaagaaaatacaggaatgagaggcagataaaaggacaaacaaaaagggagtaggaaaaaggagatgaagaagagggtctgaggtaagaaaagcttttcattccctcttctttcacttttcccatactcccctgcttgacacagggtactatgatatgacccacttccctcttctctcctgctttactctccaggtttccatttttattgactactgacttgtgaacttttcctctgtttcttttttaaactggagctgtacaaggtaagaattcatagacaaaaggcattgattatatttgcattctcaaattaaaaatatttggaatttaaaataaaaatatttattgaaccaatcttacctaaaggtgtcaaaactcttcctttatagtttaataaaatctaacatatggatccaatttgtggttcagatacttaggaaaattcattattatacttgattcaagttttacatcaacagcctagtataaaatttttagaaaatttgtttatctgtacttacttgattcattccaaattgttgattcccaaagtttttattgggaggtatttaataagataaaatgaaatgggaaatttagatgtttaccttaataatttgggtacccccccgaccccctgccaaacagaaatctgaaatgtaattaattgtagcattggatcgggaggggcctggatgagtatagacttgcgttatatatatagttacttcaattatctattaattatgttgtgggtatttagatatagcttatgttcacagtatt

SEQ ID NO: 116798 - DNA, 2130 bp, Homo sapiens
ctggttaaaagtggcaagtcatagaaacctcatagaattgtcttaaaagttacgtgaaataatgcttgcaaaaatgtttagtacagtgcctggtatatagctaagttcaataaatggtagctataaagaagtagagtttttagtattttcatttcagagactacagtccccttattatagatattttagttctttttagttatgtaatacctgaaggtaagaaattaccagcaggtggagctcagtatcagaaaaaacaaatttctgaaattgaggtattttatcaccttatgttttaaaaataaaattaaatgcatatagttttaaaatttacatgtgaaggccttcttttttaatcctacctaccaaaagttatcaccctgcaacttggtttttgaatatgtagaaggaatgcttttgttataattattttaaattgtttgctatatctggtgtcatacataaggtatgacagttcatttgcatgaataagacatttttaatgtgaacttaatttataaagattgtcttcaaatttggtcacttcatacaataaagtaattacactgataatcttaaatttaacttgtcaaaaccctcaaatctgccattcccacagtcttcttagggtattttcagtcaattgcttaagtccaaatcttgggaatcacccttgtgttcactttcttccaaatcctgttagcaagttgtcttgatattacctccaaaatatattccaaatctgacctcttgataacatttccattgtgatcatcctggtaaattcaccataaattaaggtctgaactacttcagccagtttacctgtttgttcccttgccctttgtaaattttattttctgtataataacttgagttatcgtaatgtataaatgagattttatatttctcctgcttatgaccctccattggtattcctatataaccagaatgaaattctaatcctcaccatgaactcaattacataatctcatccctgcctacttcccctcattatttcctaccagtcctcatccatcacactccagccattgaggtcttactgtcctttgggtacactaagtgtcttcttatctctgggactttatgtttcatctctttttaatacttattccccagatcttcgtatgaccaactgccttcttttgataatttcaggtcaaatgatacttctttgagagatctctgactacttcagctgtaataggccctatcagacccctgtcatcattatttatcctattgcctttttccttttcttgcaaagcacttactttagtatctttactatttctactattactacaattattactattttgttggttagaatttactctgtggtaggttagttctaaatatttccatgcattaaatactaatatatgtactttggtatgtatgaactcatttgattatggtatgtatgtatgtatgtgtgtatgtttttattatctgtcttctataatccctgcttgttccttaaactgtagctctcagaaggtaggcactttcattatgtttactactatttcctctgccttgtacagtgcttgctatgtaggggaggctaagtaaatattttttgaatattgaacaagctcttagaactcgtatcaacaagtagagttatcaaatatttatgtaaaataatctcctaggggatagggaacatatcagtggaagaaatcatacctgaccgattattcttagagtctttttttatgaaggtaatagggtatataaaataagctacttcgattttagaaaagacgttgacaatgttttttaccaaaggttactaaatgttaagtcactgctgaaatgggaaataggcttttagaatggcccaacaacaggtttaaaatcagaaatcaaacagtaggaatagatgtttatttgactagaaaagtataaagagagtgccccagcaattgatgatcacatctgttatggtttgaattatgtgcccccaaaagatatctttaagttgtaatactaaatacctgtgtatgtgacctactttggaaatagggtctgtagttgtaaactagttaatatgaagttgttagggtgagctctaatccagtgtgactggtgcccttataa

SEQ ID NO: 116799 - DNA, 1850 bp, Homo sapiens
ccaaaacctaaaataagaagacttctatatgtttcttaggaataaaatcaggtattttatttatctaatttaaaaaatcaaaggccaggtgcagtaagctcacacctgtaatcccagcactttgggaggccgaggcgggcggatcacctgaggtcaggagttcgagactagcctggccaacatggtaaaaccccgtctctactaaaaatacaaaaaaatttagccaggcacggtggtgggcacctgtaatcccagctactcaggagactcaggcaggataatcacttgaacccgggaagcagaggttgcagagagtcaagagcatgccattgcactccagcctgggcgacaagagcgaaactctgtctcaaaaaaaaaaaaaaaaaaaaaatcaagtagaacagagatttatttcttagatagtgtttctttacttaatgtacaaggattttccgtttgttgctcgaaaacgcaacatttgttggctgtatctgttcctttaatccagaactgactagtatacttccatgccaacagggggagatagtatgaaataggagatccagatttgcacctctcttctatcttgcttttgcctcacacaggaaggtttgttggtaaattgacttccttgggcccactgtcactatctcttagctaaattttgagatggagcagaaaatgaaatgtcctcattgtaaggatcagctggagtctggtttcggctcccaatcctgtaaaacatgtgctttaatgttcagctctgagccttccacatcagaagtccacagagatcaggtaaggagaagttctgccacaggcctactttacccagggccccagacattatctaagagtccagcaggtcatctattttatgcggctgcttcaaatgggaaggataatttctcttgacttctgaatctggtggtaaacaaaattcttttgaacaatgctatcacttagatgctaaaccaaagccactgaaaaaaatgaaagtggcttcttttcacatttgtattttatttcatttgtttccttaattcacctctcagttttgagaaaaatatgtcctttccagtatttcaatacatggaaggtaaaagagagtgcagttttattgaatatttgaggagaaacatggctcagattttaaactgagccatgtttctcctcaaatattcaacaaagatgatattaagatttctatttttcaaatttcagtttctattctggctggtgagctcaatttagccttgttattttcaatgtctgtcaccaaaggaaactaataatgtttttcttgaacataggtatttaatagttggtgaccataactggtaaagcttttcattatgatatgtagctatatagttcaatgctaattttgtaatcaatgtttatggtttaatttaggaacttggaatacactaattccttactcttttaatgtataaaatataatttctgttactaataggaatatagccctattttaaatctgttgtgttggtgaagaattatatttatatgtcattttgcgacttaattgcctgcattctcttgagtcccttatttaatgcctctcttttttaggctttcttttttcagattcactatattaggaaaacctaattctggtcttcaaataagaattgtcaatgccaaaaaagtttatgtattttctttattttgaagatagttgaaatacatacacgattcttgctttaatattactacatccagtgtttgggttatggtgttccaaatatgtgtcttatattattggataagtactgtttgtaaatataatgaccattacttgtgtgcataagttttgcttatctggt

SEQ ID NO: 116800 - DNA, 1643 bp, Homo sapiens
agatattttaggtttattgtataacttttaattggtcaattaaagggaggaacatttgtaagaagcctttatagttgctatgaattttattagaaaataatcagtattttctctaatttagttttttttttttaatatttgtttaagctttctgatatgatctccatcagtgagaagcctttggcagaacaggactggtaccatggtgcaattcccagaatagaagctcaagaactgttaaaaaaacaaggagactttttggtgcgagagagtcatgggaaacctggtgaatatgtcctttctgtatattctgatggacagaggagacattttatcatacaatatgttgatgtacgtttccagtttagttcatatgtatattttgatgtagttcattgcggtacaattatattaaaataacgaatggtttgtgataaatgcctgcaacacttgaaatttagcacttaatttttttctgaatttcttaaatacagtgcttcaaaatgtactaacatttaaatatgtttaaggaaacatgtatttagtaatattttaaattaaaaataatgtttataaaatcaaagtatatagctatttaaaatatgttgttaaatttgaacattaaagatattttgaattaaaactaaaaacaatgtgattattataaatttttttctagagaaacttaagtttatgaaacttatacttttgaaattggagcttggaattgttttcagaatggtgccatgaaagatttttaagaaatattttattcaatagtaataataaaatttcttaatgaatgggatgatggttgaattggtttttatagataagctcttgtttattggcattaataatgaatagaaattaatgaagaattaaaaatctatttacattgattattctaatgctaatttattttttgaaatttatttaagtattgctaaactactttctatgtttgttacatttctttattgagccttaaacagatgaagagtaatttcaaaatttagctttacccactaaggaattttaatgtttttggcatatgaaagaattgatgcctctgtttgttttccattcccatcatttcaaatggcctgcattttcaagattgctatccacaggatttcattttatgttgagagactagggtgatactaattgccttacagaaattgaaccatgatcattagatgaacttgagggcttagataacttagtaacaggtgtatgtacacagacatgcacatgtgcacatacatctcttaataagtttatatatatataaaacgtatctttgagctgacattcacataccatacaattaatcattttaaaatgtaggattcagtggcatttagtacatttacatctcgtagttatagctaaatgaaagtagataccattcaaataggttaaaaggaatatatccattaaagtatttccactatcataatgttcacactattcgttaatttttcgtagtattcagacctcaacttgataatcatatttgcccacattcatacatctaacctactgttttggaaactatgttgtttctaataatgtgtcattttttatttccttggcaaactcttttgtaatttgtatatgcctttaagttatgaatt

SEQ ID NO: 116801 - DNA, 1042 bp, Homo sapiens
ttttatttctttatccaagatgtgtgaatgagtgtttttggtaattaataataaatgaatactccactacagaaagcaaactaatactgtatcagcagatagaaaataaatgatcagatgtattaaaatatttaccatcagattggatatctttccttatatttttgacatttttgatattgaaagttttatcaaatggaacacatatgtagacatatgtaaacatgtatcttgtccagtaactcaggtgtatcccatgctttgtttcctttggttagcattttagcaaaatgcatttcaggtctgtttgttagattttttatttttcaacaatttgaattagatttaaacattgtgaaaattgatttatctgtcacaaggtagaattttaaaacatgtcagagttttatttatctatttatatttttatcatcttaaccatttttaagggtatagttcagtagtgttaagtatattcacattgttgtgcaattatagtttttttaagaaaggaatctaatttatcaatgaatgtagattttctaaagcaatgtcttcacatttattctaccttattgttctctctccagaacatgtatcgattcgagggcactgggttttcaaacattcctcaacttatagatcatcactatacaacaaaacaggtcatcactaagaaatcaggtgtagttctgctgaatcctattcctaaggtaggtgcttatatacttttttgtctgtttgttttaaaagaatttttggtgagttaacatttccaacagtaaataaaattcttaggttatatgctagtagttcagaaaaaaagttttgtttttgtttttctagcttttattactaatgcaattgaaacatgaaacttccttgattttattaagatgagctgctttcttattcagtatttgctagtatacagatggcttggttttttttcccctttcctagtttttcttcagacttgaggcttttcttcactttataaggttcatactttgaaaggttcaggttataacagattctaagt

SEQ ID NO: 116802 - DNA, 1060 bp, Homo sapiens
tttcagagatactgatgtcccatttcacaagtcaaccaaatgtttgcattgtctacaggcttagccaggtctaaattgggagaccaaatctataaaagaaagaaataacaacgcaggtatgagtttgactaggaatacaaaatttcaaataaagctataccccttataatataaaatttgctataaaactttgataatagattagattctctggactattacatggttaattattgtttttccaacccccaacactttggaattgattatctcaccatctgatagaactagctatgaaaataaatatatactggatgctgtagaaattaaatcgttatatgtgattttttatatgaggtagaaatttaaagtttatctgggtattaacctaatctaaagtactggtatttgaaatatgcaaatcattatctcagtttgttgcaaatattatacactgatttaaaggttcatgttgctcttttaaaagaaaatcacaaagcagaagctttgagttagataattttcaactatgagtacataacaaattgatatggatttgttatggtggtagtatctgttacttatcttcctttgaattatttgtactcttataactgaatctatttcttgatttaatttgtgtgaaaagtaaatgtctttgattatataatgtgctgtaaaatatttaatttctgtcttgctagacttcatttttagcctaaagaattccactttagttcattgtaatttctatttcccatttatttctcttcccatttatctctgctcctacccataaaaatatgtttatcatcataatgcctaacttgaggacagaatggccaaagtaatctcttccttaccttcacatttttatgcacattcactcagaggtaccgaaaactagacaggattaaattgtttaactttctcactttatgaaaactagtgggtgcctgagccacccatccctctccctgatttttcctgcactgccttcagagcttgtgtaaacatatggaagatggaagaaatttttgtaaagaggggttattaatca

SEQ ID NO: 116803 - DNA, 1586 bp, Homo sapiens
actagaaatggataaggacaaccaaataaaaatattggcaatggatatggggctactttagaaaatagaaatacaaatgattttaaatatattaaagttgatttgccccattctcagtaaaataaaggaaaaataaaaatatatttattcacctattagattagcataaatttaaaatttaataacagtgtcttgacaaagatgtggataaaaatgctctttgatactttgctgttgaaagtataaattctcaacaacaacatgaaaaaccactatagaaggcattttggcagaatctgtcaaaactgtaaaatgtatatatctttgattcagcaataacacttttacaacttatcctttagttctatgcatgtatgaagttgtgtcattccaaggttagtcactgcagcattgtttgtaatattaggaaactggaaatcattgaaattttcaccattaggggctagttaaataaattatagtaccctatccagtggagtactgtgaatgaggaagttctatatgtactgactggggagagctccaagagacattgttaatacaaagaactaagctgcaaacagtttaggttatgttgttaccttttatataaaaagggtaggagtatgattataagtctgattttgcttttatgtgataaagaaacttaaaaataatacaataaacaataacagattacatgtttggggaggtggttgaaattgaaagcagaggtttaggggaaactttttacttgttatattttacattttaatttttttgaacactgtgaatgtattacctattcaaaaggtaagattaagaaatattgaaaacatggcacctgtcctcaagcaaatataaatttttaggatgatgctttattgagaaattattgataagaagacaaaatattcatgctatatattgttaaagtaggaaaagcagtttataaaatagcattatggtatttatctgatttttattaaataaagtatagatatccaaatacatggaaaaagttggaaggctatattccaggatattaattatgattaccttagagtggagtagtaatgggtgatttggggcagtttaaaaacgtttttcattgaacatgttactatgtttgtaatatgaacattttctaaaattatattacatgctaatgttttgtagaacactatagagcaatgttttaaaaactatttttcccataatttatatgaagaaatcgcattgtagtttaagactcaggacacacaaacttgagagtattgatatttatgtgtgtgcgtaactaaaacaagttttccaaacactgttttatgcttcctaaatgagctgcattatatttaatttatttgatttatttatttatttttatttatttatttttgagacggagtctcactctgttgcccaggctggagtgcagtggcgcaatcttggctcactgcaagctctgcctctcaggttcacgccattctcctgcctcagcctcccaagtggctgggactacaggcgtctgccaccatgcctggctaattttttttttgtattttttagtagagacggggttttgc

SEQ ID NO: 116804 - DNA, 1120 bp, Homo sapiens
gcagaatcaaggtcatagaggagcaagagacatatggtgatttaaacagctcctgatttcaagtccttctaggtcagctaaaatgcactacccagattcttcttccaaaaatgcatagaattatgagacatctcaaatagctactgaaagcaagctaacacaccggtatacttgtgctcacgctttcattctccctttgctctatcatcctctctctctttctctctgctttcttggtttctttcatgcagtcagcaaatatttattgagcacctgctttgcctctggtgctggcaatacagtaaaaaaacaaaacagacacggtgcctactcttcttgaaatgtatactctggggactcatttaatttttcaaaaatattattttaggtcaagttctactagcagttttctgtcctttcctttgcttgtcttaccttttattcttccaaaagtaaaagatccctaaaagttttcccagaatcctgtcttaccattcttatttcttaaaattctctttatggggagttaaagttactgtaggcaaagatctagaggaatatagaaaaaggaattgagaatgtgttcaccagatgtacagaaacaattctattagtcaagttaataatagctcagaagatataaatataaaaattgtataaaatgtcctacgaaatcccagttattatatatacaagtttaaatatccttagggaataaagctgaagagtataagatttgtttgaaggatcatcaaagcatatttgaaaatactatagaagaaaactaactgggaactgaaattattcttatcccaaacatgatgttggagaataagtaaatgccacgatagttttttttttttacattctgtattattcattgagttatatttcattgaatataatacagtacttaatatttattgagtattatgctcatgtctttttattacactgaaaaacacacaaatatgacaaattgtcatttatctaaaagtacgtggggaaactgtaacaaaggctatatcaaaaatcaattggaaagggaattttctctcaatccgtggtggtgagataaactggtagcaatttggtaaggcaacagtttagacattgcttt

SEQ ID NO: 116805 - DNA, 1953 bp, Homo sapiens
cctttggatctcatgctggaatctaactggaggtccatcaacaagacagtcctcaagtgaagtctgaggagtcagcctcctggggcatgtaatagatccaagcaggagagaggatagaaggtgttagagggtgaggcaggttggcaaatggaaaaaaactatcccgtgtgtgtgtgtgtgtgtgtatttctctgtatgtgtttattcaaacatacttatgtaacacatacatatgcggttaatggttggtattatatttacatgagttgtgatgtatatatgtataagcatgtgtcatctatttgtggaagattccaacgtttgtgcatactcccagacacatacaaacatatgcacatatacaagatatttaaattctagtaaatatagaaaacaatggaactagttggaaaagaattctggtttagacagaggagttccaaaaaatagctagggaacctttaggtaacacttgttttagatacacatgctcttgcacaccaatgaaagcatactgaacacacaagagtttaaatttcccttcagttgaagttccttagcagcaaggaccatgtgttctgccttcctgtgctttgtaaactcttgtacagtgcttcacacccaggaagtgtctcactgttgtaagaatgaatgaattaatcattccatttaaatattgttttcactcaaccagagtataacttaagacaaatttgtattcgcttggagaccacttttagaacaattaattgaatgaaaaggaattgtacatttttaaaatatttattgtttttaaccagtattgattaactcagatatactataggaacatatcatgattttgtttatggtactgcacaaagctacttatatgctttttgtaacaacctgatgatgtagagagaagcagcattaagactattttgtaaatgatgactttgaatcttggggaggttaaacaattttcctttttccttttacccttctgtaatgagatagtgaaatgaagaaagctgtgaggagttttcattgagcagttatattgagctacttgaattgtagctgccataattcccacctgttgtgggaggtatctggcggaggtaatgaatcatgggggcgagtctttcctgtgctgttcttgtgagagtaagtctcacgagagctggtcgttttataaacgggagttcctctgcaagtgttctcttgcctaccgccatgtgagacaagcctttgcttcttctttgccttccaccatgattgtgaggcctccccagctatgtggaactgtgagtgcattaagcctctttcctttataaattacccagtctttggtaagtctttattagcagtgtgagaatagagtaatacaagcagtaagcaaggttttgctttttgtgtttaacatatacctgtgatgaaattagctctcttagctttttggctttttgtttttaaaactataacaaaaataggaagggtggggggagaattgttatttacatgtgatttctaaagatgagtaaaaaattgtaatctaagtttttgaacaaacctgttttcattttaccacaaatgtcctctaaaattagcctaaagtgaatgtgatgctcatatggtggggggaaaaaaaatcttacctgcctcacctccacttaattaagattattaaagcaatatattgatactaagagcacaattctggaggaaaactttgatagaggttgtcttcagttctttgcttcaaaagtttacttaactttggtattgaataagattaacatgctatgggacctgtgctttttatattctgatgttgttcagaggtttttattagttgggttattcagaaaattgaggcattattttttagatgggttattcagaaaattgagaaattatttatgatttaaaaagttttaattacattgtctattgatattggccaaatgc

SEQ ID NO: 116806 - DNA, 1176 bp, Homo sapiens
tagttgtttaccaccacagtcaaattatagaacaattgcatcagctcccaaaattattctatgcccctttctagtcaacccagctacttaccctttggaaagtgagaatgtcatatacaaggaatcgtacagtatgtgctcttttcaatttgacttcttttatttggcaaagtacaattgggattcatctgtattgttgcacaaatcagtaatttcctccttttattgtgaataacatttccttgtgatgtaccaccatttgtttattcattcctcagttgaaagagtttttgagtttttaacaattatgaataaaactataaacattcatttaaagcgttttatgtcaacattaacttttcatttatcgagtatatacttatgaatgagattggtggtttgtctagtaagtgttcctttaagtttataagaaactgccaaattattttctaaagtggctctgctattttgcattcctaccaactgcgtgagaattccagtgactccacatttttactagcttttagttttttcagtttaaaataaataaattagataattacttttagctactctcataggtatatataatggtatctcactgtagttttaatttgtatttccctaatgactaaagatgttgagcatcatttcatgtggttatttgtgatctgtatgtcttctttgtgggcacttttgacaaccacagaaagacaaactagtggattaaaattataatcttgtactcacggaggaaataaagtgtatctctctttaaccttatattattgagtttattagtacataaaattgacaaaaatcattttattgtctatttaaatgacataatggtaattattcttcctgactacaactatcattaaagatgtttaccatgttcctaatagttctcatgtctaattgattcctctccccatttcccacagctatttccaacctttaccattttttctcaagttcttaaactgtctgtagtttcttcagtattagtcagggacttgcttccttcttttactaagaacctgaagaagaaacacttgcacactccaccagcagttattttcacctgtcctaattttctctgtgttatcgcagctcctctcacctcacccaggtctttgattcttcatttttctctagttaactcatctatct

SEQ ID NO: 116807 - DNA, 1125 bp, Homo sapiens
ctctatattgattgtgaagactgcagattttttcattttcctcaaagcttttcttatattgccacaaggcacattacacattaactagaacacaatgctatatcttctcaatattgtgatgctcactgaaatagatgtgtgaaagtctttgaaagatttaaggatgattcttaacatttaagaatattatatgtgtgttttcccctggaaggactaaaaatcataatgattttacttcagtgtgcagtaaagtcaaaactagtgaactgagatttgaaaagaaacagtgagataataaaagtttaaataaatacctaatagtcttgttctttttgtttctggttacatgtgatagtttagaaaaaaatgaaatactgcctcttgggatttcaggattgtatatagaattacagtatgtaacaacactgggcatatttcaatctaaaaatgtggacaagacacttgtttcaatataaatattaattttataactagttctattaatcagaaaaagcaactatatataataaaagtcccttttcttccaatgtagttggaagtttctttgaactcataggccgtagtcaagtatatgttatttaacaataatggcagatacttgagaattaaccaaatggactatttgaaaatttattaataacttttatttataattgagttccaatgaataagtattcacttttttgtcagtgacttaattagtgattatttccattaatatataaaaatgtgaattcattttagcttatggtgtgatacaaaaaatagtttaaaatctatatatttaggaaaagctaacatacatatgagtgatcagtactgaacttaattaaggctcagcattttagatgaagaaatgattactcattacttttttgattcaaatgtaaacttgatgaattgactattttcccctatttttaaaaaatctctgagaaagtaaatctctgttgaaataacatagtttgcaggattcttatcatttatgattttaaaatacttttcccaaagcatcgaattgttattggaaagcagatttttattggcatatttagtaagtgaattctaaagaacctcaagctaaaagcagtgactcatatgtta

SEQ ID NO: 116808 - DNA, 1363 bp, Homo sapiens
atttctcctcgtaaagtctccaaggattttgtttaacatttccagataacaaaagagtctgtacctatagtcagtatttttataggctgtaacactttactattttctagaaaatgtcaactgcttttttaaaaggcagatttattattagaatatagttacacatggaattcagttatacatctttatgtgcaaaacactatttagaaaaaggcagtgtacttagactttctaacagtgatagtactatcttatatttagttcactgtatatcattttccaagtacatctccacacaacctctcttctaaatgtttaaattaatttttaatttttttttgtagaaatggagtctcactatattgctcaggctggtcttgaacttctgggctcatgtgattctcctgccttggcctcccaaagtgctgggattacagacatgagccgcagcaccctgcaaaacctcttttttgatggttatatataataatctcacaatgctttgaatcactttcgaattatgaacttctttcatatgtggacaaacaaaaaggtgatcagtctatgaatatgtcttggtatttatttctggtgactttcaacacctttatgttaacaacttttgacaacaaagaaaactttgaagtgctgtattaatagtatgttttaaagtttttttcgttgtccaacttcctgttgtagaagatacattcagaagtaaaatttgatctcataagctttacaaatagagtatttaataagtgaaagggatttgctttacttttaacaattatttactcattttaggagaaatttaaagaaatatgtaaaacgtttctaattttaattaaaatatattaagtaaacataatattgtagactgctcattaatttctgtttacagaaattaatttttcatgatttataattattggtcctgttttgttatactgctttgcttgctattgaaatatttctcaatattaccatgtaactgcagaatacctagatcattatcatctttatcctcattaagatggcattgtctgtgttaagtacattgtatgttttaatggtttaaatgtgtaaatattataaaaatacatattaacatttacatgggtacaaatgaagcccctgaataataaggaacgccactgaaaaactcagatttgggaggtgggatgaacttgaggaaaggtgattctggtcttactgtaattgttaaaggaccacagatgcaaataccagatgacaagtcctagttaaataaaacaaaagaagatagctttgtagaggagccaagcaagtgtttatctagactctgactagtaacctgtttatattttttaaatgaataaga

SEQ ID NO: 116809 - DNA, 1048 bp, Homo sapiens
ccatcactttttcatcattcctcagctactactcacattcatttaatggtttctgtaaacatttttaagacagttgggatgtcacttaacattttttttcttttgagctagagtcagggaatcaagccatgcttaatatttaacagtcacttgtatgtgtgtggaagtttgttttgtttgtcatgtattggtacaagcagatacagtacaaactcacaaacacagatttgaaaataatgcacatacagtgttcaaatttgaacctttctcatggatttttgtggtgtgggccaatacggtgtttacattatataattcctgctgtggcaagtaaaacacacttttttttttctcctaaaatgtttttccccgtgtatcctattacggatactagttttgttaattatgattctttattttctctcttttttttaggatatagcagtaatgctattactgaaatgaatttcctttctctgaaatgtaatcactgatgcttgaatgacagaattttagtactgtaaacaggctttagtcattaatgtgagagacttagaaaaaatgcttagagtggagtggactattaaacgtgcctaaatgaattttgcagtaactggtattcttgggtttgccctacttaatacacagtaattcagaacttgtattctgagtttaacagtcttttggagtgaccagcaactttgatgtttgcactaagatttcatttggaatgcaagagaggttgaaagaggattcagtagtacacatataactaatttatttgaactatatgctgaagacatctaccagtttctccaaatgccttttttaaaactcatcacagacgactggtgaaaatgctgagtatgacacttttctacttgcatgtcagctacataaacagttttgtacaatgaaaattactaatttgtttgacattccatgttaaactatggtcatgttcagcttcactgcatgtaatgtagaccttgtccatcagatcatgtgttctggagagtgttctttattcaatagttttaatttagca

SEQ ID NO: 116810 - DNA, 1036 bp, Homo sapiens
ttataaaagacataatagggaaataaccagctagtttttttattataaaactagtacaataatatatagtatcttacatttacataatattttacagttgtcaaagcactttaacattatgtcagttattctactagaagttattatttccatttacaaagaaactattaaataagtgaggtacagagagcttgaagtgacctgtcaacatcagttaaatagaaagtaggctaatagtactctatttctactattgtgtaattagatttttatgtgggtcaaaatatataatccttttatgaaatgaaaattcaagcaaaatgtctgtgcaagatactctgtggatgaaaacatgaatccctatttcataatttctcaaccttgtgcatagataaataaatagctcgtttcagtaaacaggaaaatttctgtttgagtttcttttttctctactgggaataaagctgtggagggaagatttagaaaactgttaggttaaaagcaagaatttaataacttcctagtgtctaatatgcaaatcatttctaaaatgtattatgcagagatttaatatgctcctgttcttgtcagataactgagcccttttggaatcataaatccaaaatatgttttaaccagagtaatgtttgagaagattataagcatttgagaattcaagtttagagtgagtagtccaagatgattctgtctttgtttgaatcatctcttgaattatgaatactttgcttgcttgcttgcttgcttgcttgcttatgagttgctggataagtaaaatcaaacaaaagtcagctctaaatggcaatgggtaatatgaaaaaaaaaccctaatatgctaaaagatgaccccttactttatagacaagttattacttagaaattcaaattaagagaggacttttaaaagtgacaagctatgagttaaaagaatatttctagtcctggctgggcgtagtggctcacgcctgtaatcccagcactttgggcagccaaggtggggtcgatcactcgaggccgg

SEQ ID NO: 116811 - DNA, 1066 bp, Homo sapiens
ttcaccaggcttaagacattgtcagaatttatctcacctctgtaacatgacattttatttatggtttaaaaaaagtaattgagttcatttggtttattttaggcttagaaattttaggcttagaaatctagacatgattatttatattgttctcataaatgtctttaagatttccatataaatctttcaattgtcaaaattcgttttcttttaatttttcatttgcatttgtaatttctatagtacatttcactaatttttgccaaaaagttaaattcttttaaaaaataaacatttcatccttcccatttattgtgaaattttatatttttacaggattttaacagtcagtttcagttatgtgacttcacagctctggaaggttactatggtagttaactggcaatgacagtttcagctgctttggtaacaaatcccagcatttggagtctagatacttgcctggcatttgtgtctttcacttgtgataaatgtagaaaggataaattgagccaacaaaggattaaggaatgtgactcctgcctcatactcactaaaagagaatcctcaaagtctgaactggtgcctttcctaacatagtttaacccattgccaattatattacaattttacttcacagtaatcagttttgaggccgattaaaagaacaacatagtaattctcgaattaatatttcattcaaaaaattttaagatatagcaactcagtggctgaattttttaacgttgcaaacggattactaaagaaaacccaatactgtggagtttattattttgtgttgtttgaagatgatggtagaatattcctttaaaacaactttgatatgagcctaaatgcatgcaattatagattagtgcacagtaagtttcaatttgggagaatgagtactttttttcttttttatgttaactgatgttatatctaaacctagacattcccatttttattgtataattcaagaacattacattactgaaagtcaaaatattatgctcttggttgtcattttacatcatgcgtaatatgtttgatataatgtattttc

SEQ ID NO: 116812 - DNA, 1010 bp, Homo sapiens
tttagatatactctcttagtaggccactgttttttttagtaggcatctattctagtagtgtatattctttcccagaggttgagctaaatgataaagacattaacccagaagaagaatataagaaataaaaatataactatttcagttaataggatcactcctgtaaagaaaatatatctataactattactctgtcacctctttgagtggttttaaagagtgccaagggatttttttctattaatgaggaaatgttggtatgttgtaagaaacattaagttttcatggtacatttgagccatagatgcattatgtatgtctgagtagtattactcgtaggctttttatgttctgagcttcgatggcatttatacctatgagtaagtacctccagcaaagaggcaggtggcatggtgagcaggacaaagcatgttctgaaccactcttgctcttagattctgttttttaaatgactttctgttatttgaagttccttcacaattgaaagtgtaggagttatgaatacatatgtatccttccacatgaatgaacatttctttaaaggtactgtgagtttcactgttggctttgtaggtgataatttttatatttttgttactatacatggaaaagtcttaaaattccaaaagatgaacaaagtttaatgtaatattttaaataataagaaaatttattattggcagtctacttatatttgatgcaaatgttagaggtgtgagcaggactagtgtaactggtgaattcaattgaaataaaaaacaaattttacgtaaaatggcttgtttttacaaataggttttcaccaataacctatccaatatatatgaaactaacagtgagtatcagtatgaaattttcattttatcagaattgtaaggaaaactataatttcattaaaacagtttggagcccatactgtttttccaagattaaaagacaactgaaaatcctttgaatcaaaattttaaaaaaacatttattgaatccaa

SEQ ID NO: 116813 - DNA, 1052 bp, Homo sapiens
atggatacgaatgaatagaagaacactttctgaaatgtgctgagacacataggaaaccagagtatgtaagacagggttaaatgataaaataagttggctgcattgtctctaccccctgagtatattgaagatagatttatgaagagtttaattttaataattgaggtgggaaatgactgtggtatgaagagtaggttttgagtccaagtgaggataggttctggtagtattccagagcaaatgacaaggttgttgccaaaagaagaaaagatgttgatgtcaaagattgttcaaaatgtcctatttccaatccatcattgacgtccctgtgttatttacttcagaaggatgagccatagaattttttttctgtttgaactctaagtggctaaggaaataaaaaccttaaatgtaatggatgatgagtaaaatatttggtctgttttacttcatttgttattggtttgtaattcttagtgttgaatggacaataaagttgttttatataatctgcagccacacataagcttagactattgaacaattctaagattgtacttttataactttttacagtagcaatcttaaacgttgagatttgcctattctcctcattaagtgtaaatcaaactcattggcagtccatttatgtggttttttggagtaattattacatgataacctttttaataataaaggttgatttttttttttcatctccgcaaccatatgtccctgcaagtccagaaatagcttttaaataaagctgggaaaagattattgaaaacatggagagaaaaggagataaaaacatgtttcacttggtcatataaatgaaagagcataagacatgccacatgtttttagacttaaggtctatccagttcagtataatatgttggggaatgatactcttacagactgatttgaggaaacagtatattttgaaaaggagtattttaaacatcaccatgtttggtgatgagtatacctacctttccttagaagataatcgactttggaaatactaatgaaagaaaaaactgtgaaat

SEQ ID NO: 116814 - DNA, 1034 bp, Homo sapiens
tccatatacttggagttccactctgcagtactattaatacagtaatgaattttacagctatctcttggagcacagctcaaagtaaattaaagagggcggtcaggaaacctgatttcataaaagcatcaaagtaccatttagaatcttcatggaaattgaagagttgtacaggtatgttttggaaccagggctttgctcgcttttgcgaaagcagagtttgggtcatataccttggcatgaatcatttttcagatacagtgtgttttgcagtaagtgacgtgaaaacctaagtaaatgttagtttgctgtgctaagtattcataatactaacatacaacgtgattaaagaacaaatgattctttggaaatataaacagaaacaatactaatgaattggtgacatgttcatagtattctgtgtatcagtatggaatatatcaaatttaagttatatctaaaccaggtattgctaatttaataaaatcagtttttaagcatcaaaattctgtgtgtatatatcttagctttctaacttttcctgtgtcccttctgtacacttccccttgcaaatccttcaacccttctctcatctcttgtttacgctgctgtctcttttcttgttcttttttaaagagtaattccaaagattctgactagttaagacttagaaaaaaattaatgtaaaaaaatgtagttattccattaataccattgcttgccacttttctgttgttatctaagcatggtatgttaattacatctagttgtaaaactgatctgtaaatcaatagcaaatatatgaaagcatataactttgaatattattttctagattgtttcttggctaaaaatatctttggaatggcttttgcttagcatttttttttttttttttttgaggcagagtctcgctctgtcacccgggctggagggcgcaatctcgactcactgcaagctccgcctcccaggttcacaccattctcctgcctcagcctcctgagtagctgggactacaggtgcctgccaccacaccc

SEQ ID NO: 116815 - DNA, 1156 bp, Homo sapiens
cctgtttttattttctcttagtggtcattttgaatgacttccttgcccactggataattagcagattcatgtacttttttatagcattctgctgtaatttcttttgttttttgtgttttgagacacggtcttgctctgtcgccaggcttggagtgcagtggtgtaatcatggcacactgcaacctctccctccctggctcaagtgatcctccattcttcccacctcagcctctcaagtagttgtgactacaggggcatgccaccacacctgcctaatttttgtattttttatagagatgggatttcgctttgttgcccaagctggtctcgaactcctgggctcatgtgattcacctgccttgacctcccaaagtgttgggattacagatgtgagacactgtacctggcctgtaaggttgtttcaaactggaagtctgggttaggttccctgtaatagcaataacaacatatagtaacaacagcaacagtaaaagcaactatatcttgagtttttagctttctgtatttcagacactggtaatcacttttgaatcttcacttcagccctgtgatgtggttattttcatgccgtcattatggatgatgataagcctgaggccctatggccagagccaatacacagagctaacttatttatcacagagagcctctgaatcaggccagtcttcttcacatctcttacacttgtctgccttttatataccatcataaatgtcagctaccttgactgccttttatacactgtctttaatatcagctatattattaaaagcaataatgaaactgcgtagtgtcgaattttaacaatattgctaaaatgaaaaatgttgaggcactgtggggcaaaaatgtgaatcactctttcagacagtgaggagtcatcaagagctattccaagagaaatcctatttagagtacatgagcaaccgtaatgaaactttcttagatttttacatcaatcttgatttttaccttattatatgaattaactgctaaatcaagtcttgtctggacaattaaccaaaaagcctttaaaaaataccttaaggtaacataattgttaataaatatcaataatttctacattcagaatcatcttttaaaataatatacatatcttattaatgaaaattac

SEQ ID NO: 116816 - DNA, 1032 bp, Homo sapiens
agcagaaatggaattatctacattagatgttcaagaaatgatacattgttgatacctgtggaacacaaagtcaagacaggtggggaaatggttggagataaagctggagggatgataataatggtaggtaacatttattcagcatttactgtaccacacagttttaggcaccttatgtatattcgttcacttaatcctcacaaaatccttgaaggatgtacaattattattcttccatttttacagatgaggaaactgaagtacagagaggttaagtgattttctccagatcatataagtgacttagggcagaaccagcttttgaacccaggcagtctggctccaagtttacgctcttaatagtgtggggctttttgtatttaattagacatatgtaactgacatttttgcaagtcgcaatggttacatattggtaatttcaaatggttcaacctaatgtcatgcagaagaatttgggtattataaatacagatggaaccctggaaagggtttgaacaagggaaacaagacttttgggggcaatagactatagcctccccaactcaccaaaactctctaaaaacaaggaccactattatccagtaatccaggactcccactctaagcctgtcttattcccatttctttgtaaattggcctgattccttaccctttgaccttattcctttgactttaccagtccagttgcctttggctgacacttctctgtttctggtgatttctgctactataaggtgaagttctaataaccagcgctcaaaaacagaaaagaaagcaaaagcaactctttgtaaagcttttctgtatgaccttacttccttctgcttggcccgggccatcccaggtctacccataaagcatatactgctataagattgagccaggcacagtggctcatgcctgtaatcccagcactttgggaggccaaggcagttggttaacttgaggtctggagtttgagaccagcctgggcaacatggcgaaaccctgtttttactaaaaatacaaaaa

SEQ ID NO: 116817 - DNA, 1028 bp, Homo sapiens
ttttgtagtgggaattatcaaagacagtaaaaagatgttagaagagaaattcaggggtaggggaaatgggaatatgttagtcaaaggacacaaactttgagttataagatgaacagtttctgggaatccaaggtacagcatgggtggtgatatgtgtgttaatttgtgataatcattatgtagtatatacatatatccaatcatcgtgttatacaccttggatatattcacccttgtcaattaaatagtttaaaatataaaagaaaaattcaagaccttaatgtcagctaaaggccttagacttagttactctccccaaccccttctgggttatttttgtttgtttgaagaaatgttattgcctcaaaaattcttgatttctctagttcctctcactctattttaatatcagtcagctatccttgtgtttccatctgatgtttcacagattgagggctgtgaagtcacttaccctctcgaagcagttaggagactattacagctattccagaaagagatgataagggtttgaactatgtcacgtgcagtatgagtgccaaggaaggggttgaatagttgaattcaaaaacattttcagaaatagaataaatacaaattcttgatatgacagggtaaaggagaggggagaatccaagaagatattgagagtacatttctaacagaagtagagggcccatggcaatctatgaattaagacatagggcacagggttaagagcaggtttcagagggaacaaagatttgacatttgcttttggacttgttgaatttgaggtacctgtaggacatctaggaagagaaagccagaacagtctagttgaaatatggggtggagggtataacattgagagaggctcaaaaggaacacagcggagctaagtgattcaaggatggtatataggagtctcaggtcttttctttaatattgtctatcaaaatcacttccttgtcttccacagactccttcctgagtctgtcttgctgtcaaccctgcagaagattcccacc

SEQ ID NO: 116818 - DNA, 1813 bp, Homo sapiens
ggcctatgtctttacttctccttctttctttcttttttttttttttttttgaggcagagtctcgctctgttgcccaggctggagtgcagtggtgcgatctcggctcactgcaagctccacttcccggttccaagccattctcctgctacttctccttctttataacctagggacattgctaaaagatagcagtttttaagaaaaaatgctaaaagagagcatttttaagaaaatatagtttgactatgacttcattttcagatgtcaggactggtttttgtttcacttttttgcccattaagatttagaggttttctgcaagtcagcagaaaattgtagttactatatcccctgttatgaaagcaaacccccagttttcttctggatatgatgtgttaatatgggaacacacattttgctgacatgccctaatgcttaatattttgatgaatcaatctgggaataagaattgattgaaaacatctcaattttacattggctgaagtaagtattggttaggaagatgggcagccagttagctgacaggatctacaccgtgctagatggattgcaataaaaaaaaatagaattaaacacagtatactgctatcaattactgactggcaagtatgttattgaaccatatcagaaataaaagccaaagcattttcctgtgattcccaaaaaagctcaaattgcgaatatctttagtgcctagtaaacaaacaattctaccttgtataatgtgaaatattacagtgaacaaagtatttagttttttctactagcaaattaagcctttttaaaattctgtgcacacaaaaaacatatgcttattatattaaaaattgattatttgagtggctcttaattcaaataaagctttaaatggaaaagaatacattccagtataacagaattttacctgtactaaactaaaatcatatctaaaatacaaataaagaaacagtacaaaacatatcctttctgaagcaccattaacagcatcttgaattggcatctaaccacagcattgcttataaggtagtacatcttgtgctcttattggccaagtttttcatctgcattccatggaaaaaaagtttggctatcatttgtaagagtatgatcagtggtgtgttgctatgagcccgtgaaatagaaaaacaaaattaggaaagacctatgtagctagaaaatgtggctttttaaaattgtcatcagaaagctattaatgacttttaaggaagcaagaaagaaaaaaaattactaaatacaaaagcctgttaaaatgatttcagtgttttatgctacccttatgaaagtcttggacttcaaatgctttttcctttggtaatgctgctaatgatagcaaaatttttagccttacgccttgtaactggagacattattaatacacaaaaatgcctttcatagtctgagccatctgataatagggtggagtatatttaaatcataatgaattgggagggaagagattgttatgtgacagacataaaaatcctttatcatttaagtgaagttgcaagaacagtcccctcataagtcattattgcccccaatatacaaagtaccagagtccattgagaagtcttccaaggtaaaattctggacccatattccacagtagctcctattcttccatatctcgagcataccatgttcagagacttagaaaacttgtaggaacatgtgagcagctctgaggtctttattcaagtataagacttaatggaggcctaaccaggtcagcaccttcagagggcgtacaggtggcccctcttaccttgta

SEQ ID NO: 116819 - DNA, 1010 bp, Homo sapiens
gatggagagtcagttacttccacaatcatagaggcagagaacttgccaagctgtgcgcaggctctgaaagctacttcctagaagtaacagtcatcacttctgctcaaatttcactgactaagtcaagttacacagccatgcctgcattcagtgtggtggagatatgtaatcctcctgcagagagagatactgtatatttgtaaccaataatataactaccaaacttccaattctatttgctatgccaatggagtgtaggtttcagaacagtttgcctggtttattgtggttttcaaaccaccagcataaaagcctacagacacatcaagtgggagaggccttggacttcatggcctgttcttcccagtgtggccaccagagtgtggattccaaggtccgtttttcctggtttgttagtaccactgaattttccgtgagcattatcaactcccttcacatagtaactttgggctcaggaagaaaaggcattcataatctcatttaagagggtgaagatagagtgggaaggaggatacagagactgccataaaaacctgttcatgttctattatttacacaatgggagttttctgagaattgcttttaatgtgagttacaaagagatttaaaaataataattaagttgtcgatattagaacatttgaaaactcagttccacttcctttgcttaattctaataatctgaccctaattcccttctctaatgtttttattatataaatgacaatgatggatgtattgtttgatggtgagccactgaacaggtgtaggaaatatacaaacaggcaggctccatctggaaaattttcatcaaagaggtaggattctagggactataaaacttatttttataattaagataacaagagccatgcttgagggaagtgaaaagaaaggcatacttttgaggaacatttattaagcaaccactgtacgacagactctgtgctaggtaccacggatccaaagtaaatatttatagagagagc

SEQ ID NO: 116820 - DNA, 1093 bp, Homo sapiens
tctgatagctccaatgttgcacatgcataaagtcactgacttcacccagtatgtcctgaagaacaagggactctcacttggacttgcacagccaaagcagagaaagtgactctattcccaaagaaaatgctctctttgaaatctccagacttcaaaatagcacagtcatcttctttgctaagctttacaacaacatgaggaaggaaaaggatgattacagaaactttctcatatcattttatgaagttaaatttacctacatattatgtgcttcagtgttttatattttctttacaatttttttcttgcctgagttgtaaataatttgctcccccaacccccgcaacttttctcccctctgtttaaattactctgtgctttgcattgcttggcatcaagcagtatctttggatggaggcagactaggaggcatcttgattgccagcaagatctaacattcaaaaataaagaaatgttttttaaaaagaagatctttattcaagtgtggtaaaacattttctgagatcattcaggaagcttcagatttgtggaagggaggctgtatgcatatagaatgttattattggaactttattattgtcacattgatgttacatttctcaggaaatatatgctaatgtgtttctacttgctttttttaaggccttgagtagatgtgctgaatattgaagctatttggctgcctagaaaatatatcttacaatttataagctgtatgttattatttaaaaaaaaaatcaataatctcccagaattttgcatgaataatatagagatagaaacttaggtgatttacatcttatggtattcagtttttaagatacgtacagatgacataccaggcaaccaataaaaaactatataatgtagagatttctcaatgaaattaagataatttataaaatatagttttccattttaattgtctgaatttaaacaacagagagggggactgatagaattacagaattttgcagcaaaaaaatacatatatatataatctatctattttatatatatatattatctatctaatatatatataatctatctaatatatatatatatatat

SEQ ID NO: 116821 - DNA, 1019 bp, Homo sapiens
tttaaatctcagctctgttcatcatacctctcttgagaaatctttagtggctcaacattgccttcggatgatagctagcattcgagactctccagaatctagcttgagtgtcttcattaatttagggcctactgatcctctcaaaaattgaagtactcgttgttccctgaactcacttctcactttcttatctccacctctgctcaggttataccttctacttagaatgctcttcctttctgtctgccttttctgccatatcttagaatcatacctattcttagaacctaaaatatctgaaataattattagtatgttcatgaataccaataatgaaagtcatttaaaataattattaaaataattttaaattcagtcattaaaaagaattttatgggattattatgaaaagatatattgctagataaaacaaaagggatataatatagtatgtttaatcacattttttaaaaataaactgctgagcaaactttaggcatattcaacctggtattaacagtcattatctctggccagttgggtaaaagctactcttctccctacccctgttttggcttttctatattttatcagtaaacttcttgtgcttttacagtaagaaaacaaaataatagatgttattttcaacttttaaaatagttctaaaaaccctactcttctttcaagcggctcaacttagtctttccttcacagattttcctgccattcaccaatcagaaataatctttaccttttctatcacatatttttgtgtttatagcagcatctctcattctatgattatattttaattacatgctagaactcccacagtaaccagttggtaccatgaacagggatcactctgttgaatgaatgaattcatgctgatggcaatttgaagtagttattttctttaaagggcttaaaaccttattagagagacaatacatgtcaagaaaaatataaaatagatgttaatttataagacaataattgtcaagtagtatataaatgtg

SEQ ID NO: 116822 - DNA, 1050 bp, Homo sapiens
gacctggaatgtaaaaccagtaaagagaataggaagactgcatgtcgaactcatttggtaagtttaaatacagtcatgtatcgcttaatgacagggatacactctgagaaatgcgtcgttacgcagtttcatcattccatgatcatagggtatacttacagaaaccaagtacacatctaggctacaaacctatatagcatgttactgtattgaatactacaggtcattttaacacaatggtaagtttttgtgtatctagacatagaaaaggtaatgtgttatactatgacattaccatggctaccacatcactaggcaataggaattttttagctccattatactgggaccactgtcatatatgtgctccatcattgaccaaacatcattatgtggtgcatgactgacacagacatacataaccaggaagggtcacctacttgtctactgtgcctcatgtggttatggttgttgttcctcttccagggagatacagttcagagagtgacgtgtggagctttggcatccttctctgggagaccttcagcttaggggtttgtccgtaccctggaatgacaaatcagcaagcaagagagcaagtagaaagaggtgagccaagtacattcattgttagtgttcatgtccagccccaggggtaggcagtgcttatagtgtgtctgcttgaggaggggtgtgttaaatactgtttggttgtgttatgagaccatctctggggttcagaagcagatttatctaacatctctgctctttatccaaacactttgaaggatttcaatgcgagagagaggtatataggcttttcttccaccctttccctgtctggcatgacagctgcaggattgtgctgttcactgtcgttaagagaaatagggtggtgtttctcaaactcttgtattctatgccagataaacctccttttaaataatattcccaattgaaatgcagttagtcttcaggaagtctttgagaatatgacaacattgtagcacttctgaagaaaccctttggggttcctagaccatagatggg

SEQ ID NO: 116823 - DNA, 1005 bp, Homo sapiens
actcatattcatttttatttccctattgaattcacatttataaaatcctcatattgaattcacatttataaaatcctcatcttctcttcatcttgaaaaacacagatgattttttaaaactgttcacaggatctaattctgaaagtgaatacttagagcaactaaaatatgcatttgtattgtatcttacatcagactttctgagaaatgaacaaataaaaaatgttctttgaattagaactctaagactctgtaatattgaattctgcatcacctgtagaaaataaaaactcagcctccccagaaatggatgttttgtttccatataactacaacataaggtaccaaaagttaataactgcataatgccctgtgtgaacattttgtgtcttacctccattctaaattctgttctccttctcttgggtcttcaggataccggatgtcagctccccagcactgtccagaggatatttccaaaatcatgatgaagtgttgggattataaacctgaaaatcgccctaagttcagtgaacttcagaaagagctcactatcatcaagagaaaactcacatagtgacaggatggcgccaaactcagccttcaggactctgtcctccagcagagtaacattattgttctcattaacaatgaatttataccacattaccttcgacagtcttctaccattattttttattaactgggtgttttaaaagtacgttccacttgtaaaaagtcaaaggcaaatttgttaaagaaataggcagtcctaccaagggctttcttagctaaccatagcaatcctaccatttcaggccattgcaaatagaaaagcacaggcttctaagtgtgtgaaggataaaagatctatcctatccttttcacaccttgtttctacttcaggcacagtttgtaggctgccatcctatgccacagaccctactccgttggtgctataaacagcattggtaatgccatgtttgcaggacatgttccaaccac

SEQ ID NO: 116824 - DNA, 2121 bp, Homo sapiens
cacagtgcccagccccctccctcctttgggaggctgaggcaggcggatcacctgaggtcaggagttcgagaccagcctggcttgcatggtgaaaccctgtctctaccaaaaaaaaaaaaagaaacacacacacaacgcatgaaacgtcgtcaaagttagagttgaggcagttgcttttcaaggatgtacagagagctgtgaagcaagaaacagatttgaacaggagggtgggctggagaacagagcagctaaagaatgattaacagagtaaagaagaaagtgaaaatataaaaccaccttatcagagttatgcctttctaaacatctaaacaaacaaacattcacatattctattctaaaaacacataataatacatattctattttatggtctgaatttaccagaaaggtcctaagaaaagtttcaggagttcgtagagtcctcgtaatggcaacaaaaattttgagagaaactgcaaagcacaaatccacagaaataacagcatactttcagttaagcattttcaccttagagggggcattccaaaatgtaatttcctttatttgtaccagtttttagagctgtcagaatttcatgattctagttcaccaacacattcacgtgtgtacatgcgcgtgcacacacaccaccaaggtgcaagacagatgtgaatgaagtagacagtctagaagtcaggtgaatattaatgagaaatatgacatagggacagccctcccatttctacttccaccttcattgaccattatactgccccctggacattcttaccattagctgacaggtatgcaagcagagtgctgaagatgtctcatgtgaataaaatgtaactcactcactcagttaaaactaggattctgtatcttaactcttatctagggaacttacttacttaccccatgatctgtatatagttgcctctcaggataaatgcatatatagaagatggtcatgctcagggctaaatatgttctggaagccttttataagttctcaggcctgtgtcctggtaaacattaccttagtgattatttggtctgcattcattggaagagcttagggatagaaaatgcctcctgccctctccagctgtttgctgcctgtaccatcgcacagaactcacaccagtactttagagtatgaaagataatactgaagagaaaagtgacttgtatctaacatttcaatctccttgcagatttcatacatacttaatgattagtacattcagactaaagggaaatttcttttgatggcacgtactatggtaaatcaaagcgcaaactcagaagtgctatggtattgaggcacttaccaaccttcaaaagtaagagtaaaatgggatattcctacccttttttttagtatttctaagtgaatctctgtaatattctttgtctgtttaaagaaaacagcctcccatctcatagtggcttcatgctaagctctcagcaaggagagagaatgatggttttggctttagttttatgaacaagacctaaagcttaatcctgacattctggtgttaagaatgaacacagcattgatatttcacttatccaggctgttagaatttgcagttcacatcattactctgtgcttaaatttaaaaagcttttcaaaacatcgtgacatgtgtagcatttaaattccattttattctttgtcctaaagcaggcagtggtatagttcaggattaataacttattgggagtctctcagtcatatagaatattaaatttaatatagtcacatgcattaagaaaaacttacgcaaacagtttttcactgttaattttgttgtgcttgaagcataatttattcatcccttctgtcactgataattaattattggaattatatactttaggaggctaatccatgcccaggaagcacgaacatactgttcagaatgtgcaagttgatgtagggaaaggaagattcagaaatgtacaaaatcctgtgatttgtttagtaagaaaagagttgtaaccaaaatttcttctggtccggatgtaattagtccagtcacaaatctttgtgttgttaatggattattcaagatatatatatatattcttactactgcatagttcctctca

SEQ ID NO: 116825 - DNA, 2127 bp, Homo sapiens
ctgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtagaacatttgagcaagtaaaatagtaaagcacatagtgagtgtatgtccgtctaactggtacattgataatttagtttgggcacataaaaggaatatttatatggcttcccaaatgcagagttacatcttattcgtgtatttctctgagtatttatatcccgtctccttttttcattcttaaaaataaatgaattttcactgttggcacatatgaggcttaaatataaggaacataacacttgcattctaatttttgcatatattgtaaatgtgtctggtatttacagcaaaatactgtgtatccttttatgggtaaaacaaaagtgaacattgcatgcatgtaatgtgatgaatttgtaatttaggagttctttggggcttctgtgacttgggaaatgcttacattcaggccttaatgttgcattagctagcatgttttccctctgatgtatatagtcactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgatttttgtttgtttccttttaagtactgttgatcagttgtgacacttactggttaaacttacgttgctaaagatttctctataataagccacacattatatttagactatattaagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgtgacttaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaaaatggaatgcaagtttttcaaaagcccaggtctaaatgtaatggttggtttattgttcta

SEQ ID NO: 116826 - DNA, 1050 bp, Homo sapiens
aaactgtgaagggaaagtactcaagagcattgtttcaaaattcaagtagtcagggttggatttttcttacgtttctcctacagaaggagaaaacagcatagataatttgtaaatcaaataaatatgttcctatgtaattaggaactatttctgtatacatatgaccctataactgatttctttcctttttttacataattctgcagttaaggaagacagttttttagaattataaaagtaccaagagcttagaactcaacagaatccacttgcatggaatagaattaaagacagtgttatggtatgttttaaaataatatttttttcttcctttaaaatgtttgtactagggaacagacatccttggaagagggagaaattccttggttacagtacaatgaagtcaatgaaagcagcagtgatgagggaaatgaacctgccaatgaatttgcacagccagctttcatgttggatggtaacaataacctggaggatgactccagtgtgagtgaagacttagatgtggattggaggtatgtagcacgattttattaggatgcttaattaggctctgagttcatgattctaatttatgaaaattaaatctctgctagctgagaaatattataattttcccatctgttagtcctcctcttcttcaaagctcatttcaaatgttccttcctacttggaccctttcctacttcctccagtcagtgacctcttcctttgacctttagctctcttgaagctcaccttacatcctagttacttacatacttttttttagttttggatttctgacgtttaaaattttgctttatatgccctctatcacttagcataattctttcaaaaatagcttcttaatgaataccacttcaattttaaaacctatggttgaatcagaaaacaataagaatagttctccttccctattcttccttttccttctctatgtaaaatatggaagataaaattttactttccaggagatgttgaaagcatttaatttactttatgcttgacaaagaatagtcagcttcaaat

SEQ ID NO: 116827 - DNA, 1060 bp, Homo sapiens
ggtctgcttctttgcctcatcgattttctggtacagaaaaagatcaatcctcaagtgatgaaagctgggagactctgccaggaaaagatgagaatgaacctgagctacaaagtgatagcagtggccctgaagaagaaaaccaagaattatctcttcaggaagggtatgttcaacagtgagatttatttttctgtatattgtacaagagtggtatattttacattcaaatgttggatatgccattaattgtatttataagccttatgtagaaccagtaggcccccctgattttttcattatgcttttggtattttaaaaagaacaattaagttgaaaatactgataatttcagtatcgtttatggagatacaatatatgtctccacttggctttaataagaaaagttgggcacctaaaatgtcattttggttaagttaggaatgggtgaattagcactgtcattgctcaagggagaaaggacagcctcaagagggaaatcagtgattcattcacagaaatggagacagttagttgcaaaagctagtgttcatattcttgtctaattgcattggatgagatctccaaaatatcagtgattgatgataaacatttttgttctttcctcattttaatgggaaagctctagtactgtaagggttgtcaaacataccatgaagggctagataataaatatttatggctttgtgtccagtctttgttgcagctactcacctctactgttgcagtataaaagtagccatagacaagatgtaaatgaatgggtatagctgtcttccaaccttttactattttatgggtttctagcaagaatgtttgttgaattttatgaaagtcttttcagcatcaatggaagtgatcatgatggttttttacttttgccctgatcatgaagaattgttctataattagatttgctaatattcaacttcccttgctccttgaaataaaccaaatctgatcacagtcatggtttattgttattttaatgggctgctggattctaatattttacatgggatttttataatgagattcctag

SEQ ID NO: 116828 - DNA, 1018 bp, Homo sapiens
ggttactatttttaaaaaaagacaaaacttacagtctttgataatttatttttttgaaagtgtaaggtgcttgtattttttttcccccagttacactttttcttctttaaggagaatcatttaatttggctatacctttgtcattttgggcaaaataaatacttctcttctgcttgctttttatagtcagttataatgtcttatgatgaagttgatgaaattgttacattgtttgccaacccctagagaaaggtagtcttcctggctccttgattttaaattgattttctttgttttgggggtggtcagtggtggaagtgtattctttgccttgaaggaccctggacttttcatagttataaggtattttcttagttatttgtaattcttattcttatttttaatttttttcttaagtgatgtcaatattctgaacaatgatagttttttttttttttttttacaaacaatatatagatgggaaaaaacatttacagttaatagaaactgtccttttaaattgctagtaatgtattgactacagagcctgtggttagggtatgccaaaatgatggaactactttaggatcattgtttaagacacattgaaatgcttaaaagtttcttgtttcgttttgttttaaagaatcatagaataaattctaaaggataatggttctgcctaggactgtacttatatttttatccatagccttaagatatgttttacgatctcaaagtgtctgtacagttttctgtacagattattctatttctgaacagaaactctgtttctatgctgctgtgtcctgttcctctaccctaattccctgcaaaggattatagttgccagggtgcctttttaatatggtgccagctaaaggttggaatttaatagctgtacactcctatttagtttcattttgcccttgttcatctccctgatgtttcattgtcatcctccctagttcttgtatttgtagattggagagatggtgatgctagtcttctcaggttt

SEQ ID NO: 116829 - DNA, 1083 bp, Homo sapiens
ttgttgcagtacatcacagtgaggaaggcagggataccttaggaagcagtacaaatcttcataatcactctgagggagagtatattccaggagcttgtagtgcttcaagtgtccaaaatggaattgcattggttcatacagactcttatgatccagatggcaaacatggagaagataatgaccatcttcaactttctgcagaagtcgtggaaggtagtagataccaggaatcattaggcaatacagtatttgagttggaaaacagagaggcagaggcatacactggtctttcaccaccagttccctcatttaactgtgaagtaagagatgagtttgaagagttagattctgtaccattagtgaaaagttctgctggtgatactgagtttgtccatcagaatagccaggaaattcagaggtcttctcaagatgaaatggttagtacgaaacaacaaaataatactagccaggaaagacagacagaacattcacctgaagatgcagcctgtggtccagggcatatttgtagtgaacaaaataccaatgatagggaaaagaaccatggaagttctcctgaacaggtagtgaggccaaaagttagaaaactgataagttcaagccaggtggaccaagaaacaggttttaataggcatgaggcgaaacaaagaagtgttcaaagatggagagaggctttggaagttgaggaaagtggctcagatgacctcttaataaaatgtgaagaatatgatggagagcatgactgtatgttcttggatccaccatactcaagagttattacacaaagggaaacagaaaataaccaaatgacatcagaaagtggagccacagcaggaaggcaagaggtggataacaccttttggaatggctgtggagattattaccaactctatgacaaagatgaagataggtaaggtcacatccagtactttttccgattgtgtagtaaatgaagtggtttctttctagaaccatgtttgatggctgggctatttgatatgatcagggaattagacattttgacttaccaaatatttttatttactgaatgctaaccatacatgc

SEQ ID NO: 116830 - DNA, 1017 bp, Homo sapiens
gcactgtggctcatgcctgtaatcccagcactttgggtggccaaggcaggtggatcacgtggtcaggagtttgagaccagcctgaccaatatggtgaaaccctgtctctactaaaaatacaaaaattagccgggcatggtggcacacgcctacagtcccagctactgggaggctgaggcaggagaatcacttgaacccgtgaggtggaagttgcagtgagccgagatcaagcccctgcactccagcctgggcgacagagcaagactcgccctcaaaaaaaaaaaagttaaaacactgttaattagcacctatgtttttgccagtatgttaagattattattatttttatattccttttctctttagctgttgctaacagcctcttttgattcagatactttaaaggatcataacttgttactgaatttataaattatatgggtgaatgtgggtttgtactcttacgtatgttaatatatatctgtctgtgattagacaggtaacatataaattaaactcatttgcagagctattgcattaatgatgagcaattagcagtagctcaagtgtttaaataaataaggtgtttaaataaaaacttaaccaaactttcaaaaaaaccacaggttgcaacttctcaaatagtacttttcaaatagtaaataaatgcattaatttcaaaacagaagttctttttgtatttgttccatgataaattgtagtttttcctgattgaaaataggttcttatttgggattaaattatctgatcaactgactattgcaaagaataaatacatcattatttacacacattaattattgttataagccattacacatttttaaaaaatgaagtttgtattcttacagttaccttttagcaattccagggctaaaggaactttactgcttgacagagaagcaatgatagcacagtgtagtagactcccaaatagtttggttacatacctgagtcagtacttctgatatttttgtttgtttacttacaaattat

SEQ ID NO: 116831 - DNA, 1042 bp, Homo sapiens
taacacaagaactactattaaataataatcacagaataagaaagtatgagaaattaaaaagattgttacagagagtaatgacaggctaagagaataaggaaaggctaagggaaagaagtaaaaatgagtgaaatctcccagtctgtagagtgaaaatatgaaagaaaagtttagagacaaatgattaacccatttgggccaaataaagaaaaagtagtgaggaaaaagatgtatttgagacgtgtacaagagtctctaaattaaaatagctcttccagtgctgtgtaggaaaaatttaaacatggcctgccccaaacaagtctttgtgaaattatagaataccagctatttagatagaccctaaatattccagacagaaaaatttggtgtttctacaaaatgaggataaataggtagacaggtaggacacagtgcctttcagagtttagaaaaaatgattttgtcttgaactgtactaaagtatgagggagatagtattttcagatgtccaaggactcagtgtttgcctccaacatatacttgttgaaaccattatttgaggatcttccagtaaagggaaaaaaaaaatgataaaaacatggaattcaaagtagggtacttaacctgagcgggtagtacaatcaaaagatttccacagaagtagctgattaatagcccttgaaaacacgtagactaaatttagatcaggatgttagacggctccgaagagtatctttaagaagaaaagtggaatcacattaaagaaaagtttaagaaacagggtgatttccatgatttctgtactgtttccaattcctttcctctctttagtagcattcctatcaggcatttgcaccaaccatgctaccaaaggtgccgccattcgccattatcctccatgttgctaagtggtcagtgataggccttcatcatactttaacttttggcacgatcagttctgcctaaaacactttcttcacttggtgttcacacttcagtatttttcttttctctcactgccctctgttgttttttctgctat

SEQ ID NO: 116832 - DNA, 1041 bp, Homo sapiens
ctaatagcactgatagctaacaacaaacatggcattgtttctgactttaagggggaatgcttctaatgttttagcattaattatgatgtttggtgaagctttctggtaaagccgctgatattaaaatatttccttctagtcttggctttccaagatgcttatgttgttgtttttgacatttttaaaaaccataaatgagttttcttatatatatttttttgacatcttttgaggtgggtatatgtgggcatcaccagtattccctggtttatattttcctgagagagcaccctcttagaaaatcaaccttattgaggataacttagatacagtaaaatgtacttatttgaaatgtacagtgtattttgttttgacaaatatgtgctctgtgaccaccaccacagtcaagagtggaatattttcataccacaattaagatatagaatattttcatctcccccaaagttcccttttgcagtcaatcacaatttcaccctcaggactaggaaagcacttatcatctttttcttgctataaattggtatcattttgtctagaatttcatgtaagtggaatgatgtaatacatactcttttgtatctggctttttctcttggcatgtttttcaggattatccatgtttttctgtatttaacgggttctcattttattgctgaatagaagtccttggtattgatttactagtttgttgaccattccacctatttacagatacttggattgtttccagtttggggctgttattaataaatagccttcatttgttgaacattcctttattcaatgaacattcatttattttgaatttttgtgaacatcttttttttcttggtaaatacctagacatggaacttgttgggttgtatgatacatggatgtttataagaaactgccaaactgttttccagagtggttgtcacattttacatatccatcagcagtgtatgacagttccaattgctccacatcatcctcagcacttggttatttcagtcttttaaattttagcccttttagtgg

SEQ ID NO: 116833 - DNA, 1021 bp, Homo sapiens
ctcccgggatcagcacctttccgccagggctgctctcagttagcgatgtcaggccagagctcctcttgcagatgcacctttaatttggcctccctcagatgactggtaatcattttgcgcacattcaaaatggtgaggttaaagacgctcagaccaagttgaagcaaaggggaggtggtaaatagtcgttttgcagggaggagagtaatctgagagttccttctccggacattaaaaaaaaaaaaatttacatccgcataggcgcttcttttgagtctgctggttctgtgaagtttaaaattttcattgcaggcttaatgtattctgttttatcatgaaatatttggtcacatttctttaaaatggcagtcacctttgctgaaggctacggatcatttgaagtgtatgtgaataaacctgaggataacagtaataaacgtttaaactgtatttttcagtgttgtaattgtcttttggggttcatgtcatttttatatgagatgaccacttaattttaaaaattcattgcagacatgcaagtttgatgtacacttcaacaatataaataacggactgttaggtaaaatttaaatatttcttttcatcccccagtcccactccagtgtaaagttgacagtttagtgttcatttttcaaaatcttgcaaatgcacttctagacacatacaagtacacgtaaagtttttttttttgagggaggctataccatataccaaacatgtttgcataccgcttgcttattgacttaattacatatgttggacatttttactttttacatataggtctccctaatactttttaaaaggctaactggtatctcgtgagtttgaatgggctataatttattctattccctttttgaaagacatttaattgcagtttctttttgctattacaaatgatgatttataatgaaaataactttctaatttattgatcgatgtttaattacaaattttaattcatccttgattttaaaaaattaaacagtatggaaga

SEQ ID NO: 116834 - DNA, 1451 bp, Homo sapiens
gctgcagctggagcgggcttctctccggggacggtcctttcctccctgctctccttttccttctttccgcgttgccgccgcccgccccctgcgcctccccgcggagcctgggtccgggagggggaaggtaggggcggcggggggcgggagagtctggcgagcggacgctagctctgaggaaactcatcaatccgtgagccccggagtccggggtgcacatcggcccagccgcagcgtcggcggcggcggcggcagcagcacgaaggggctcagtcggggtaggcgggggcggtgccggtgccgcgggggcgggcccgaccgtcccgcccagaagttgtagggcttggctcctcgcgatcttgttcctttcccctccgcttctctgacctagctgcgcggccccggcccgggagctgccgaacccgcgcctcccctgggtgaggaggacacgcctgccctcgtcgagaaaacttttcctgccgactcagttggggcggcggtggcaggaagtgcgggcagcgacctctcctccgcctgccccgcgcgccctgccggaggtcggcgctgagcttgcgatcaagtttgtgggggccccccttcccagttgccggcgagtctcgcctcgagaggggcgcccgaccccggggagggcggcaggccagggcgaaggccaagggcgtgtggtggcgccggagactaggtgcggagcaaggcggggactcgcacccgcatccgagagcgcggaggtcgcgcagcccgggagaagggagcctccggcggctgcttcctagagtccacagtgcgctgtctcctttggctgaggagagtgtcctggccccgagtctatcgaggaaaatgaagttaagccgccagttcaccgtgttcggcagtgcgatcttctgtgtggtgattttctcgctctacctgatgctggaccggggtcacttagactaccccaggaacccgcgccgcgagggctccttccctcaggtaagcacctgggaagggggcgcggggctccgaggggccaggcgtgcgggcccctggttagcggctgctacccaacctcttcctcccgccgcggccccacacccgtgctgggcgaggccaggggctctgtagctctcggacggcaatgatcacctcctgggagccacctcgcccgggcgcgccaagttaacaaagtgctgggcggcgtgcggcggcggcggcggcatcatcccgctcaggaaagtggccatgttccggcattcgcacccggcctgttggggtggcttcgggcacctgctggcgggggaacgggcgcggcgtgaggcaccccccgccagcccggggcccgcgtatcccggtggggtcgttctcggctctcacagggttaagccgcccgcaccagcccagagcccctgagcgcacggagtcgcggaaatggatcaaaccgaacccacctaggc

SEQ ID NO: 116835 - DNA, 1050 bp, Homo sapiens
ttgatatatatttttttctcttttgtgataacttaaatgaccaaagaatatccttgccattttttttgtgttatgctagagcaaatggcttgaatttaattgagattaaagtaaaaactttactggaattattgtgaaagtgaaaaaagacccttttatggatgctgtcatcaatacagagcactcaacatgttttgtcggtgagaggttttaaaaatcttgctgcagagagatgtatcaaaattttaaaagcctctgcttcccctaggtagtatgacagagaaaatagaaacaagcactgagggcatctttaaatcttgagctcagagcttgtccagtgcttcttgatgaggttgaagaaaacagttggaaaaaggtaaggagttttaagcttagcttgatatgttgtgtaattttggggttgaaattactgtaatttttttccctccagtaacctcattttcagattttcctccattacaggaaaatcataaaaagtgatatttttacttaaagtgttttctaaaataatgtcctttggctttggcttgatgatcacttgaaaatggtttatgcaaacatctggacctgggttttctggcaaccttgacattttctctgttcagaatctaaagacatgagtgactcattcagttactgagaaatcttaggcaaagctaattccagtattgtaatatctatccttagtcctcaatgagaggctgaagttctgctttaagcgtaaagcatttgatgaaaggtcaaagtggctgctggaggggaaggctgttggtactcaactgggaggtggaacattttgcatttaagattgcctttctcagattttctgtactggattttcactgcagaaagaaggtattctttaagtgcttggacggccactgaatcctcaagcagatagacattctaagacccctctgtaagcttaaccgttatgtgtgtgacattagccttcgtatcttacagggtaaaacttaagtggcgaggggactgaggcactgaggcacggagagattaattagcttgccc

SEQ ID NO: 116836 - DNA, 1023 bp, Homo sapiens
ttatagggccatgtgctaagaatggtttttacatttttaagtggtttaataatgtttcatgacatagccatggtcattcatctaccaattgtctctgaccactttcacacaacagtggcatagtttagtagttaagacagaaactggctcacaaaacctaaaatatttactctctggcccttttcagagtttgccaatccctagtttaaactatatttctctattgttaatattggaggcaaatagtattgttagatctgttaaagtagatgtgagttaattaaagacaaacaaaattctcgtaaattggttattagataagcattggtcaaactttgtgtttttagagagtggtttaaaacttgtgttatctacatgtttcatagatttccaggtatccttggggaactttgatgctagagcatcgacatgcttgatgagtttgtttctcttctttcacctgaaggttttgcactgtaggactgctctgggaaggaaggttctgggccatgaactaggcaaaattgatccatagcttcaagactgaaaaccatgactttatgactttttggatctgctgtaattcacagatgggcttaattctgagcccagtctgattgcttgggttagttagtcctgagaagggagagctcaggtataggtatcttcttcataagctgtaaatagaagatggaactcagccggtctctgggatcctgagcgttgctcagcttggaggcagggtactttcaggttgtcagcagaggtactggcctgctcttctgcttatcaaagagcagttcttgctaattttcatcattttcttcacttttaaagattatatgtcactttctttgctgtgttgctgtgacacaggctaacaccccatttgtgtcctcacagattttagtatcatctttaaattgcagtatactgagtccgaacaaaatgggggtaatgcgtctcatcgagtagtattaaggttagtgttaagtagagttttttaagtatttgtttttttgc

SEQ ID NO: 116837 - DNA, 1001 bp, Homo sapiens
ggagctaagactaaaacaagagtcaatgatattattttacattcctgatataaagacaaaggccttaaagagaactcaaaaacagaaacaagttttggtgatggcctggcttaagttgactaaaggagagggtaaagaagctaagctttccctatgggacgatactttgaagggagaaagaaaattgctagtgtaaagtacggtgcttatgaaggctttgaatcctggaggagattggcttgatttagaatctttggtgcctgtgaagagtagttgggaaaacactgtaggtagttcaggatcagattgcaaattgccctgagagtttgtctgaagagttatgagttagatggtagtgaatcactccaagttattgaatataccaggaagctgcttgagaaaagcagtgtgagagaattaattttgtagaaaatttcagacctggaaaggagctaagagaatattcaatctagattattctggtagctgtgtgtaggaagattcaagtaggaaggcagctgagaatctgtttgaggtaatatagacataaggcagtaaatccctgtaccagtattgaattggctagaatcgggaggatgaaaaatgtggagacattttgtaaagagaaagaccaaagctttttaacaggtttgatcaagggtaatgatgagtggcttgaatcagaaaatttctcctacctttttccattggggtgttggagactggttgtactatttgcagaaggagatagggacaagctgatctggaaagtcaagttcatttcatttatgatgacgtggatgttagtggaaataatcaagtgggctggaaagccagtgagagatcagggaagggagatgctgatctggtagtcatcagcatagccgagaatgaatgagctcacttggggactgtgcttagtgagggcagggccaagtacatttctgataaccaaaagctgcacatcttacattaagaatattttgtagcagatgttaatg

SEQ ID NO: 116838 - DNA, 1049 bp, Homo sapiens
caatgttttgattttgagggtgcctaactaggtagagattaaagccctttactggagatctgaggactgtaggtgtctttttgaggaggatgatttttggacttaagtttgaaagccaatttgaggcatcaggcaggtatttgaatatatgggtctgtttttcaggggtgaggtttcagcgggagatacaaatatgggagacatcatggaatttaaatcatggagtggatgagatcatgtaagagagtatagagaggtaagaggctcaagaagctaaccttgaggtgctctaacatttagagcttgggagagaaggagccagcaaaggagactgataaacagttggcaggaggaaaacctagggcatgttgtattgggaatgagtaaagaaaacatttccagagggaaggagtgctccattgtgcctaatactccctgagatgacggataaggtaagggcagagtgcttttcatcaggcttgaaacatgggagcctctgggaactttacaaggtcagttttggtggagtggtgagcagatgctgattgtaatgggcagatgaatgaatgggagtttgtaaggaagggggataatgagtagagagaaacttttgataatcccggtacatgaagtgggtggggccctggaggggaatgggaatgtaagatgttttattcagggttctccagaaagacagaactgataggacacacacacacacacacacacacacacacacacacatgagaagggagttattaggagaattggcttatttgattatggagactgagaagttccactattggccatctgcatctgcatgctggagaaccagagaagctggtagcaggacttagtctaagtctgaaggccttagaaccagagaagccaatagtggagctcagtccaaggtggaaggtgcaagagcccagggaccactggtgtgagtctggagtctaaaggctggagaacctggagttctgacatccaatggcaggagaggaaaagcggccaggctcttagagaggatgagaatttgccctttc

SEQ ID NO: 116839 - DNA, 1018 bp, Homo sapiens
cattacttatgaatctaatgaatgggacactgaaccccttcaagtctttgtggtgcctcattcccataacgacccaggtaaaatttgcacttcaaaaagacaggaggttattaagtttctttaggcctagagtcttttaatgagaatctggtagaggccacttctcaaatttttgagacattattctctgacttttaacattaatatattccttttatgtgtcattatgttttagtgttctcattttatcagtttatgtgccattcaaggatagtatctgtgcagtatgaaatggtaataaacaaaaaagaagggcttgcctttggggacaaaacagtatatagttttaagagactgcttgttcattttagtaactttttaaaaaatattgcataggaaaattatttcatgtctatgaggtctacttttagaaaaggcagaatactcatgggaaagtttgaatctttaaaataaagaagcagtattaaatgctttaagaaccttggtgttgattggtttcaggcacatacgaatgtgagtctcagctctctgtatttatcagtgttagatgactttaggcaagttacttaatccctctgagaccaagttttttccctggtagaatgaggatagtagtatctgtttcaatagggtgcaaagtgaaagaatcatgtatggcacaacagtagctgctatcattattgttactgcatatgatggcgtttatttattgggaccacagattcctcccttcccccacccctgaccccgccctgccaagatgaggggaagttgtttcaattataatgggacataggatttgatatacatatttgttggtttgagtacccagtcacagataatttagttgcagcatttttttttttgtggggattggagaggggggtgtatttccaaagacttattttgaaggagtgtgttacttttcttaatatctcgatttcatgattactgtcagaagcactggtaacctaataatttgaaggtttttttcttt

SEQ ID NO: 116840 - DNA, 1024 bp, Homo sapiens
ataaataagacctctttgacctttctcaaagcccctccaccacatactcatactgcacacacacgcctccacgcttgcaggtcttcgcagatgtaaacatttacagcacttttacttggtctcctcactagaatgttagctcattaagggctggaactttgttttattcactgctgtgttgggaatgcctagaatcataactggcacatggtactgagtcattagagtttggttaaataagttaatgagctaatgaatctgactcttcaaactaggatgaaacatttgacttattctttggcgtaggcttttcttttaagttccctccttcctgatggctacttatttctattcttaaaaaaaaaaaaacttatttaaagtactcttttgtaattttatgtactaaaaacaggcaataataagctctttgagggcagggattgccctcgatttttagattttttgtttgtttgtttgcattactattcctgcttagttagtaggtcatcttctgagtagacatccctagtaagtattcctgactataatctcttttggtatcctagtaactatagctgaatctttttgtcttagtaaaagatgttaatgaccctgactctcaaacccttctccacttggaaaaaataattgtcagaaacaaacattttaaaactacagtgatttttgctgtcaagcaaaatgctagagagaagaatccactgacttaataattttcactattccttaacttaacaaaagtaaaatattgacaaataaattattctgtgaaaaactgaattattcacatcatgaaaagccattcttttttaatagaggaaaaagagaaaagtgtgttcacatacactgcaagtcaaaatgtgacactataatgggaaatctttgtataatactcctaaatgaatgtgcaattaggcagtgttctttctaaatgagatttatagagatttgtttgcattttctgcagcaacaatttaaaacaagctttagcatagtagtttgtttc

SEQ ID NO: 116841 - DNA, 1243 bp, Homo sapiens
tcctaacaataatgcaaataggttcctctggtgtggggtaaaatttccagtgacagcatcttcatatggattcaaaaaatgatctctctcaaatatcttcattgaattaaagctgatatgcttagaaaactattaaatgacactgaatcaactgagaaaaacaggttagattattttggaaacctgggttcaaaagcatttagaggcatcagcaggtttctaggttttccaagtctcacagatctctggaagcctcagcttcatctgtgactgtcttcttaccctctcttggaaacttagtcgattactaagttctcttcattttgtctccttgacctcttatttccctctgtttatttcaactgcagtccataaccattttttacagaattttgcagtggtctcattttctgtttctctgcttctactttgcctttttagtcttcacactcttagtacagttatttttgaaagcacaggtcagaaaaccctcatgtcctccctccaaagttctctgtaagaaacaggaatggtttagaaggttttcaataatctgtctcccacttctatttttatatttatttctcaccatatttgcatcatgtaccctgcaatgcagccataaccaacttcctgtcttttccatatgctcttccctctatttggaactaccaccctttttctctctccagatgatgactaatctaagaatctttcttcttttcttttggtaagactttaccatttctttatttccatggcattttattcatattttcactgtagaatctgttttcatttagctttattgctttgcccttattagatgcaaggtacatgtttgaatgaataaatcagaacgttaattaaaactctttcacagtttatcagggaggaaaagcaagcttaacttataatagaagtgttggaattaaaattaatcagcagcgtatttgagtaatagtaataccatttaagattgtatgttaccccataagtatatgactagaagttgcagttgaatattgaaggattaaggagtgatggaagaaacctgttcgtcattttttcatagaaaataccttaattactagatgagaacaataaacactgaggattctgaaaggagggagagagggaagggggaaagggttgaaaaactacctgttgggcactgtgttcactatttgggtgatgggatcaatagaagcccaaacctcaacatcatgcaatatacccgtgg

SEQ ID NO: 116842 - DNA, 1050 bp, Homo sapiens
atttggatcccctattaggataacagtactgccaacttgtaaacagtgtttagatttttaaaattcaaaaaaaattccttagagataaaaaattgaattagatactataattattaaaatataaataactgctttttggccttaggtcatctatcttatttttctcatttctatctgaatttgtgcagttttcagagtgttttcattgttttaatattagtgggtttctgagtcccatgacaactaaaatggagtttcattaattgaaaacacctgttaaatttaaaaatatgtctatgaatgaaaattctaacgatgtccaaagtaatgcaatggaatgtgactgagttgaaatcagccatacgaattagacctttgtggtatatttgtgtcttgatttaggttggttgaagactttcaatgactactttagagacaagactcagtatatttttaataacatggtcctaaagctgaaagaagactcacggaggaagtttatttggtctgagatctcttacctttcaaagtggtgggatattatagatattcagaagaaggatgctgttaaaaggtttgttttaaaacttttttggaatttggtaatattaaagcttaattgtacaatgaactaagtattgaatttttagatggtgaaaattcttagctttatatttgaaacttaaaatatttcttcacataccgttttcgttgattttggttcatctctgaaaaagccatttgaaacttttccatttaaatcctgtgttccactggaagcagtggcttactgctgtaatcctagcactttgggaggccgaggtgggcggatcacctgagggcaggagttcaagaccactctggccaacatggtgaaaccttgtctctactaaaaatacaaaaaaattagccaggtggtgctcacgcctgtaattccaactactcaggaggctcaggcacgacaatgcttggacccagaaggcagagggttgtagtgagccaatatagtgccactgcactccagcctgggtaacagtgcaagactctgcc

SEQ ID NO: 116843 - DNA, 1041 bp, Homo sapiens
ggcctcatggaatgggtccagttcaacagaataattctgttgctacaagaaatgggaaaaaagatgctagactgatagaatcagatgtccactataaaaacttgggactaatagaaaactatgtgatatttaatatttgcattttgtaacatggtatgtaaatcctttcaaatattttatatctcagtataataatgtagttttttatgtaagtatatgtgttttttattgaagttatttttagatatttccttattttaaaaaattgtcccttagagataaaattcttaatccctattttttctttactttttattttgagataattgcaaatttgaagaaatgtataagaatactgcaaaatattctcataaacccttcacccagatttaccagttgttaacattttgacacatttacttaattttttctgtttccgtgttgttgtagtggtgctggtatttcttattatcagaaccatttggaagcatgttgcaggtatcatgcccgtgtagaaaatagttagcatagcaggtctgctatctttagaaaggccttgcttgcaagattggcccttggttagtgtctgggaacatggatatcctaacgataagagtggctcactgtttttaatctgtttgtacaaacaaaatagtttgtgctaaacaattgctttccttctgggagtctgaattcttagtatgtgctgaacagagggtgcctacatgaccagcccccaacattggacactgagtctgtaatgagtttcctggtcaacagcacttcacacatactgtcacagtttcgtgctggagcatttaaacacatcctgtatgactccatggggagaggacgcttagaagcttgcacctggtttcctctggacttactctgtatgctttttccttttgcagatttttttttctcatttcactgtaataaattataggtgtgagtacgacaatatgttgagacctgtgatttttcttaacaaatcaccaaacctgaaggtggtcttggggaccctctctacacaatgcc

SEQ ID NO: 116844 - DNA, 1048 bp, Homo sapiens
tccaggaagggccctggtcctgtttattctctacctctagttaatggcagtggctttataataggtaaaagatgttaatggctaaaagatggcagtatttatttgaactctaactgattaatttcagtgagcatcctctgcctatgtggataggcagtggcacaatcctcccttcatgatatcttgctgggaatacttggcagaggataatgctgggtagatccttggtctgatatctctaggagactatacaatgacaatgagtctgaatgtgttgtgacttctttttatttcatatatcaattaaaaaaattaacacttatcatctttatccacaggagtgaaacctcggtccggctgggctattgatccctttggacactcaccaacaatggcttatcttctaaaccgtgctggactttctcacatgcttatccagagagttcattatgcagttaaaaaacactttgcactgcataaaacattggagtttttttggagacagaattggggtatgtagggtttgatgaaagttgatcccatttggcctagatactatttcacaagggttatgaactcatgccactgtgggttttgttcactgtcagtcttgaaaaatcaggtggcctaaagatagtcactctcgtaattatttttcccatgtgcctgtgtcaagattcttttaagtaataatgcagatatttatagagcataggagaatctttttatgtttaaagaaagtagataaatataaggagttagtattttgccaataatgctttcacttgcttctgttttagaaagcacgttttatcacaaatttgaacatgcattagaactgatatccagtcatatatcttatattcagccagtgttccttccttctgtctctcgtctctacatcttgtaagaattgctttttaaagccttaatcctgtcctcctaaaacagccctaatgtcaaaataccacctgtcttcacagtgtgttctgtggccacgcaggcattctaaggatatacttgtgcagctctttattaggagagagga

SEQ ID NO: 116845 - DNA, 1948 bp, Homo sapiens
ctaaggagcatattaatttgaaaaacaaagaatttgaagaagccctacttaaacaattgcccataaatatcagttagtatgaaattattgagtacttttatgtatttcagtattgtgctaggaagaaatgttgaaaacatccttgcttatagggaaattccagtctaatttgataaaatacggatacagccaaatgtagcagataaaattaagtatgcaaattagctgcaaaagagtagcgcataaggagaattagtggggtatggagtatgtccttatccataggagagaagagttttaggacttgtgacaaccttttgtggcgactatatgctcatagcaagcattagtgaccagcatctacagtgtcaccgttgtgaatatgattcagtgaaacagctgacagcactgaagtacatagattttaatagttttaaatttggaaaataacagttaactaaattgataaaactggaatattttaggacttacctgataaatttgaacatgttgctttttaaaaaatgttttcgaattaagttgagcttgttcacgtgttcgagttcttaatgaagcagttattttcacttattaaaaatgtaaatttttttgtctttctgttacgtaagcagtacatactcattgctgaaaattggaaatccatacataaataaagggcgggggctatttaaaagctcaggatcatattcgcaaagatagcttttaactactaggtaggtcctccagtctcacttgttggtaggcttctcacctctccaggccaacatgtgataacattgtagttttaattaaaagtaattctgcatcaggaatcagtgctcattttccatatcttattcgttttgtttttatttttgtttcgctttttgaaaattactttttcttttcctgtgcttctttgttggtgaaaagtcccattgactgactcattcttggtaaacatggggtgagactgtagattctcctgggttgcacatcctctcctcaccataagaggaaattttctccaagagtgaatttctccagtgtttttataagtctatgctccacacttcctttgttcttccatcccttttttactccgttcttctcacccagcctctgcagctaatatcatggtatctctcagtgaattctgttacctgaattgggaacagttacggcaggaactggcagccagggatggacatagttttggatgagccagctgtaacttttacggctgctcagtttgtatccctcctggtcagctggcgctggttcatgctggggctttcctgtctctgctatgcttagatagaagaggtagatagagactgagatgtgtgagtatcttccttcagacaggtggccattaaataccgctggggtatatgtactggaagttaaaggggctgctgatttagcacagagctaaatcagcattactttgtgtaaagtaatgacattttgaatattttttgggaaaacagattttataaatgcaggtttgtgtgttggctctttattttagatctgggatctgtcacagatattttatgccacatgatgcccttctacagctatgacatccctcacacttgtggacctgatcctaaaatatgctgccagtttgattttaaacgtcttcctggaggcagatttggttgtccctggggagtccccccagaaacaatacatcctggaaatgtccaaagcaggtatgaaaatgcgtatttcataagacaacatcttgaataaagtagccacttagctgctagttgctgaagggttgaacaaatgggctttattagccaacattatccttgtttgaagtattcattcaaaccagatctaaagcaacttaaaaatgccagagccttgactatgccggttatgtgttacattttaatggaaagtgaacaatactagatcaatatacaatgga

SEQ ID NO: 116846 - DNA, 1044 bp, Homo sapiens
ttctcatttctcttaatgtgtatatgtgagagtaaatgatattctggtgatgttcatggtctatgtgtgtgttgctcttggagagaagaaaggacagagaaatttatccaatttttcagatttttttcactgtgctattcataaataagcctgtcttgctgccaacaggttctggcttctttttcaggatcatctagaacaaggactcctgataccagtgtagacatggtattctttgatgattgagaacgtaaatgtgttatacgggatacattggttgttttatatgaactattattaccaatatctttttcataaattgcttgtactgcaattatggattaaaaaatttgtaaagtatcaatgtcacaagttttagattataagctaaagtgtttgttttaaaataaaaatatgacttttatgcaattagggctgctgaaattctttactatttcgccctgagacaagctcacaaatacaagataaataaatttctctcatcatcactttacacggcactgacagaagccagaaggaatttgggactgtttcaacatcatgatgctatcacaggaactgcaaaagactgggtggttgtggattatggtaccaggtaatctaattatagaaaaatcatctttaaaaaaatcattaaaattatgggtaataagattatatcttttggtgaagttgttagtgtatatcaaaccacattaacaatgatatccctcataagtattactgtatcaaaacagcactgatattcaaatattaagaaatctgttgacagagtcccagctgcaccaactttttattgcaatgcatttctgcaaatagggtagtaaaatattattactactgtttaaagctgatcctattttcttctaaataacagtgtggagactggagttatcttcttgaccaaggacttggcatcaaataaaacatagttataatgtagagagataaagattcctacttcattgtatgtcagtttaatctcatcctatttcatatccaattgttcttgtatacttcttt

SEQ ID NO: 116847 - DNA, 1061 bp, Homo sapiens
aactgtgattcccaagtgatttttcccgaaccgtattccgtattaataggataagtgtatgtttggaaattagaggccctgaaaaaaatcctgtattaatgaaatgttgaaacgtttagaattttgttttacccaatgtttcccaaatgtactgtgtttcattttgttttgttttaagcaaagcagctctatacatcctgagaaaacatttggggagtgatatactgtagtctttagtactcatcttatgagaaggctgcatgtgtgcctttaggatgcagacattgatcctggctttcactcagtttaattaggactctttaatacatctggttttaggtggtggagaacatgactttcactctgcagattcaggctgcctaataaagatagccctgtagacaatagaaaggaacttagattgagggtcttgctgtcataactgaaccatattcgtatggtgttttagtatggtgaaaacacttaatgctgtctaggaaaacatttgaatatgttgggaagtttagttagattatggcatgaactcaaatccataagattttagcattaaaattatagatttgccatgtaaatgtatttaattaataacattgatcatgatcacttacatctctgaaggaaatattaatgctctgcaaaaaagaagttaacttcttttataggttttcttgttgttgttgcatgacaacaaaaatgtcttcaaggcatagatccaaagttgctttctgtattggaaaaaataatataattgaaaacgtgattagcgaggagtttctacgtacttctccaatatgaatttgcctatggatgcctggtctgtagagccttcaagaaacgtaactgaattaggaaaaaaaaaaaaaaatcttcaagcaagttctttttccatgagtaatgcttcagcagtagcggatgtatttcagaattggtctggaatcagtagacttttgattccttagacataaaaatacaatttgaatatagttagtaatttcagtgaccaaaaaatttaacagggataaagacaatttcattattca

SEQ ID NO: 116848 - DNA, 1646 bp, Homo sapiens
cttgatcacattgatgaaagggcttccactgtgtccatattttgcaatcaatttggagactaaatctgccagaaataaagtaggcaggaacaaggaaacttaacgatagatcattgagctaggaaagtccgctcaaggaaattgctgttggtggtggcatgggcaagaatactgtgatattctttgttgaagaaagaagccttccctttgttcagaatcagagctggtatagaagactgaataccaatcaggcacagccaccttggatattaaaccttttggaaacttgcgatcaggctggatccatgcatgtgagcctattattcacccactctttttctccatcactgaatcctctttacatccttcatgacattattaacaaactggccatgtcatttattccttattgtgtgtctcacttggtagactagcagctccatgagggtagagagcttgtttggttttgcatcccctggcaaatacctggcacacagtaggtgttcaacaaatatttgtcaaataaactaactacgttagagaaggacttcagctaatatcaaaataaaaaggaccaagggtagttttagcaaacacagagtctaggtaaatgtctacttctttgaggataagtgattgaaaggttgtcataggagagctgtgaaaaagctctacagactgattaaaaaatagggtgcagcatgaagactcagaagtgtagcttacttattaaaatgatttattacagagaccagatgaaaatttttttaaaaaaagaggacctggaactctcaaaaagttttgagttataatctctgagaaatatgaaacaaggtgaaacactgaaacaaaaagatgacaaaaaatgaaaatgaaaatatttggaagaggagaggagtgagataaggagagattgttggaggggcaataacagaccatcttcactagtgatgctgaagagtaaagctgacactgaaagagggtatggatgtgaaaaaaaagtccatgagatacttttttaagaatgtagacaaaaggaagacaaatgccaacaatgagaaggaagatgatgatcggtatggaggacaagattccaacaaaagaattaaaaaactttaggaaaaaatacagcagaggcaatgatcaaagatataattgatgaaaagttttctgagctgaaaaggcctccctttatagatgaagagggataagtgctgggtaataaaaatgaaaaaagagccaccccgagtacaccatggtaacttagttcaactaaaaggaaaaaggacatattaaaaaagtgcccaggcagaaagactatattgtataatatagaacaaacgctagactgacttagacaggaagactatgaagttttgaaatcattttatactcaaagttatctttcatatgtgaaggtagtagagagacattttcagatatgaaaacacttataccacaggcacacttcccatatttttaaaaagaaattttaaaaatttcttgatgaggtcagttcagctgactgatagatgaattaaaattagcaattaaaaatgaagaattaaaaaggcattggaaacaattagacgtagtgaaatctaaatcattattgtcaattttattgtcaaactaaaggtagaagt

SEQ ID NO: 116849 - DNA, 1114 bp, Homo sapiens
gaaggagcagcatctgcaaattagattcattaactagatcaaaaagcagctaccagattttctgtcagctactcttccttgcccacttcggctcagggactggagttgtgttctgaatactctaggagcaggtctatactgaataaatcagtaatggttgttagaaatgtctttaaaacatgttctcaagacttatcagttaggaaaatcataccaaacacaatgaaactgaaaaattttctacatattctaaaaccaaaacataattagatgctgcaaaattaaaaatttaaagagataaagaaaagctcataaaataagagcatatatatacaattgagatttgggttatttaaatattaagaaaatagaatatttattcttaaacatttcctgtttatttgtaggactatgtgggcctatgttaaaatatagttccttattctttgattcatacattcattcattcagtgacaaatttactttgtatttctgtcttgggcagcactgtactggtatgtgttcatattttcttgcctctttcatttcttcttgattctttcttgctcagaacctacacaggcaaggtctcttttctaagtgacctgtgatttatactgtactgtgtagactgcccataagacaaaccctcagtgccttacctgaaatcttcaggggtagatgtatgtgagggttcagaattctttttaattttaggaaagtactgtgcatatgtggcatattattgcacagtctcctttgaaatttctgaatgttccgatcaaaaaataaagattctataaagcttcatgtcagttctgtttagatttactaccaaatgagttataaaaaagcttttgattttttcagagctttttggatttcacagtttagagattgtagttctgtagagtattggtttgggcgaattatgaaattgcttaaaataattagcaagcttcctaaaaagatgcattatagcagaaaccattttgattcttctaaatggcattgattgttactatcatccatacttgggtgcctcagcttttctttgttctgattcccatcatttcaaaaatctgttcaaaaatgtctgtctcttaagaaatct

SEQ ID NO: 116850 - DNA, 1123 bp, Homo sapiens
agtgctttaacagcataggattttaaatcattcttttcttcaatttcacatgaactttaaaagaatcttccttaccaggcccttataatttagtctgctatgattttgttcttaggtacaaaattcttttagattttatttgtgaaagtaattaaacagatagattgcatttaaagttatattttttatttttatttcttgaaaaataaaggcagagtagcttaatgttctgagaccacctgctaaattgcctggttagtctgtgttttaattgattttgtttatattttaagtcaaactttcttaattaactaattgcatggttctagtttattgtcagattattatacagtgaattcagtttgcaaagtgtgttttaattgtgtgttttgtgtggtgagattaaacttattttgcttgtttcttataaataacatcttcatccatcaaggaccataatcagaaaatgcaaatgatggggaggaaaaacaggtgctcatatatatagaattatgatgaggtattttgatatattaaaatatgaaggcagaattgtcatggaaagtaccatgtataatggataaaggattataataatttctagttaagatatttggaaatacataactgtatgtaactgaagaaaaactttgaaaagaagacgaggtggtgtcaaagaatagctggtgttagttttggtgtgtttgctagataatataaattttgaatgattctgttttgctattgctgtagcaccaacacttgaagttgtataaagtactgtgaaaatgttaaagtaaactaaatatctggagtatgagtgatttttaaaaaatgatttctattggggtgggagtaactgatggttacgtgagattacttcagtagcttattgttttcagtttcttgcaaacttagttctctgtccactttccacttcttttcctcccagtgtccatcatgtcttctgaaatagtaacataaagctaattattaacccaaagcagttcagaacatagactaaagtgatgtggcatatttcaaagtcttccactcttctgaactagattttttttccttctaaatgcagattaataaagcgtgcacaacaagaggaacaagg

SEQ ID NO: 116851 - DNA, 1065 bp, Homo sapiens
ctgtgggctaatttaagtgttctgagtacatgaaaggtagactaggctaagctatgattttggataggttaggtgtattaaacacctttttgacttacgatattttcaaattctaattggacataacccaatcatgagttgaggagcatctgcatttgcatataacctgcacacatcctcttgtgtattttaaatcatctctaaattacttgtaacatctgatacaatgtaaatgctatgtaaatagttattatactatagtttttatttgtattttttgttttttgtttttttttcaaacattttttatctgtaattggttgaaactgtggacatggaacctgtggatatggagggccaactggattctctttttaaaaaatatgatagtttgttggttttaccaaaaatataaatggtttgcctctcagtagataacatttatctttaataaattcccttccctatcttttaaagatctcttttcgagcacatataccgccattgggactgaaagtgtataagattttggaatcagcaagttcaaattcacatttagctgattatgtcttgtataagaataaagtagaagatagcggaattttcaccataaagaatatgataaatactgaagaaggtataacactagagaactcctttgttttacttcggtttgatcaaactggacttatgaaggtatgttctgaatagttctaaaattcatagaatgcttatcatttttgctacaatgtgtgtagattaattaggcaaaaggggaaaaaagtcttaagtagagctgtatcaaatactcttgagtaaaaggaagcatgagctttttgcaccttcattgaccacttgctgctcacatgtatagtctgtgggtggcgctactccgtggtctgtgtgtcactggtccaccagataagtacagaaattatttttttaaattgtcatatacatagaaccagatgcaacatgcttaacatcttagtggtgagttgcttattattattttttttaatctttagcaaatgatgactaaagaagatggtaaacaccatgaag

SEQ ID NO: 116852 - DNA, 1700 bp, Homo sapiens
gaaacctgagaagggagataatatttgatgatgcacaacatataatctatgtacagcccaatccttgtactttgagagttttgtgataggttgagaattttcataaaaaggtatgccttgtcctgaaatgtttgtaggaaatgttttcagtatttttagtattaaatcaatggaagatatattttaaacatatgagttagatgtgtgctgtttattttcttttattgcttacaactaaacttggtagtttatggagtattttctaagactgttatttataaaatgtaatgaaaccaaattattcatatatttttatattaaaccctctcagataattctgttaatatgatgagaactggaaatatagacctcttaaacatttttgttttttcttgataggaagaagaaaagaagtcggtcagttatccttctctccttagccacataacttcttctctcatgaatcatccagtcattccaatggcaaataagttctcctcacctacccttgagctgcaaggtgaattctctccattacagtcatctttgccttgtgacattcatctggttaatttgagaacaatacagtcaaaggtatgtctcaaaatatatcttataaaaaattactgtttattatgtacttgttttaagggggtaaggaaaggagaaaaaaataatgtatgctttactatgctttgaggaattattaacagggcttcacctttagccaaaagcttcatgcctttcatttgactattgctgtatattttagagtatatcctgatactaatttactcttaagttctgtatggcgagcaggtcaggaaataccattagtaggtgggcaatctgggccttaagtttagcactagtgacttttcccattcatttctccttgttagacaatatctctcagaagctagagaaatagtacttagttatttctatatcagaggctttgtattttcgtacctttctcttgagaatcactgcaactcagtttcccattagaaaaccaactgtttagaagaaatattagaggaaaagcatggggaagttttattaggtatgaaatttaatttagttagactgcagttatatacatacctgtttttaacatcaaaaagattgcatttggaaagaataagaattagacatttgacattgttcttatgtgttgcaaagctgttttgatattgcaaattgacatagatttagctggaaatagtaagtggttatggattctgtggaaaatatctcatggtaaatggcctaagtatgaaaagaagaggatgctcatgtttaaagacaatataagaggtgagaaatgtttaatgtagaacaaagaactaaagcaataaagtaaggataaatgcctataatttggatattagagatttacaactttatgtctaagatataggagaaaaaatataatttttttttctttatagatttttagttgagacaattttgaaagcaaaggtcagataaacaggggaaaaatagcaatagtatattgtacatgctatacctgtcacttgggagaggcctaagttcaaaagtatttttttcccaaggcagtggttttggcaccttgcctaaataatgttttaacaaagagccataaatcctctagagacaagacaaagaagaaagcaccttcaggcttccaaaaggtaggaaaatgtgggaggata

SEQ ID NO: 116853 - DNA, 1071 bp, Homo sapiens
cttggacaagatgattgctatttcagttcgtttttacaaaagtgatgtaattttagttttgagagaaagtataactttttctatcagtgaaagttaatttttatgacttttatctctatttttgtattgtcggtttaaatctcttgtagaattcaaatgtagaattccaaaggtgtttccctccccacattttttgtccccttctgttgctataaaggccttacatattcattattccaagagcaaatgtgttgcaggaattttagccatgcatgctatcaagtgatatgtaaggatggacccatgagttaaaatggacaaatgctttaggttagtagtgatatgtgcttttaaaagagcttaatgaagagggtttctaatctgttaatctgaatccagactttgttatgactttgatgtacgactctagacatataatttaggagttccctgagtctttagctacaaagttgtaatgtcaaataaaggaaatttatgctaagggcttcctgtgtgccagacatttggccagatctttgttaagctatttcatttcatttcatcttcattttatggaaaaggaaaacctggttttgctgaaacccacagctagtaaattgcagagcaaggatccagatctccagctgtctgactccccactcaggctctgaaccactcttactacacagctcgtgcactagcgcattctgccctacaaggcagtgtgaagctacttacatagtattttcaacaggttaatccacacagtgactccatgaaggaaataatacaagcattacctccattttacaggcaagaaaatagatatttaggaagaagaaattactatcctaaggtttcacagttggcacatgatagagtcctgtttcttattcttttggagatctaatgataccataaatgaagggttttcctatgtgttatttttatagtacatgggcagggtgttttaaatgtattgaaatgaattagaaatttttatcatatgatttaaaattgctgtgtgtatcatgtggtcttgtgatgactcagaattccttaaatgactct

SEQ ID NO: 116854 - DNA, 1050 bp, Homo sapiens
tcctgttcccttccaagcgtagtctgtatgttcaagcatgtatatatgtatatttaattcacccttttttctgtaaaagagaacttatatatgtatatttaataacatatatgtatatttaatccacccttttttcctcaaaagagaacttcaacatactgttttattccttctcatactaattttcacagaatatgtagttgtgctgctaatcttcaaagttgatctaaatatgtaaattttatcatttacttttcagatattggtacagaaacttttaaacaagtttattgtcgaaagtctcacaccttcatcactatccttgatgcattcacctcccggcactcagaatataagtgagatcaacttgagtccaatggaaatcagcacattccgaatccagttgaggtgaacctgactttcacatttggattgagaatcattggcttttatacctttcttggtttgacgtgcaataaagaagcacattattttagcttctggctactgtgagaacatgaattctgtgattctgtgggttttttcttttttcttttaccagtacagtaagaaaaaaaaaaaaaaaaaaaaagccatgctatcaatcaagattctttttttttaaactttctcccatgaactaccaccatcagtatgaattgatgcaacaaatgaagaaatatttaaagacagcctctcaacagattgtatctcaggttaaatgctaactaattatgtctgtgttgggggttgcgaagagattcttaaaagtatctgtgtgttgatcatcagttttacaaaaacacctatttggctgaaatggaataaaatgtttgtgggtaaaagctaatggccaaaatggttgcaatcattcatactagttagaaaaattatgtgttgaaataagtggaaaagtgcaatccatccacccttatgattaacgtagatgatttttatacctttttctgatgtacctcttgaccttctccttcccttcctaccctttctaagtatttccagaaatacctgattttgaatcattcaacagta

SEQ ID NO: 116855 - DNA, 1036 bp, Homo sapiens
aaatagaagcaattccataggtaccataaacctattttaggtaccacaaggtgtctttttacacagctcatttgaatacaggtgttctgagaaggggtttctattttaaaattaccatatcaaaataaatgtgccttatttttttataagtcttgttaaatcagtgtccatattactgtttggggaagggggaatgttgtggggtctgggagagggtgggtactttctatgacacataaattgtgtaatttttgcctgacaatgctggccacattctgatctgtttcattaaatttgtggtgatgttactctaaacattttgactatttgaatgtactgagatgtcagaaaacaaaacaaggaaggaaaatattgttaattaaaatgtgctgctgccaaggaaactgcaacttgaagcaaggattttgtaaaatgcaaaatccagctactgtttccatttcacagtagttaactatattaaagagagaatgctttaaaattgatcttgttttgaaacccacttttatgtagctcatcatggtttatcttactaaggaatatgtttgttcattcagttctcaacttttgtatgtgctaaccttaaagtgaagttctgagcccgtgtgccattacagtgcttttaataaaatttatttgggattattgtttccttaacattaaaataatagcgacatttagactatgcaattttagcatagaaaggagtctttgagtatgtacagttttgaaaattctctttgagataattgatttcatattctgtggctttcaacctccatttacctcttgtcattccaacatctttatagagaaataaaaacccaatttctctttcaccatttagtttgattatcatctggattttcactcaagatgcagctcctaagattattgttatgttaaattcataaactccttcacctttaataattaaggaaacaataccagtgttgataaagatattacaaggggtaatttcatgcaataaacatgtaccgtaagttttcttccacat

SEQ ID NO: 116856 - DNA, 1271 bp, Homo sapiens
aaaaggacttcctttttgtggacatctacagatgttagggttgccagaagcaaatcccaggaatgagatcagtattttcattgcatcttaaatgtataaccttcctgtgggagttcagtttgtctgtggttaagtgggtgtgcttaatcattctcgaaattgtgatcagatgaaataaaaaaaaaatcttgatgcaataacagtggttttgccacttctggttgtttgcgatggatctgtcccatgtcagtctggggttttattcagcttgtgttgctaccagcagttcacaggtaaagcagaaattctctttaaccagcaagtttctgctttttaaggttacttttagaataaatcatcagggaaacagagaggatgctttgctttgggttgtagtcaaaaactgattaaataatttaatgtctctggcacacactaaaaaccatacacttcagttgtgatctcagtggcatatttatttggttaggtttcgttacatttattattacagatgttcagttgaccaagtagttcagtgttttctttcctttttttggaaattttagtttgagtttgtgactgcagtgttcaagaactcagcatccttgttttctacaaatactgattaaaataaaatgctgtaaaatgtgatgtaaaacattatcatgatcttcccatgcctttgttgtacttgtgccgaagtgttttgatattcctttgtctggaagaaaatgtttgctttcattttgatcattttgttcaccttggaatcaacaggttttgatattttctcttggaagattttatatctttttgggaatatgtaatataagatctctaataaaagataatcttatcatgtacatggtcctctagagtagttcttaatcctattttgtaaacatgtattaaaacataatgaaggggtagggggagtagtgagggtctgttctttgttccttcatgatggattgggtttttttttttttttttttggacacagagtctcgctctgtcacccaggctggagtgcagtggtgcaatctcagctcactgcaacctccgcctcctgggtccaagcgattctctgcctcagcctcccaagtggctgggattacaggcacccaccaccactcctggctaatttttgtatttttagtagagacagggtttcaccatcttggccaggctggtcttgaactcctgacctcgtgatccacccacctcagcctcccaaagtgctgggattacaggcgtgagccaccatgcct

SEQ ID NO: 116857 - DNA, 1043 bp, Homo sapiens
cataccatctgtagtagcatttaggtatccagtaacctactccaattaattaaacagctagcctcaaactatttaaaacttgaagagatgggggagagctgtatttacccattttggttatccctaagtaccctttcaagttaataatttagaggtgctttacttgtagttattggtttaataaagtgctctccgtcagtaacagtgaataactagttttacagcataagaggtaaagtcgcaggtggaatatcagctgcggccaaccatggaaaattttttatttgattggaatcagaagctgaaaactggtagcccttaggttctgtccggatatttgtttcattaggccaagacaatgtgttaacagtttttgaaatagttgtccaggactttaaaattggaagcttttatataaaatgagaatatctttttttgaaaaaattacaacttcaaaaccctgggcccacactctaatgtggcaacaatgaattggagtgaaagcgtaattgtgctttaaacactctacaccttgcaatttgccacagaccccagcagagtccttcattcatttaaattatttacctggcccctatcagaatttgactttgaggtttaaatgaacagcaggttaataaaataaattttttaaaattgttttgagactaaacctaaattgtcagtaattggttatcagtaatcttatttttttatttctatttttttttactttagaacagctgaatagatttgctggatttggtattggacttgcaaggtaatgttttatctaaagacgtttacagcttttatttattgaatttagagtttttctttaatttacaatattaaatgattattattgcttcctttaggttgtttctttgaagcagcagcttaaattttgaataatattttgcagaaaaaaaatgaccattatttaaaatatataatttgatagtttttccagtaaggatagactagtcatccaattttataaacacaaagtaattttgtaatgagtattgtaactgttttcatgg

SEQ ID NO: 116858 - DNA, 1044 bp, Homo sapiens
tcaaatgactctgctgataggaattctgttattaggacattttctgaaagaaataatttgcagcattaaatgccatttaattgatgtgccatttcccacattaaacattcagagatctagtttcatcttatactatagacattaatattatgtattatgtattgtttcccttatttactagtatgcagatctggttttcattcttttcatattgaatttcgttatgggtagaatcatttgcaaacatttctagacatttttaaagatctatttaatttgtttaagaatggaaaacataaaataatgcatgattcttcaggcaagaataatttcagaaagatacctgttgtaaatttaatttatctctatgtagacatacatatacataaattatttttatatagtctctttacagaaaatgtattggcacatccttgcattgttctacgccgccaatgtcaggtaaatgtaatttctgtgatcttttgaagcaatacttctgaccctaatatgaagggcagaactcacataaatgacatgaaaccaggtaattgttacttcatgtgaaatgttccaaactttttggtctcaaaacctctttaaagtcttaaaaaaatattgaggatcctaaataactttggtttatgttggtcatatctattgatagttaccatttcagaaattaaaattgggaaaatttcaatgcatctatataattcattaaaataataacacctgttagtaagataatatgtttttatgaaagtaactattttgcatttttgcaaatatctttaatatctgacataataggagagagccagtttctctcgtatgcttctgcagtcaatctgttgcatcacgtggtttttgaaagaagcaaggaagtttagtcttgtacacatgtatagttgaaagcaggagaggagtatattatattcttttgagataattgtgggtattctttgcaattgcaccaaaactcactgtgtcgcagtttcttaaaggttatttgcaatgtgaaatcagaaatcattttagtga

SEQ ID NO: 116859 - DNA, 1398 bp, Homo sapiens
aaaacagtataaatcattataaattaatctgttcatgcttagcactgaaaagtatgtatacagaaataccattaaagtagcattgactgtatgtgccacagaacagtgtatttcagatatatattttacattgtagtaatattaacatggagatccaatggatacattacatataagtaacaaatatattatttttaaatgttttatgaaataataccattagaatgtaatacattctaatattttattgtttcacataataaatattgttttgacactcccccagttgatttcatataccagtcagttgccaagtacagtttgaaaaatgcttgcctaaaatgaacatgagttgggagatgtaattcagttgtttaaggcaaaccaaatatcaaataagaccctctttattatatagtctacagtactgtgtgtattatgcattggtcttcagattgtatttatataaccatacatactgtacttttaataggttatttaaagcacttttaagagtaattttgcttatgtgtaatttatgttgactttggaattaacttttgtttatactgcaattccaccatatttctttcatggctctgttatttcttgacaaaacattaacagaaaaaaataatgaaatatcttttttacaggttaattaccatgctcagcattaccatctcactccatttacagtcatcaatattatgtacagtttcaacaaaactcaggtgagaattttgtctggattctattaaaggtttatataagtgtcatttgggtttagtaatcattaaagcaagaataattactttcagtttggtcaataaaacatcttaactgttgtagtaaaactaaagtagcacaacgatatgtttttgaatctttcaaaatgtaatttagcaaaagtacaatttaatttagcaaaaccacaaagagctgtgctaagatgatgtctctgctatcaagaggctcatatttattcatggagacaaaatctttgaagattgtgctgcagtaagataaaggcaatattagaagtacagaatgctgtcagaatacaaaagagaagtaccttatcaaaactgggcttgggcacagtgtatggctgggaaaaactttgggaaaagaaaggcccgaattgtgtgcttcttgttgagaagtctgactcttcatgatgaggatagagaaaaggtttttaaagtagacgtgtgaaggcagaagacaaagagagatcataatgtttgggaatggatttaatggagtacaatgggagcttgaagtgggggttgaagagtaagagaaagatgaaaaagtagccagagaagtaagcaggatccagattctaaagcaccttctaagaactgcacactactagatcttaaaagctacaag

SEQ ID NO: 116860 - DNA, 3047 bp, Homo sapiens
aatttaaaatgtacatgttctttcacttccaggaacttatcccacatagatgtgcacatatatatgcaaaaatatatatacaaggatgtcctatgacattgcatataatagactggaaatgattaaatgtccatcactagggtaccagtgaaataattatggtatattatggtgaaacaccttgtaacctttaaaaataagagggtagctctgtgtatactaatgtggaatgatctccaggatattttttatgtttcaagataatactacctgttaaaaataagcaaaacaaaaatatttctataacatacacacacagatatacttgtatatgcatggattatcccgataaattttaaaactgctgctgaggactgggatgaaaaggagacagacttttcagctgataccctattgcttctttttaattctatcatgtatatctattaataatatagataatatagataaataataggagtattactgatggtatcatgcaaaggggcaaaaccagagacagtgaaacttgtagtcaaattgatataaagtaatagtgttaagtatggagaagagcatggatttgtaagatactaagggagtagaatttgtagaacctggggactgattagataggaagagtgagataaaaatgttttctagatatattgtttggacactaggatgatgaagctgctatctagggaaataggaaatacagcagagaaggaaagaattggtgtggtatgagtgagtatgattgggttaagttgtggatatgtaagtttcaagttaccttgtgtcatccacaggacaggactagtagggagttgaatatatagatattagggatatttaataaattagttaatcattaggggttttaattaataggaatgttcttcttggcctaagtataactttaaaatgatataaaattaattgtagttctctactaatatttctattagaataatgttttattggaaaatgtctacacaatatcaagttttattaagatcttttgtgtttcagatgtaggtattaacagaaataacatgaattttgttcaatttagggacctagagccctgtggaaaggaatgggaagtacatttattgtccagggagtcacacttggagcagaaggcataattagtgaatttacacctttgccaaggtaccatttttagcatttcttcagtattagtttcatgtggtgatgtgtttttagatgcaggcggtacatgtgcaggcttgttacatgggtatattgtgtgatgctaaagtttggacttctaatgatcctctcatccaacaattctcaattgtgtaaacatcatacccaataggtagctttcaacccttgtccccatccctcccctattatattgttttaataataaataaaaaataccttgaatctgaaaacttgtctgaagtaactaaaagaaaaaacaaagaataaaattaattatatattattaaattagtatgtgataaagaaaatgtgtcttggcttagtatctattgagatgtatctttcagcttctactgctatgtgccagcaactgccagctgaggaacaaatgtgggtatgtgagcaattcccgctctttaagtattcatttaatgaaggagacacatgtaagcaagaagaggtaacatgtccaatgtcacggggttggacagtctaggtaataaaagaagtgtcttatgtttggaatattgggtatgtatgaaattgaatatcaggaaaagaagctgaggtgctacattaaaatacgattgtgcctttttaagtttattctctatgggtttggaatgtgtttctttttttaatatatagatgttctgatcaagatatattcaaatggcagtataaaataaatggagttgtatagacagatttatggagatctattgtaataatctaggcgaggctgagaaggttctgaactgtggaacagaacagaaagggatgagctggctagacatttctgaagtatagtcgatggtcattatgttagcttggtaattggagataggagagaatgagttgtcagtagtgactgagatttctagattggaaaatgttaaccaagatggagaattcaagaagaagaaaaagttggagtagggaagaagataaagaatttatctttcaataaatgaagtttgagattcttgcaagacattgagggagagggacatgtctcatatttggttggaaccatggatcagagtaaaaaaaaaaaaatagaaaattgaagcacagggagagctttgggtattgtggcataaaagtagcagctgaagcttaggatagatgaaatcacctaaggagaaagcatagattaaatgaataaaatggaccaaggacagaatcctaggcatacatgtgtgccgtgtgtgtgtgggagcggtgggaaggggggtagttgggggagataatgagagaaattagagagggcctcagacaaattggaaatagcataagatgtaggacaatcatgttctagaaaccaaaaatgggagaattagaagtgtagatacatttgagagagagggtagagaaattagggaaatttgctttgggtctctcttttctctgtgaagcaggatacagggttatttggtgaaaaaatgataagcattggggttgtagtagaaaagcatgagaggaatgatacacatttgggacagtcacaatgatgggtaacaaaggaatcttacaaagagtatatgaaaggaatgttaataggtaatattggaaattagaaatttttaaggtgctatttggcattactctgattttctatatcagcactatatttttgtatatcatcctatcgataatgttaaaggctttggaatggtttgttaatccaaatttattctctggcaaggtgaattttttgcattgttaaagaagtgagatagttgaaggcatagctactagtgtaacgcatatgcccaatgttgggatttagtccttacagggaaggaaatgaaagcaagagaaactgatagtaagcttttttccaa

SEQ ID NO: 116861 - DNA, 2094 bp, Homo sapiens
ggacattccagcacattattacttagtgatgttccattcaccttgaaaaccactacttgccaggacctggcccataagggttaggtaagtcccaccttgatattattttgaataactatattttgcaggcttgcaaagttgtaatattactatgtctaaatattggtgataggaaacaactttgcaaagctgtataatgtttttttttttttttaataataaaagggacttcactcaccattgaagactggcctaactctgctggatgggaaatctgggaattgatataagaggatagtaacagaaaagttacttgctcaaatatcactaaaaaggcaaactatggaatggatccctcatcctcaattttaagttttagatttataggctgcattagctatgtgtaggtagatgtccaatctattttctttgcaggctgtccttgttttatcatttgattttttcatctctgttgaataaagcatcctacgttacagatttctgaagttaatatttttaggctgtaggtattaatagttgaaaaccttaaaaagattattctagcttgactataaattatgttgacatattaaagcagatattaaaaaatttagtataagcatcttgtttcagtatactgataaatttgttttaatttctatagcctaacttacgtggtggcaatgcctttttattcagcaagtctgattgaaacagtgcaggtgagcttttttttactgtcattttttttttatttaagaatagttttttgactattcagtatattgtagatatctaacatttcagcagaaaattttaagactatgtcttaaaatatttattttataaatatcacagttatatcgcacgttgcttgtctgtatatttccattggtatcttaagtcacacttctagttttaattatttttgtcctttccataggcaactatactcttcatttagacatctcagaacacagcctataacttgctctgaaaacaaagaatctataaactttttaaggcccttacatacaactcagatggttatggcttatcattggacagtaaattaataattacctgagaataaacatgatggataatcatccgaacaggaagcaggttgtccccacaggtagtttactgacaggattcttttaaaacatgcctttaagtgacatttgatactattgggtgtggtaaatactacaaagctgaagcaattttctgctagcacttgaaattctgtttgcttgtgttactattcctaaccacatggtggcgcttcaagtacatttaattaaatgtcttaccctccttcctacacttaaaactgtaagatgaaggtagtttttacttcacctgtatacaaaatccaactatttgtacacctgtcttctatttccacatcagatcctctagcatattcttttctctagtatatgtgagtgccctctctgtaaaaactcgcactggatcagcctttgctcttctaattactcttttctaccttgtttcttttctggctgtatcattcatctttgatttatgattattattattattatttctgttagaactaacttcagttaactgaagttagtgtcttgcgacccaaatcatactttcccttccccttgcatttggcattgtgttaaataaatgatgaatttttgtatggtgctatagaatttacagagttgtcacttgtatgagatagcctcattttaaaggtaagggaaaaatgtcaggaaggtaattatttaaggaaaaacaactaagcagaatgatttattggggaaaacaatttttagcttgagacagacccattatcacatttctctgcttaaattagacctgggactttagacagatttcttaacctttataattttcttatccataaattgtgaatagtattttaataactgacgtgtaacattgaatgagttatttatataagtgcccggctcactatgtgatagggttttttctgtgtatgtgttttttttaacccagtatttactccttgtttcctgcttcaagttccacttgctaactccttttgatctcttttgtctgcttttctag

SEQ ID NO: 116862 - DNA, 1038 bp, Homo sapiens
catgaggtcaggagttcgagaccagcctggccaacagtgaaatcccatctctactaaaaatacaaaaattagccgggtgtggtagtgggcgcctgttgtcccagctattcaggaggctgagatggaagaatcgcttgaacccgggaggcagaggttgcagtgagctgagatcacgccactgtactccagcctcggtgacagagtaagactctgtcttaaaaaaaataaaaaagaaagaaagaaagaaatccttgtactagtctccacattttaaaagtcaatactcatacaagattgttttcaagttgcaatacttatatatatccttttactgattaaggattcatattgactcatattccctaaaatcaacttcagacttcttattatagttttaaaccaaggttttaattacatcactttacctttcagatttgcagattatcttaactgctaaacttttaaaaaaaatgtatcaattgtttattgagtacttgcctatatcaggtactgttatagaccctggggatacaacagcaaacaaaaccaaaatgctctgttctcatagcacttatattcttatggggaaagtagacataaacaactaaataaaaggtatatttcatggcgattaactgctaaagaaagcaaaaataaagcaaggaaggcaaataggatgtgtaatgggtagggaggggcggttaatatttttttaagaagataagtaaaggtctcactgagaaggtgacatttgtgtaaagatcaacatgcatatttgggagaatattctaagtagagggaaggcaagtgcaaatgcccttacatgggactgtgtcatgtgtgttgtatcatacatgcttgagaagtaggaaggatgccgatgtggctggtgctaactaagcacaaaataagcaaatgttgaattgtatttagagggaaagcaggtgcaaaaactctcaagtgggactgtgtcatgtgtgttgtatcacacatgcttaagaagtagaaaggaagctgttatggttggtgctaagtaag

SEQ ID NO: 116863 - DNA, 1026 bp, Homo sapiens
gtagacagtgctcatttccatttttgtagaatgcgaaactgtgcttaggagaagttaagtaacttgacaatggttacatagccagtaagtaatggagccaggatttaaacatgtttaagaactataagcactatattgtctccttaagcgttacatagttattgcctttccatgtgagttctaagaagtttcttgagatgtatccacctacacatctccccagtctccctaccccaataagattagctcccaacttcactgctagcaattttatgagatttcatttgaaaaaaaatctgatgcctagataacagttaaagtctgcaaatcatggatgtttccctcttcagtcactatgttaggatttaaaaggaacctaaaaagagtcctttttctgtggcaaaataagcaaatgttaagttttacttatttcatcatttttatttcagagtgagataattcgagataatactggcattttggagtgtgttaaagaaggaattggaagagtgataggcatgggagtgcctcatagcaaacgacttcttccgcttctttccttgatcttccctacggtgcttcatggagttcttcattacatcatcagctcagttattcagaagtttgtcctactaattctaaagagaaagacttacaatagccacctagctgagagcactagccctgtgcagagtatgttggatgcttattttccagaacttattgctaactttgctgccagtctttgttctgacgttatactttacccattggaaacagttttgcaccgccttcacattcaaggaacacgcacaataattgacaatacagaccttggctatgaagtgcttccaattaatacacaatatgagggaatgagagactgtatcaataccataaggcaggaggaaggagtgtttggtttttataaagggtttggtgctgttataatacagtacacactgcatgcagctgttttacagattaccaaaattatttactctacacttcttcaaaataacattt

SEQ ID NO: 116864 - DNA, 1591 bp, Homo sapiens
aattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatcatgaaccatttagcgctctgaagcacagtgactttgcactgatattgtccaaccaagaatgcatacgaatagaaattcattttacttgctaaatgtcacagaaatggttactttttgcaaatagtagtgttggaacaaaaaagtgatatccaaaaagtgtaaaaacagtaataagtagcaaatctctcgtgtgtgtgtgtgtgtagttactgaaacacctacattttccatttttaaattccaccaaaagggggaaaataaaattaaacaccactgatcacattttatattttatggtgactattttagattaaggtttactttgtccaaccaatagcatttaaattgttttcaattaggatagtttcagataagagtaaaccagaaaatttcaagtttgaaaaatttctagaaaagaatctgaatagaatcaagtatttactagtgaaaatctgtaggatcctttgtttagctaaaaattaaatatttcaggatattttttggaagttagcatgaaaatagttagttacataaattcattttattgtagaataattataagactgataggctgaaccatacacaaataaggttgatcttgttttcctttttggagaaagagaatacaaattaacatta

SEQ ID NO: 116865 - DNA, 1151 bp, Homo sapiens
agcctagggaaatttcacacttttctagaggccacagctggtttgtagtagattgaggaagagaacccatatcttctagctcagagaacattgtattttcccatatgctcctgttaaccacgggaaaataatgtcacattgttaccagtggtgaatacctacaggtctgcagcaatttggttcttgcctcctaggaggaaagagtttgactgaagggcataggcagaggaagagattgaggcaagttttagagcaggagtgacagtttattgaaaagttttagagcaggaggaagtgacagagcggagctagcgcgtcaaaggtacctctatggttttcctcgctttcttgagctgggaaatggccactgtgtagtcgcaatggaaataaatccccggaactgcgattcagtgtgtgaggaatttgaatttagagtttaatttctcagagtattctctccaggaagaatttttacagtatctcaaagatttcacttgactccttgatcctacataaacccaaggagaaaagaaacgggtcgctccaattctagatcacattcttcaaggtcaaagtctagatgacagtctagttctcgatcaagatcaagatctcattctagaaagaagcgacacagttctaggtctcgttccagaacatattcaaggtcttggagtagagatcgtatgtattctagagatgatcgtcgtgagtacagaaataatagaggaatgaaatgaccttatgggtacagaggaaggggtagagggtattatcaaggaggaggaggtagatatcatctaggtggttatagacctgtccggaataggaggcactctaggagtcctagacgaggtcgttcacattccaggagtccaaaaagaagatccgtttcttctcaaagatccagaagcagatctcactggtcatatagctcttctaggtctccaagatcattctcttctcgttcttcatctccatatagcaaatctcctgtttctaaaagacgagggtctcaggaaaaacaagccaaaaaagctgaaggggaaccccaagaagagagtccgttgaaaactaaatcacaggaggaactgaaagatacatttgaacatgatccatctgagtctatcgatgaatttagtaactcatca

SEQ ID NO: 116866 - DNA, 1124 bp, Homo sapiens
attttttctcctataacagttcatcgatcattgtaatagtgtctcttgtttacttgtttcttttgtcttctccgaaagaatgtaacctctgtgagaacagaaaccttgatgaggaggatgataatagtcagtgttaattaagtactttcttttctggaaaacaggtagagttgtctctcttggaggattgtgaatatcaaatggcttattagcaaaaagagctgggaggtaggaactagttgagttagtggaaaaggaaagtgagggcagagctgaggtgaagagcaattgggtttctcagagtctgagctggtaatggagacagggtgggttagaaccatattaatcatgtgaaagtatttagtgttaccattctctgcacttgttccttgcttgctaacttttgcttttgctggttaatgttttcttccttgaaatgtaatttttctgagtttattactgaaataactcttgaaatcttgtctttggtacagtgtctttcctgacactgcattacacacagacacaggtgtttttccctatattctacttccaaagaaaccctgtggtgaggagagtaacatatttgtacattttataaagttaacaatttacttactgtgtgttgacatttagtcataataaagatggcttttaagttctcctctagttctaacactgatgatacattcgtaacatcatggcatgtaaatgttctttacccagactgtacactgctcagattaaccaatgcattgggctgtgacctctaaaactgaaaatacttgggagtaaaaagaaaaaaaaaaggagctaatgaacctaagtcactaattgggtctacaagtgctctatcccatgactatggctatatatgctgtccccagtcagacttcctacagtcctacagattagtttcttctacaggggaaactagacaagttgtgaataggtggtggtagtgatggtagtagctatcatgtattgagcagttactatatgactggccccattctgttttacacaaatttactcattgaatcctcataacaatcccataaagtaaataaatacctgttttacagatgaagaatttgaggcacagggagcttatttttccaggg

SEQ ID NO: 116867 - DNA, 1027 bp, Homo sapiens
cccactgtttgtttttgtatgacccaggagttacgaatgattttgacatgtttaaatgtttgtgggggcaggctgggggtagggagaaggatatttcatgacatgaaaactatgtgaaaatcaaatttcagtatctatagataaaagtttaatatacccatgcacattatttatctattacgtatggctgttttcatgctacggtggcagaagtgagtagttggcaacagagaccacatgcattgcctgcaaagcctaaaatatttaatatttggcccattatagaaaacatttgcctaccccttccatcaccactcctggtgaaatacagttgaaaatataaactttcctaataaagaaaattagtgtcagtaagtgtctttcttatgaaggacagcatagcaaatatacgtatgaggttatatcttaatcttcaggtgttaggttattatgattatgtttgttaatgaaaatttaaccttttttcttttttaaacaggttcagaaacttagtctggttgcagtaagtaagtatggactttattctgaatttatgcacatctaaactttttttttattttgacataaatgtgagacttacagagcatataaggaagccaaggtaacatgtatgtcttataaacttacattatcagcaacaaaaaagggtgccaggataaatcatgttttgcttttagttgttatgtatctttattttctttaatctggaactgttctttagactttctttgtgcttcatgacattgacacattgacatttttgaagagtacaggctcatttagaatgtccttcagtttgagtttttttgacatttcttcaggattagatttaggttgtaccccttgggaggaatcacagtgaattgtatcagaaggcacatgctgttagttggttctgttcctggtagtgattggttaggaggctctatttttaagttagtgttttgtcatttgtaacgaataagtatcttttggtagtatgcactgggactatgtaaatatctta

SEQ ID NO: 116868 - DNA, 1004 bp, Homo sapiens
actgtaaggagaagttttcccttttctcacattttggtatttctttccaatggaagggtttttttttaaactatctaatagaataaaacatttctcagggcagagaggtacttgttttaccatcaaatatggttcttgtgagagaaacagaagacctacaaggactgtaatgtgtatgtgtattaaacttatattttaataatagattagaaggcagaagaaaggcattggaacttaagttgaatacaaaagtgaatgataaacttataaaacagggttatgcaaacaaatactaatatggaatttgcagcatgaaaagtacaacaatcctgtgtctactaaccctcctgccccaaaagaggaaatgaaaaggtcagtgtgaccaggatactgagagaagaatcatatgtcacgtgagaaatgctaaagattgataggcatatttcccttggagaagactgtagaaacaatattgtctttaaatgttttaggaataggcatatagaataccatatgtaatatttttgggttggtccaaagggtagagttagagatttagattttgagttacttttaaaatttttctggagttattagtgaacttgatgttccagaagatactcacatgggttaggcatgtggctcacgcctgtaatcccagcactttggaaggccgaggtgggcagatcacctgaggtcaggagttcaagaccagcctgtctaacatggcaaaaccctgtctcttctaaaaatacaaaaattagccgggtgtggtggtgcactcctataatcccagctacttgggaggctgaggcaggagaatcagttaaacctgggaggcggatgttgcagtgtgccaagattgcatcactgcactccagcctgagtgacacagcaagactccgtctctcaaaaaaaagaaaaaaaaaaagatgttcacgtgaagactggatgactatctgtcagagctttgtgtttcaaatgacagttttttccaaataacc

SEQ ID NO: 116869 - DNA, 3023 bp, Homo sapiens
accttgtgacattagcttaatcatcagaatagtgtgtggaagagtaagaacttaataaatatcacctattattatttcactttttaatgtgtagctgatattgttttcctccaaaaaaaaaaaaatacagctttcaactatttttcttcttgtagtaaacttctatatacatttccaggatggaaagttggagtgacagctcttcagcaggttagtatttttctgttaagtcaaagaggaacaaagttaataggaaaatccttcagtttcaggaatcaatcataattttagacgtaaagacgaaacaatatatagcttagtttacctttaaaattgttagcctgaggaaatagtgttttggaaatgtaagttaaaacaagtaataatgcctttgccaataacacttattggagtcctttgtgcttatagtttgacttaaatctgtggttgctatggatccttgtttctaatcattttgcaagtatatgtagtccattgtcttgtgtagactggaaatgagtgttcagcaatgcaagcggtattgtaagtcatgtagagaaatttgtcaagatgttgagatttatggtttgaagtaattggagccaaaatcctaatgtttgattcgatgatggactatttaagaaataactgcttttttttaatgaatctgcaaaatatgtataaataaatgaatgcatgtctacagcgaatcttgtgtttatattggccacatatgtagccactatacccttatctttttcagtatccattgtctatacttgcccaatttatatgtattccttatcttctcttgctgtcatcagcctagctccacttttgcctatccagaagactccataagtatcagaggattaggacccttgaggacaagggattatatctgttttagtatctccaatttctacacagggtctcatgcatagtagacacttgatgacaaattaataaaacgtgtagcctgattccattctataatgatattggacattgatctttgctaaaatagagaaattcataatagagcctgtatgtaagacttgtattatagaccattataaccatagaatattagaactggaacagactaattgtaaaactttttttgccttttcacatgttttgtaggtttttcctactttcttggataagcaattcttcacttcctttgtaattggttacatgttgccacacatagcgcaagcctttatgttttctagttgtctcctttttctgtttccatccagtccagtgatctgtagtgattttatacatagctttctttttctgttgtggttgttttctttccaaaatcttaccagctaggttttgggaatgaggatgggatgttgactggcagaattgaagctgggaagtaatttggaaaaatcattactgaatacttctatgctgaataaaaaagtatgcttgaatggtaatacttgctgagtttttctgccatcttttagaagatacttcattatttcttttgataacacctaataatgatgcgtatcatcaggattattaaagctattttgcttaagaaagtaaaagtttgaataatttaatttttaggcaccagccgtggatgttgttgctattggtcttatgtcaggtcaagttatcattcacaacattaaatttaatgaaacattaatgaagtttcgtcaagactggggacccattacttcaatttcatttcgcacaggtaacttttaacatacttattgataggagttaagaacacttaaaattcattactttaaaagtcaattttttttgtcttctggtagcttaatctaatagaagtgaatgaatactggagtaaaaggcaaagaaatatgaatagattattggtatatagtttttttctaactttatggattaaaagggaagagagaagaattcttgtttattttgggggatctagaagtatttttcttaatgtattttattttaataacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttagggtattatgattattgttaacatcttcctggctcatctaacttaccctttgggttattacaagcttgttttaatgtatcagctttcaacctagaagatgaaaggaatatggaatgagatattggtatagatgaaacaaaaagcacagcaggtgacatgattgcagtgaagcgggaaagaattacagtttatttctcccccaatacccactccctcccttgtagctccagagtcagtggcttagcaagcactactcaataccagttgatttatgtagggggtgatttgactgcttgcagatcagatggaacattgtagaagaactgacgtttttatttcttggcagatatggatatttgatggtcctacaggtgaaggccgacttttgagattcagaatgggtcatagtgctcctcttaccaatatcagatattatggacagaatggacagcagattctaagtgcaagtgagcttctgcttcatactattagtttatttcagcaagtattgagatgtgggtgcccagtatgaggtttgatatttacacatacttagattcacatatctctttgagtgacttagaagtctgggtaaaactaagagtcctttttgtctacttgagaagcactatagatgttattatctatgcttaatgtgtccttctatttactaatcctcagagacagaatggttagattctaaaaattctgttagtctgctgaaaattattagtacctcattttcattttatcctttgttcttactaaatggcattctataaaaagttgaatattttaatgaagtagttgcaatctggttttccctttaaagtgtcccaaactgtaacttcaagattttcaa

SEQ ID NO: 116870 - DNA, 1247 bp, Homo sapiens
tcttgggtggtaaaaacatactgctgccacccaaaagatgttcatggcctcacttgagctatctgtagagtgcacagtttttaaaatggaaggtagcttagagaaagcatcaaagtaagtggcatccaatatttttgctttaaagcaatcatttattctctttcccttttcatggtttccagcctttgaaagattttgtttattaaacaacaaaatcttacttggttttatgattactaatttttaagttactatcttatactgttcatgcatgtatataaattttaagattatttttaacaatatctaaaataacttttcttagaattaaaaaataacagtggtaataacatctttgttttgtttctgacttaaatgggaatatcttgtactttatagttacaagactgatagcttttcttttatatacactttttattaagaaggattcatagctatgtatgttcccctttcccccatccttaggattaataaataaaaagagagttaaacgtaaaggacttcagaataccatgtcagtgagacttccacccatcacaaagtttgcagcaggtaagtaacttcaaactgtgttttgagaagttctcctttgtcatttatttcctactgtatgctgttttattttctgttttaataaatgcttttacaaatattaataagcattcagaaggtaaccccaggtgcatgctggtcttgtgtgaagactaaaaatgagttattttaaatgtgaacttcttatctattaacatcaggctttgctcttctgtataacaggtattaataatatttgattttatagcctttttattctgtcatatgcctggtataatgaaagtcactaatgtaaaaagaactggaacagcagagtatgagaacatagagctctgactaattaagatctaagaatactgaggtcttagtatactatgtcatttgacctgtgccactttcaaagaagtgattttaagaaaaatatagataatgggtttgttgcgtgaaatctatcatgggaaattactgtagaggcaccatttctatttgaaagttgttattatgaccacctttctgttttctcagagcttgagtcatgtttctaaaaacatttgaatcacatcacacatctgcttaaaattttttagtggcttcttaacacctttagagtggaatctcatctccttaacatgactttcaagaccctttgtagtgtggtcctgattgccttgccc

SEQ ID NO: 116871 - DNA, 5492 bp, Homo sapiens
gaatggagatagaatctagcatatattcttatacacccaaatataattactttatgttaaaaaaactaatgaagcaattcatttattgttcttttgttaaataaaaaggaacaagtagataaaaaaatgctttggaaagcataaagtgcaataaaaatgttagttattttgtcatttgtgggttttttttcttaaaggcagtggatataacttcttgtggaaactttgctgtaattggcctctcatcaggaactgtagatgtatataacatgcagtctggcatacatcgaggaagttttggcaaggatcaaggtagagaatttttttccttgttttttattaatgtagatagatacaaaactagtagtgaaagctggtatgtataatctttaagtgctgggcattttgctaaagttgaagatgggttataatcaaccctatatggcagatactgcaattgtatcataaggaccatgttgaaagagaaaagtcatgggtacttaaagagttacgtggatattatacagattaattttttttcttctctcctttaagcagaaaatcttaacaaacttttcaaacctatgttgtatcgatctgatttctgtttttttactcgaacagtattaataattaagaatcttcttacacccctaaaatccagattaatttcaagattttaaaggatatttaagtggcaccttacatatttgaatgaaggaatcactgtgtgtattgttcagagagaaacactgccaattctgattttttttttcttttgacatctaccttacagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacaggtaaacttttaatgataatggattttctctttgattcttttggtaaaagtcataaagtcacaatttaccaagtgggaaaaatcagactctttaataaagaacaacatttggcttaatttcccccaaagtgtacttgatttaacaaaattcaagtggaggtgagattttagttcaagggttttttgtttattaaaactggtgcatttatcttgctagtggcattctgggactcgccttggatgacttctccattagtgttctggacatagaaactaggaagattgtcagagagttttctggacaccaaggccaaataaatgacatggtaaaacaaactctaactaataaaacttgactcatttctacttttgtttgggtgtgttatcctttaatagccttaaaatcattatatgaggtggttatcaattttaatttgcaggctatttttcaaagattttaaaggaaaattttgaattaaaagtttaatatttttcagggagttgatgcgatcaaattaaagtataagttttagaactcatcttttttttcattaactctaaacaaggccaaagtatactttagagaatgaatgatccattggtatatatgtcattcttaacttaatattaaaataggctgggagaactcatttctgatttactatgtatggaatgaattaatagtagaagaccatttccctggaatatctggtatctggtttattttagtttagtgctatttctagagtttacatatcttaactctgaaagggtttaattaataaaaatgtgcttaagtttactattatgttcttataatgggatatatgatatggaaagaagtaaactagtttaaatagcatatttcattaaaaagaacttttaaaataaatttgtcacttgaggaccatattaagtgtatattatcatctttcatcaattgcagataccttgatttgcttgaaaatagaaaaagtaaaataaaaataaaatcttaatacttagtgacgaacccaacagctgcatttactagttctcacaccaaaaatcagaatttactcctttccttcaaaattgaagaaaaaaaacatggtcaggacattgtgttctgcagataggaggctggcaaaattatacatcagcagaatttgttttgacagcatctgtagaaatgagggtgggattgggttaattgtgctgaaatggcacttttgaaaacatctgtcagtgtcaagttgctcttcctatttctttttcaaaccttactttcaacttgtatatctcgagtttccctgctcagtaataagttattccggttagtcaaatctgtgagcatttataacatgactttacctctcagaatcattctttcccatcctttactatctgtaccacccttctgtaaattgatctatctataacttgagatttgagttcccattgtattactgcagcctgaggaacaaatcaacatttacgtatcccagtatcatctactaatttaaactgatggatgaacagtctactacaactgtaaactttaaagtttttccttttgggtcatctttcacctgtgatctggtttgtgcctcacaacccttaggtactacaggcagagagatctattatttatccattttcatagctagaaaaaataatgggtggcataagtagtttatttaaatttattttgaaaatctgattattatagtttgtttagaaataaagcattattaaaagagaaaagatttttaacttaagcttcaagaaaagtaagcccttatcacacacataaacattgtctataaataaatagaagattgtgatttgaaaattaatgcagtacacttttttaacttttaataattcatttaaaagtctaatctttatccagattccaaatcagtggtatttaggaagtggtattttcttttatataaaataaggcagcctgaatgttagtcaaattaatttttttatgaagcctgcattatcttttcatttattacattctttaaggtgttaactatatatacatacacacatacatacaaatatattcatatatatttatatataaataatatatatatatatatattttttttttttaatttaaaggcttttagtcctgatggtcgttggttaataagtgctgcgatggattgctctattaggacttgggaccttccttctgggtggtaagtttatatttctaattccctaacctctataagatttctaagttatttttttcacatgtgacttttaccgatagttaatgggttatatgctttttcaatgtgactatatttggagatttttctgacatgactatattgtatccttggagtgtttttgataactaaacagcaggtagtagtgtcatgaaacataatagaaaaatgaaatctctcttaggttttctcatcctgcaaaattgagatacagaagcgagatgcctaaaccttaagaaagctcatttgacctttttgatactccaaaataaagctcagacttaaggatggcaaacttttgagtttttttagttcatgctgaatttagttaaaaggtcaaaccccctaacttttcctttttgtatgtctcttctgcttctctgacataattcttaaaagaaggcattttagatagtcttagtgcattttctgttgcttataacagaatattgaaacttggttatttctaaagaaaaggagtttatttcttacactttgggggattgagaagccccaggtcaaagggccatatctggtgagagccttcttgctggtggagactctgaagagtcccaaggtggtatggagaatcacagagtaaggggactgagcgtgataatgtaatagcttgagtctgtctttctcttcttataaagccaccagtttccctttcatgataatcccttaatccatgaatgggttaatccattaatgaggacagagtcctcatgatccaatcacctcttaaaggcactccctctcaataccatcacattggggattaagtttaaacatgagttttggaggggacattctaactatatcttaaagtggtgaaaatgtgtgtcttcggatttggttaaaacgtaacaaatgttcagaaatctgtttcatgggttgaaatttgctgctaatccagggctttaaagagaaagtggtatgaacagaggagacatacagaatgtgtcggctttgttgttaaaaattaagtaggtatagataccatttaaaatcatctcatttaacataggattgcttagatgagtatgaagaaaggaagaattgtgggaatagcaaaacatctaatttaacagtaacataccattagagaaagataggtgagaaaaatgagaaggaaggtggtactttttaatctaaaatattcccaaattaagctctgttcacttcctcttcctactcaggaatggataagctcatacatgaaaacagtttgacctttaggaaggaaaaaccctgatgtcctcagttcccttcgagttcgaaacaggcctgaggcatacctacccatcttgcatatacactggatttgtagtaagcacagctaacgattgtcactagtgggtccagctctaataatcagggacctttgtccacaggtttgtctctttcacttaaaatagagtgaagcaaaatcgaatttattgactgtatcctcctcaggcttcagaaagttcacttaaagttggtatttcttcaattaaaaaaacattttgttaaagacactattagaaatattagtggtctgtcacttcttgggctgttgctattttctaaaagttaatgttatataatttgaattgctttaaaataagaaagttgtataaatagtagagttggcatagtgcctttttcattttcctgtttaatagttttagtttatattagtgagagagatagattattcagtagtagtaaattggcaatgtattataagtggtaaattcgtctttggaatgaaaaaattaggatctgaaagtagcattcaaagccactaacctttgactcagcattagccttttgctgaatttcttatatcagtaagaagttgaacagattcaaatctgatagattttcagctctagtatctttatttttaggtgaacaggcaattttaagtgaatagagaggcatgaagctgggtgtagcacaagagcaagaagtgaccacatcgaattgttaaaagaaaatgtaataaaatgtacattgattgaagaaaagtatatttttattaaagaaaaaagttttggttaaaatttgaagtggaccaaatgagagagcttgaataactatccaacaactgctgctgcttaattgcaactaagctaagatttacaatgtgctgctaggcactgtttatgcttttatttttcatatcctaacaagttgtaggtactattactgttattagtcccatttcaaaaatgaggaagtggaggctattagagaaattaagtgatttgcccaaggtgacttagtttataaatgacagagcg

SEQ ID NO: 116872 - DNA, 1355 bp, Homo sapiens
tttgtatttttaatggagctggggtttcaccatgtggccaggctgatctcaaactcctgacctcaagtgatccacccacctcagcctcccaaagtgctgggattacagccatgagccacggtgcccagccagattgagttctttgaggggtgagaaatatataaaattaaataatcttaatagaatttttcatttgttctgtctcaccccacccctacttcctgaggagaattacatgagaataattggaatagaacattgttttcaatttctcactgaggcagaaacatccccttcttccttaaagatttctgtggaaggtgattttagcactttggaaatagaacatatggaagcagtctccatttgctcagaataataatcagaaacaaccttctgaattgttatgcagggctctgatcttgtaaatctgatctcttagaataggaattgttttaatattatttcagaaaaaattgtaaggtaccttgggacttacttttttaagattaccatgaaactgtatggtagttttaggtctgggatgagcctgtgcatttatgtttcatgaactaatgtggcagtgtagaatatgctgtgtatgtggaaaccaccttcctcaatttggtggttttatataatggaagtcccatctacccacacaccacagctgtggaaatgaagttacacaatgaagttgacaagataattatagtttgaagtaaaataagtttgctcaagcagtaagctttttaacagatagtacctaaacatgttaggaagttttacccttcacgtatgtaaacttttgatgagtaatattaagacaaaggaaataccttaagatttgaaattgccgtgttttaggtttaatctttatatgtgttaggataatatcttcatctctggattgtttggattaaatgacttaacataaataatttaatagtgtatggcatagaataagtatttagcaaatgttttcttttccccaattctcttgattcccaataaaagccattcttgtgggctttcaaaacagacttgaacagaaatcagacaggttattgctcccttccccataatggacaattaaacagcagtccttttcctgaacacactttgatgtgtgtgtgtttgtttccagtgcttctaattgttgtcttttctttccatcttgcattcattgtttaaggtttacatttttattggctcttttagcaaattgagagaggcgttttaccatgggcaagcaacttaatgcctcccactggacagtcttcatttacatttgagctgctcacagtgtgtgtcccatgaatcactgatgtaggcataccctcagtgtgtgtaag

SEQ ID NO: 116873 - DNA, 1060 bp, Homo sapiens
ttacttatttgaaaaataggtacagttgctcaaaagctttttttaaattactattcttatttacatccattttgttatattactttctccttttgcctaagcttttcattagtttcactgaagtaacagaaatacagaatactgataattagatttattttaaatgttatatctttagaattgtctccaagtcagtctaccaaaatttagtattcgagaaaaacagaaaatttcctcctgtttcctccctgttgttgaaactgcttctccagttagtcagtctagttaatgttgtctttctcattaagtgagattattttcacatagtaacttagttaacaaagctgtttattagtggtgactttctgatcaatgctggtgattaaaaaaaagaaaacattttctgcatctcttatcccttatctttttggcaaaaatatttttgtgaattatctcctttttggtagagttcaaatacttttaacatgttaattatttctgtagccttatagactgctttttgttggactcggctcctctcaatgtttctatgtctcctactggagactttctggcaacttcccatgtggaccaccttggaatttatctatggtaagttctttcatacagttctgttttgggatgaagaagattgtattgtcagagagttagagttgctaaaattgtcatttaggctgtttttaagtgtattaaatggaaatgtcacaagttaacacagatacttaattcactgtaagtctgagtgattcaacatctgcttgataatgtagacagctttgctgaagtatattctaaaccacatgattgatttttgtctgttacatttggcttttatttgcagaaagaatgagtgatttttaaaagtttaggaaaagggagtccccagccaggccatggttttcctgccagtatcccacaactactttacgaccttggccaatcccttctgaacttcagcctagtttgtatataaaataaggcacaagtataagcagaatactttctgagatttattctagttgcatgacttttataaccg

SEQ ID NO: 116874 - DNA, 1460 bp, Homo sapiens
acatcttgattagtcatccatggctagggtgcaggctgagtagcagaaatatggctacttagagggccattctagagaaggggaatctatgacctttcagcagccacaagaatatgctcagcatattcgcactctgacttactctctgagttcatctttccttttaatttccttaaataaaggttgatatatgtcaaaacaatatatgaaatttactttaccttataaaattattatctactactggtctgtctttaatatgtttttgtactacatcaggaaagagactcaataatgtatttacacagctttgttatgatggcatctatgacataagtcaaggcgtttttaaattgataacaatctatctttgaggtattttttaactaataaaagtctgtagtcaaattcaagattgtagagtgtttctctgaaagaaactttttataatttttaaaatattgcttatgttttgatttttcaggtccaatatttccctgtattcagttgtttcattacggccacttcctgcagattatgtcccttcaatagtcatgcttcctggtacttgtcaaacccaaggtaattagaaaattgcaaagtaatttttgaggtgtaatattataaacctaatgtaggagatattgctaccaaaggcaaagtttagtgcattcaatcaaagtgttttttaactgatataaaagactttgaatgacttcatgaatttatgcaaaaatataattgatgtggtattgataagctatcaaatagtataccattgaagaaggtgttttgggtctagtgatgggagttttagttaatatgagaaaataaggaaaagacagggataagtaaatgaaataaatgaacagtctacaaggctgcattaaatgaacatgttatgaaatacagatggatttggaatgaattaagttgcttttatatgataaaaatcttttgttttacctgaaaaatttttttaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaaggtaataattaacattctttatagaccctaagcatgcatccagaagcatttttatttttttaagcagagagaacttctcctacattgagggcattagaagagcaattaatatgtaagacagcactgacaatgctatttaatcaaatattgtttaatatggtatgattatcacaagatattcatatatatatcaactttgagaacactcagcagacatttggatgtggcaaaagttgagcctgtaactacagagctactggaaactgatcttttaaaatccagcctaagaaatcacttttatataagtttctaaaacgagcgggaacacata

SEQ ID NO: 116875 - DNA, 1016 bp, Homo sapiens
gttgcagtgagctgagatcgcaccacttcactccagcctaggcaatggagtgaaattccatctcaaaaaaaaaaatgttcctgagatactgatatgtagcagtgtacttaccaaaacaaaattctttcaatggaaatttcagtagagtttttgctaatataattttactagcatttgaaatacttataaaccagcaatcatgttttcttgaattttaaaagcacaaggtactaaagaaaaaattccagcaaaatagaaaaattagagctgtactttgaaaggaaattatcaaattacttataatgtcagtctgcttctggctccaaagttcctttggagaaaagtaatttaagaaactcttttgtattaagcatttatgtaaattttgctttccatcctgttttgtgaaagagtttgtactcaatacaaaaggaagtttaaaattacttaattgttatatcttcatgtaaatatattcatatttcaggaaaatgagctgtgtttgtcttagaacttcccctgtgccctgtcactttttttctgccttatcggcaagggtgctagagatctgcattgggaagcccaagttaaggatagctgtggtattggtcagaagagatcatattttaacattcttatgtgaaagagtttcattcctcttttactttttggtatttgttttaaaattgatttgaaattaaatatgagaaactgttggcaagataattcctatttttctttctcattttctcttaatcagaaaaagaataaaccaaaggaaccacccaaagtacccaaatcagcaccatttttcattccaacaattcctggccttgtacccagatatgctgcacctgaacaaaataatgatccccagcaggtaaaaaacaaattagaagattctaagtatatcggtgtatgtttgtatgtgttttctgcacttctttaccaagacctagttttacagatatagggtaaattaatgatagcttttaattacaaactatacatttttg

SEQ ID NO: 116876 - DNA, 1052 bp, Homo sapiens
gatagtatggactcataatattaatgtctgagaaatattgtttcctggtcacaggtcttcatttttcacacatagtctttccttttaccttctgtcatcagcaatgtgaaatcacacatttggaggaaaagcaacaccctttaatctctatttaccagcaggtgtgcctcttttgtccagcagagacctggaagagagagctgggaacccaataccagcccctgctagggctgctgcttcagctctgacgtgaaaggcttcagtttaaggtaggaaagcaatgtgttttcttcacaaagctggtagactcttatcatataggcttctcagacatcttagattgcaggccacaggcccacacctgctctcttagctgtcagaatgactagctttagtatgaattcatttctttcaagtaggactttgcaaaactcagcaataagaaacacgcacattttaaatttttctattacttcccttgatgctgcagctacaataagcacaaaaatataaatatttaataaccacattaaaaaggtcatcaacttcgcagcttgtaatgggtgagacctgtctacttctctaccttgtattcctggagatttcacatttttattccttttacttgcaatatcccactttcaggtaccccattttgcatcagaggagagggtgcaggcaagcagtagaaaacccactacagtggcttaaccagatgaggttttttttagtctgtgtaggctgctgtaactaaatactctagactgggtgacttacacaacagaaatttatttcccaccgttctggaggctagggagtctaagattaaggcgctgctcttttcagttcctcagatctctttttcttcttctaagaccaccagtctgatcagattaggtcccacccctatgacccatttaaccttaaatacttccaaaaggacctatcttcagtcacatgaggggttaagactccacataaattttgtggggacaaaattcagtctataatggctttctttaggcagacagagagtccagagctagggtagt

SEQ ID NO: 116877 - DNA, 1101 bp, Homo sapiens
tatgaaatttatgtaaaactgtcagccccaaatccagggaagaaagagatttatgctaatttgtcaagtggtaactcattttgggattatgctatttgtaccttttccaattctactctcacccttctcccaatgaaataaaaggacacatagtcatagagcaagaacccataaaaagaggcagagtttgttttctttatcttccctaaacatacagaatatatgcttcttggagggtaaatacatttaatgttaatctctgtatctctcactcccataccttggcttttgccatagaatttaatatttaactactgacaacttaagagtctctaaataaatggaaaatgaattttcaataaaactgagagcagtcagagaaaagttgtagcaatgataaaaaacaatagttttctcagtgtaatttgatttgaagtatagagaagaagaaatgattttaacccaagttccctgaaagatatttgcactgaactcatgatattcacggaaaaaatacgaaagcaaaggatttgggcaagtttccaacagctcattggaaatgatcaggaatttactgtctttggaggatgggttgtaggtatatatgcagcaccctgaattcttttatccaggcaataacggtgaccccacatttattgctccaagtcattggtgtcctttgaaaaaatgccaaacttatatgtggtatctcctacatgttctggtttgaattaagaaaatgtgacttacaaaaagttcccctgtataaaactaattaaaagtattacaaaaggacccttcatattaacaaatgatttcctgtgactcatttaagagtgaattcctgtagggtgtgaaagtggatttttatagatcattaacaacctgacaggttctgggagcagaaaaatataaaacatatgtgttaggaaaaatgccagttgaagatcaatcaaaagtgacatcgagtgtttctgaacgctttagaagaatcaagcagaaagtaatttataaagcatttcttaagaacatatcgattaaatacacttgtacaataaattctttggtaagttctataaattcttttaatgtcataaataa

SEQ ID NO: 116878 - DNA, 1057 bp, Homo sapiens
aataaaaataagtgaaaatttctaatttccactttttaatttctttactctcaaaatcccagctcttccctttcacactaaattggaagtctattcaatctctgtctgcctgtctgtctgtcttctcaatacctgtcaaaaaatccatggaaaggctttagcataatgtctataatgttagctattattattattgttcttctgtgtaataagaattataataataattattattacacaataattataattattattatagctttttgtagaaatcctaagttggttttatattaattcctacttcctgaggacttgattgtgtgtttacactataaatagtgaattgtaataaggcagttgcatacttaagctgagtagacttgcttccatggcaggaagcagtgaaaaagaacagtcctgaattcctacagaaattggatgaaatatacttgagcttttaaagacattttattctctatattttattcctctagactttgtggatttgaaccattctatgatgaaagaggcgatcagttcatgttcaggagaattctgaattgtgaatattactttatctccccctggtgggatgaagtatctctaaatgccaaggacttggtaagtgtaaccaaaacaaaatgaaacaaaatgaaataaatttatttttaactaattaatgggaagtacaattttttaaaattttacccatattaatgccatattttctttcaattttaaagtattttaataaaattagttcattaatacattttccttagagaataaaaactagatatgtttttgactcatcactagttgaattatcataaactacaattactacagtattaatgagcttttactaccttataagtataaaaaccttgcttatgaagaaagctgtgctgggtgaattcaaacacaatttacacagaattctgttttaacatggcttgcaattgcctagaatttagatgtacttcatttcttttttgtttctttgtttttgagacaaggtctcactgtcacccaggctggagtgtaatggcat

SEQ ID NO: 116879 - DNA, 2038 bp, Homo sapiens
taattacataattcaccgttaaacatggacccactctaggtaaaattaccctcatggaaacattttcactgtgagaatgatgaatttaaaaattatgtttgaatcacctaaaatgtatgtgcagcttctagatggccccttagatctgctgggctctagctgtgtactttaaaaaaacaaaaacagctttattgatatataatttacatattatgtaatttacccacttttaagtatctaattcagtgatgttttaatacatatgtagaactatgcagccatcagcacaatctggatttagaacgtttccatcattccaaaagattccttttgtcttttttgcagactcatacctaacacaaatctaaagtttatcactgttgccaggataattacagcaggttatgtttggtttcatttttaagagtggaggtgttcatgattctaagctcaggaatcttgtgatcatgtattaaatatgttatctcatactataatgataaaaaagcttaatgatgtgggttgggatggatattaacataaataattgagtccgctgcttctatagcaatgctgtaggatagaacaataatgtaagtgatatatgtaattaaaaaattctagaagccacattaaaaaataaaaataaacagctgaagttaattttaatattttatttaactcaatacatccaaaatgttatcattttaacatgtaattgatgtaaagatttattctgatagtttgtactatttcttgtactaattttttgaaatctggtatgcattttacaaatttgggcaagccacattttaagtgctcattagccacatgaggccagtggatactgtattgaatagcacagtcctatagcatatttattaatttgtcttgtagtaagatgaaatagacaataatacggaataatatcttaaatggaaatctttgttagtctctagagccttcattgcttgataaataggacatctaaactttagatataaatcagttgtcaatgagataaaattattgccagcaaatattttccttcaaagataagtaacttttgatatggcagttggtgaaatgaaagaatataatctgccttcttgttaaatggttgactattctgtagcttgtaggtagtacgtattagaaacttgtgtatgtgggaaatatttggcataatactgttttcagtatatagtagctattttttaaggaaattagtttcatacaagaaaaagattattataaaagtgatacttttgcatgaaatattagtttgtgttgataactcttagttaacccttaaagtttaaaacagtactcaaaaaaaaataatgagaatctagtattctgtagttaactaatctataagataaattgctaaagtactagggagcttgtaaatcttaaaaatctttttatttcagtgttcattcaggttggatatatttgaaattgtagatttctatctgtacaacatctcctagttaatagaatttttttccttcccctcccttctctctcctcctccttttctaaccaaagggcattttatcaacaatcatgctgaattcaattaatatctcaagctaaaaaactatgtaattgaggttgtatctggagaagatgggaaaacattgtataatttaagcccttaattgtctgttgagcttttagggctgagtaattgcctttcatacaaataaaagctttaactcttttctcaagagtgtaccaccgtccttagaatcaggtgttttaaatccagtttcttttaattaaatgggactgtagtgatccctaccctgtagagaaatcaacagaactagagaagctaagggcttgatcaggtttcccctagaacctgtgttgcctgcctgctgtatcttccatgtctttcttattcaacttctagaagtagagaaggttgggacttgagtgtagaagaaacatcagaataatttcaaaaaacaggaagttggaactataatttttaaattattgtattgtttttacggattttacatgt

SEQ ID NO: 116880 - DNA, 1042 bp, Homo sapiens
tcatgtattctgaaaggattaaaagtttccccattacctatctgccaacctcttgtcagaattctccttggtaagtctctttttcactctgccatggtcactttgggatttaattttcatctatatggataataataaatatttaaataagaattctggtaatattttaaaatgagagttttatgtcagttattgctattaatagtgctattttaaaaattgccttataggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctcagcctcctgaatagctgggaatacaggtgcacgccactatgcatggctaatttttgtttaattttttgtagagatgtggtcacactgtgttgcccaggctggtcttgaactcctggcctcaagtcattccccaccttagcctcccaaagtgttgggattataagcgtgagccaccatgcctggccccaatttaaaatgtggaattcagttggtgtccaagacttatcttgagactcttaaaagcatcagtctgtaactagaacaaatacagtcttagatttacccaagtg

SEQ ID NO: 116881 - DNA, 1028 bp, Homo sapiens
ctcaattgccattttaatagtaaattgttaaaatgaggaatactgtgacaaattgagggaagccaggggaggcaagagattccctttaggcttgaagctttaagtaggcttctggatctgggatttttgagctcattgaaacaaagaggactggaggtaaatgtttgagagttaacagcatatctatatatgagatacaattgcttccccttcctcctgtcttctcttctactttctgtatgagtgattttaattgtaaaaaatatgtaattctcacctctggctatgggttattcatcttgggagcaattagaaaaaaactatgcccgggtcctactctcagagattatgattagttgatttggggtgagggtagctatcttttatagctctggtaggttattatattgtgaaaccagattcgagacccactggcctattgcctcaaactgtggtatttgctgatgctaatcttggtctccataacagagagaagtaatggaaggcctgtctgatgttgcttcttttgcaactaaacttaaaaacactctcatccagtaccatagcattgaagaagataagtggcgagttgctaagaaaacggtaaattagttcaattacttatatttggggtatatcttctatctaatgaattggttgatgacttttaaaattaaatggaacaatatggacaaagaccatactttggatggatatgcaagaaaaataattgagctaataaagttgatagtctaatgtcacacagaggaagaaatgcatcagtggtaatcctatactgctttcattagctctttggatattagacaagagaataggctcatggcaactagaacctaaagaatggcctcttaagtcagcaaataaaatgtatcattattaatttaagaaagtgtagtacttgagagtttggaatagtttcaggtatatcaaaaagcctatgaaggtagctagttagtattcctttttactaatgtgacttgcccaaactattacataggtgacttgag

SEQ ID NO: 116882 - DNA, 1043 bp, Homo sapiens
tccctctaaattttaaagagctgaagcgtgtaccttggagaaattctggcattttggttgtgctgcattcaggctggaatttaacttgggttttttctaaaatgcacaagttcggagggagaaatgaattcttttgggaaggggtggggttttgtgcttgttggtgtggttaattttgttcttcttgctcctaaagccttgttagaaactgttgtgtttctttgcattaaatgcactttggtgcatgcaagcttttcctccctttttataaaatgaatttgtgtccctccgcccttacacttgattactctttcaatgctgctgcttccgagggtcttcttaggcattcgatcttgcagcacttttttctgcattttcttataaagcagttgaactttggcggggagggccttaaaaataaatgactgtttttttcttggtgattataataatctgatgtgcatttatgtgtatctataataacattataggaaaactctaagagcgaatgataccctttttgagaacttttagtttctccattcatcttaatttttgtcataactgtgttaacaaaagagcggtcttctgataatataaaggttgagggtaaatcactgcagcagtatgtacattaatgtttatttggtttagggagaaggacagaatggtgtatattcctgactccccccaccccccccgccgtgtagggttttttttttttttttaaacacggaaggttatgtaatgcagtgccatttccaaaaatatccactctgaggcattacactacacggtggaaggctgattcctattctgtcgtcttgattgcaaatatactgccagtagtatgtctgggaacaaagagcagccagaaaacaatctatttttatcacttggttctacttttaagttgctaaaccttttgaactcatgcaatttaaagatgaaccaaacactaagaatagcccaggactctgcaaagccaagtaccagggattcctttgtcccttagttaagcctataggccacttggaaagctc

SEQ ID NO: 116883 - DNA, 1055 bp, Homo sapiens
tttttagtatagtttcctcatcaagtaggctaaaccttccccacatatctctcacatctaaatatttttcacatctaaatagtctttcagcataaatacaaatcacattaatagagctgaaaagttctttataatctttgattccctaacatcaagtataattaatgcaaagtaagaagcgcttaatgtttattgactgatttgaaagtgacaggctgaataagcaaaaaaatctctcaccttgtctaacatcaagccatgcagtatagattctctgtatagataatcattaatcctaatttaattatttccaggaatggatggaaactctcaatctccttcaatggaaagaaaaatattcaattagcttgtctaatcctaataccaagtatctacaatattcttagcacttggttagagactgaaaaaaaacagttaaaactgacatggctcttgctacctaggaacttatcagctaatatggacaacatatgggaacagttctaatggaaatacggatacatgtatataaataaatatatacaaataatatataataaataacataatatataaataatacatataatatatatatgaacgtgtactcgtggagcaaggaacattattgtcatctgcccaagcctcccaacctgtaaaagcattcttcagatgtatctgtgacagataagtaccctctgcatttgaatacttgcaggcacagagacctcacctcctcttaaggcaggccagagcactactgacagggtcacacatctaggaattttgtctatatattaaaacggtgattctgtcctttttgggcatgatgatactccacataaactataggtccctttccttataagagcttttcatgtctgaggacacagatctcacttgcttatgagtattctctttaagctaagcaaaattatttacataatactgaatctcttcacaattttctaaatatatattaatttattatacaataataatggaaatcatttattaagcaattgttctatgccatgtattgtgctaagttcttt

SEQ ID NO: 116884 - DNA, 2344 bp, Homo sapiens
caggcactcaggccagggcctggagcatagtaagtgctgactaaatatctttcgaatgaatgactctactcttcctcagctggactcatgaattctgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtgagttttcacgttcgtgcaagaccagtcgccatttaaaacgcatcgcatttcacttttcattattaagtcggattttaaatcgtgagaaaatttctctgaaatgtattgtccgtttttaggctgtaatcggcattactgtcagccagtcagcaaccttatgccataaagcctacctcacgcagtgtcagcctttgtgttgcccattcactttggaaactagtgaatgtggtgtcaaaaaaggcgtaaattaaacgctttgcagccttttcctgcccttaaatttgatacctttggtgtaggagctgcataagtaacagttgctgcttttacgtttccacgcgtgatcttgaccctgctagccttaagtgtatggtttctcttagccagttctaatttttgttcaggtggaagatggatgcctgaagtgtagactgctgctagctgaataccatctgggagcataaaggtgacctgaaggtagggtgatatgtcttaaagcactttgtaatgggaatttttatcaccttttaaattggggttccttctctagtgagttttaatgtcagtggtacattcgtagtgttgctctgtctgtagctattaaggtgagttaataaatgggatagcctccacagcttatttttgggaaggttttgctgatacttcctgagaagcccagggaaataaatacgcatagtactggcattctgcatctctttaagatttgtttttatgtgtagtaattgagttttttaaaagcttgtgaaatcgcaggcatattaccaagttcttgattaaaatgtaatacaaaaatatttgctgtcgaattgagtactttattttttctcttaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactttggcatttgtgttttaagtgattaactgccagaaacagctatttctaaaaagttataagggaggaggggttcttttttgatcagtattcactgctgtcaccataattaatagccttaaaatagcttgtgtttggcccaaagagaaatgtactttcttccagtgactcaaaaatcgtggctagaactagactgatttctagtgacaggtgtgctttactgcactcaatgcgtatttttcctccaactaaattgtacatttaatgttgccatatcttctgcctttgctttgcaggaaacgacaaataatgtatagaggtattcaaaaaatttattgaaagcactgtactaggagctgagaacacgatgatgagcacaacacagttcttccctttggaaacatagataagtggagggaatgtcatcacaaatgtaaaacttcactatgagatgagttccgtgatagg

SEQ ID NO: 116885 - DNA, 1004 bp, Homo sapiens
gggctgctggcagctgtggagagaactgtacgtggtaagggggagatataagatgtcctgcataagtattttccctgtagattgcaaagtcatctatggagaggaaaggtacaaaatagtcactggggagagcaggtgaattagatggccaagcagggtggatggatcatttgaggtttggggtgacagatcaactgagatccacttacacttctgaaaacgcaagaacactttagaaattaacaacacttaaagctttttacatcatttgtaaataactggtggaacttaacaccacaaaataaagtattataaagaactttatatgaataaaaatatatgcagtctgaaagtgatgcctcagtccttttgcatctgggcactagttgagaaccagcccagccctgggaagacgtcctcccacttgtactattgcacagcaggctagctgcagttcagaattccagaatgttcatcagatgcatctggtcttggttgtggtggacacagacacaagatagaaatgaatgattgctatcctgttccagaaatgaaaatgtggtatcaagtgaatttttacaaaatacttattcttccagttaaaacaaaaaggtccttcagcacaactgtgctgtagttaaaccatggcctataatcccagcactttgggaggctgaggcaggcggatcacttgaggtcaggagttcgagaccagcctccaacatggcaaagccctgtctctactaaaaatacaaaaagaattagccgggtgttgtggtgcacgcctgtaatcccagctgctcgggagcctgagacaggagaatcgcttaacccagtaagtggaggctgcggtgagctgacacggtgccgctgcactccagcctgggcgacagagtgataacatctcaaaaaaaaaaaaaaaaagaagcaaaagataatgtattttctcatgctgaagaaatacttgcaggtctgagatttgaattaagatacctatttcacag

SEQ ID NO: 116886 - DNA, 1039 bp, Homo sapiens
tgtttggaagagtgaggttgagagcctggtttgggaattgttaacaaaagtaatgacactgatttgggtgaattatgcctaatattcatgaataaaatcgttatgcatgtaaatgtcagactaactttgtatattaaagtttaaatacaaactttattttgcacagctatttagagggaacatttattgaatagcttttggtattatgaaacttttgaattaactcagtatcttaaatttaagagcagcttggtttctgatgtaattaaaatacttcatttggctgttttcttctgaatctttctacatttttcaaatatattttagagaagaaatgggtctaaagatagcctgatggaagaaaaacctcagacatctacaaacaacctggctggaaaacacacagcaaaaacaataaaaactatacaagcttcccgcctcaagacagagacttgatcctgatgaagggtcaagggtaggggtgggaaggttgtgtgcgccactggtacttttgaaactgtgaaataggtatcttaattcaaatctcagacctgcaagtatttcttcagcatgagaaaatacattatcttttgcttctttttttttttttttttgagatgttatcactctgtcgcccaggctggagtgcagcggcaccgtgtcagctcaccgcagcctccacttactgggttaagcgattctcctgtctcaggctcccgagcagctgggattacaggcgtgcaccacaacacccggctaattctttttgtatttttagtagagacagggctttgccatgttggaggctggtctcgaactcctgacctcaagtgatccgcctgcctcagcctcccaaagtgctgggattataggccatggtttaactacagcacagttgtgctgaaggacctttttgttttaactggaagaataagtattttgtaaaaattcacttgataccacattttcatttctggaacaggatagcaatcattcatttctatcttgtgtctgtgtccaccacaaccaagaccagatg

SEQ ID NO: 116887 - DNA, 1022 bp, Homo sapiens
tttgtggtattttattcttcatgatgtaaatctatacatcgagattaaaatagagcaggaaaggagcaaaaaactatttggatcccccatacctgagaataaatgagacttaaaaagtcagaattatcacagtaaacatatctttttcatttaaagatttctttattcactcatgcataaacaaaatagttactcctgcctcttaaggacaaagtgctacaatattcttgcttctagggctaggatttttttctttccaagtagcacctgtgttttttggagcggttcagcagtggaagaaatgacactttcattcttgtaatgaggcaccattaactagaggtcttttgtaaggatgtaatttcaaacttcattacaggccaaggccgccacactacccattactcaggaaaatgtgcttctgttgtgactctccaaaggctcttacatttttaatgcatcttgttagaatatttatgaaacagcatcgccagtagagggcatctgtctttgaaacatgtggatcacaaggatattaactgacagggtttcactgccctcactttagacttttcagttagaaaaaaaggtaaaggtacatgtataatcttgaattctttctgatttggtccttattactattatagcaggatacaggaaatacgcatgcttatgtctcaggagttttaattttttatcatcagagtgaagtctgagtatgagggtagccagctgaattccacaatagatgagaatgaacatacagtaactgtgcttccttttcagtgtctgttactctaggaaaagtatgtgtttgcccaagttaggcctcagctttgttagcaggtttgacctctcaaaaatatttagacgccccgacttcctgacacaaacatttcacattgtaaaatttcgttctgcccatcaactggacagtgattttgttcagaatgaaagctgcatcctaaaagactccagggttaggagttaggagacctgagttttgtgtccaatcctgggcc

SEQ ID NO: 116888 - DNA, 2092 bp, Homo sapiens
tagttagaattttgaatctcgtccctgagatcagaagggccagcagctcgcttattgctgtaggtttgagaccatgggccatgtgctggacttgcccagggtgtaggatgaaggaggacctcgcaagtagacttaggagagtgaaacctttgatgaactagctttacctggatatgtcttaagcttaataaaatatccttgacattcaaggaaaaggttctacaaaatatcctttgtgctattgatgaaaatcagcagtcctttgagcattcactgaggagaatctttgaattactcattcattcattacctttgatgtgtttctaggctcttagaagtttggaagtgggagatgtggaggagtgggtgacatgagatagtctggtgcgtttttttccatcagcataaaagtagaaataacttgggagcctaccaagtattaaaacagagaaacgagagcagcttagggtaatagtagaactagaggaaattgacaacaggggactatttgaacgtttccctaattttattctaggatgtttgcatcataaacatgagtcatgtacgtcagtgtcaggctgcatgtttgtgtacatatatatgtacatgcaaatctgggagcctgtactatgaaattgaacccactttgaagaattctgtggctttgagctggttactttatcctgtgaatcttcatttctcacatgcaaagtggaataatacctgacctgcctacctcactagaggtttgtgaagttcccgagataatagatgtgctttgaaaagtagaaagtgccctgcacaggcaagttctgttaaattgataacatccagcactgctcagtattttctgaagttcctgcaggatctgtaaaatggggaccagctcccttgaacaagaaataagtcagtgttttctaacatgagtttgttctggcatgaatgttgctagtttctccctaacaacattggggtcttttagatgtcttttagggtctaccagatgtctacagtatctaaatagtagattaagacagatttaaatattttaattatgttccataaggtcttttatattgtttttctaaaatgaggaagcacatttctgtgtgagaaatttggcactgtaagagggacaatatatctgactagggcaaatctagaagatcacaattttggtaggattttgttttgggagtggtaaagaagaactttattgtccctgtaccctagggaaaaaatatatttgggatgttagcaaacttaaactgatgggcatttcttccgtcttgcttgaaaataggtaaccgcttccttgccaggaactgcctactgtcctgcccctgatttaggggctgcaaacgaggtaaaaattttgggtacggagagaagagttcgtacaaagctagtggaaacagtgttcaccgtactgcagatgcaagggtttctgatttctactttaataggatatatcaagatttagacatttgatatggttgatttagggcttccagagtataatcaaggttggcagagatgactgtggaaggacaaagccgcagcaactgaggaatgctgttacattactgagtgagggcaaaataggttaaaaattcatgaaaacaggagagtttgaaagggaaattgcgccagaggtagcccattgtagtagtgggcacgtaaggaataagtggaagagacagaagtacctttaagagcaaataagaataatttattgatggtagagacaatgggaaaagcaaatgaactttttgcttgctggtcttaagggagtatgtcgacacatgcctggaaccaacatacatttccctagggaagaaaaactagaaaaaaaaaagattgctttatagcaggtgatccaaaaaaaatgagtacagttgatgagaaacacaagttcacaatcagttggggcctgcagatttaattttggcaatggaggggccatgtgaagcaattgtctggaatgttatgctatagttgaagagtgtaagtttctttcagtgtgtctgtctggtttggaaataaaatacaaatagagaaacatcaagttttaaagctagaaaggatcttt

SEQ ID NO: 116889 - DNA, 1064 bp, Homo sapiens
ctaaaaatacaaaattagctgggcgtggtggcacatgcctgtaatcccagctactcaggaggcagaggcaggagaatcgcttgaacccgggaggtgaaggttgcagtgagccgagactgtgccattgcactccagcctggcagcaagagagaaacttcatctcatatagaaaaaaaaagaaagaaagaaagaaagaaaagtgaggaagttggattggataatctccaaggtctttctttaatgcttagaacccttgcgcttggcacaaattgaatcagtgatcctctaactacaaagcctgtgtaataatagcccagacagcattgtaagagtggacatttttttaggaaagcattctatgtggagccttctgaggctggaattacactagacagatgggagatctcaatgtgttacgacacctttctcaaagaaatgatttcagtttcttctttgaaaacccatatgtgggaggtagctccttcttaagtatcctctttctgataaaaaattcagtatttctgcgcaaacaacacaaaacaaagcaaaaatacccacttattttcttatttaacactttttattgatcaagccagtattttaagtctgtttctgttttacctaatatattctaaattgtgcccataagtgttctgttctcaactgttcagaaggtggccctgaaaataaataaaataaaacatttttgggggagccaaaattgctcacagtaccattcgctactgaaaatgaaacactagtgaaaggttgccatcaaataattaaattgctcatactgatctggttgcactggctttaatatttcttgtaggtattttctcccttaagagtttcttccccctttttcctggacagattagattggctttctttgtactgtgtaaaaagtatattttagaataacggtgattctgaatgtttaatgcactttgtaaggctagtaatgagaaatagctttcaaaacacattccgacacgtttcatgcaaaaaatccaacaggccttcacaatcatttatgctacgtatagaaatattgctctagg

SEQ ID NO: 116890 - DNA, 1310 bp, Homo sapiens
cctcattctattggtaaaatcagtcacaagaccagtgtaaattcagaggatagggaaataaactctacgtctctcagtggggcggatgggagggttacaagattttgtgtccatatttagtccaccaccgacttacggctttgccatgtcagagttctgttggaagtgattgattttgcggtccgttctgggaacatactgacattcaccttaatcggtttttatatttcccctgcattgccatttccctgagctatagactcagtcagatgtcttactgagttcagaaacactgacttggagagggataatacagctcttgatgtttggattgataattttactgcaaaatgaattccagaggacccatataaacctttctgaaattgttcgtgagttataaatgtgtgttttttcttttgttcttacctttttgtcttcaggtcacgttcacgctgtaacaccagcagtggtagtgaatcagaaaattctaatagagaataccggaaaaagagaaacaggtaatatctcaatattataattaactggcactctgaaatcagaggctgcccttggtggtagaaactgagtgtcctttgtaagtctgttttttccatctgagtctgagaagcaatctggcactattttgaagcacttagtttaggaaactttagctctttgagtggagttttcttatcttcacaataagatgattaaacaacttgacaatgaggtcccttcttgtgtgtgtgtgtgtgtgttttaaaagatgattctgtatatagctacaatgtgtagtgaatttctctaaggctggtaagaaagtttaccattcgtagatagatttctccctgaactatcttttcaatggcattactatattttacccaaccaaaaataactcattgtttcttagattctgcggtttcaggcttatgtatatatatatatgctaataatatgtgcatttactcatctgtgtgtgcctgacattccatatatgtaagatagatttttaagatatttttaatcacatcatttgacatgtagtcagtattagtggtggcttaatgcattaatcagttatccctagttccaaaatatgcactcgaaaacaagaagtatttgtgtcattaatgaaaagagcaccttgggagtcagagggatttggttgccagtcatgccagttgttaacccagtggttctcaactgggggagttttgtcctccctgccttctccccaaggacatttggcaatgtccagagtcattttttatcgtgacaattggatagggggattgcaactgtcc

SEQ ID NO: 116891 - DNA, 1064 bp, Homo sapiens
cagccagctgtttaggactgatccagaaaacttgcatagttggattcacccatgcctgggattttgccaaaaagatggaatgaaaaacagagttgaggaacatgttgagtatcagcatgcatgttattgaaatgatggattaggaaatctaagctgagtacagaagacagtgaagagaagtgaagagctggtggagagtagccaggtcaatagatagtcttattggggtcaaagaaaaggaagaatggaaatagttgaataagcaataacagcttatcttggttgagtgctaacaatggcccaggtcctagtgtatgcattttaaatgtattaattcgttttatcctttagaggagactttaaaggagattctattaaaaatgagtcactgagtagaaaagtaacttatttaaatcacataactcatcagtggagaagatgggattcacattcatgttgtctggctctagagccagcacctttaaccaggatgccccattgaagctgtttgaaagtaaatggcgagtggtaaacaggaggaagaggagattgtggtaagagagcaaagtgtttggaggtggttacagatgataaagtcgtaagtatgaggtaggttgctgagttgaagtggaggagattatgagagaagagataaagagaatttggagcctcagggtatgggaaagggcatccaagtgagatgatgtcagttccactatggcagaaatcagcttggaggattgcagttctgaaactgcagactaacctcatcattggattaatggaattcggacggtttgcaggttccactagagtgaggccaggtgatgttattaacattatatttctgggacgtgttgtatgtagggttaggcatatacatatgacgtaaatgtttggcaaatgaatgaatgtatgacaaatatgtgttaactgaagtgaaactcattttggtgtgctttccttagccaattgataatctcctgttttcttaaatgtcttcatttgttttcacaggaaagcccataacagtggtgaagattcagatcttaagcaaaggagga

SEQ ID NO: 116892 - DNA, 1056 bp, Homo sapiens
gattattttcagtttaggagtctatgcccagataaccataattgtttgtatagaataaagacattttcagaaattttgggttccaaaaaagtgtatctgtcatgcaaatttttctgttagcaactaaaagatacactttaccaaaacccagacaagtagccaaaagacctggagatgtagggtccatcatatcaagaagcaaaaggagttccttggatcatggtaaaggggagttagtcaaaggtccaggtatgagcaggagggcagagggctccaggagggataaatggaacttgcagattacctgagtatccatccatagcaggagttttgctgttctctcagagtttgaagaattagtgataagcaaaagaaccctaagcaagtgatatgtacatggaaaacttaggcaagtatcttctcttagaaaatttaaaacctacaaaagaatggaatcatattcctggaacactatttagatcgtctgtgaccaatttcggtataattgtgtttatgctaaatagtgaccccaaaatttgatgtaagaacagagaccacatattgctgttcatgttatttgatataagtgtgttggaggaaatggagtaacgtaagccatacgttaaagagatcagaatgggaaggtgctagattacagattgtaaggaaatggagcatggggcatagacaccactctccaaaagtttggctttgaaggagagaggagagactgggcagatgaggggggatgtggactcaaagtaggtctatgtttgtttaaacagtagagtcttgaaaaagttaatagcttgtaaaaagagtctgctagacgggcaaggtgactgtgtgagaggtgggagggtagttaatgaaagtcattgaaaagacacagggtgatgggaccacaaagcactggtggagggactaaccttggtagtaaggataaatccataaataacagagaggaagatgttggtaagtttttatttttggtagcaggaagatgaaagagttacatctggaggctgctttttccttcggaaggagaaaacaaaa

SEQ ID NO: 116893 - DNA, 1049 bp, Homo sapiens
aattcagtttcagatttttaggaatgtttgcatgaagaacacatttgaaaatgtcttttttttatatgtgagtgatacagatcacatgtatattactctttttttgacagctgcattatgagttgggatattttcaggtttgaagttttttgtttggtttgatttcaaatggggactgtcatgatatgctgagaaacttcttcacaagtagtcatcaaaacctgatcattatgttttatattctaatatatggtactaaatatctcagaatatcattttaatagtctaaagtgaatgttattttaacatctaaagatgtggagacttagttttaaagtctgaaaaaaatagcctagactcccaggacattgttatgttgagggtttagtacacgttagaaaatagtacctccaatttattgggtgattcattatttatttggggttataatttatcaataaaatgtgccacagtgtccctaaaattgcattttaaaataagtcttctgtttctttcatttccttatcactgtttcctctctcttccatctttccttctcctcctctgctagaatcaaacagcatcagtaggataactgcaaacatggaaaatggagaaaatgaaggaacaattaaaattattgcaccttcaccagtaaaaaggtcagtgaagttaactgaagaaacgtacaattatatgctgttgtaaaaatgctttttttctgtagacaaggttaaaaatcttttaactttgatgattaatgaatacttttgatccatgggatccaataaatctctgggccaaataatacattaaaacaccaatgaaatataaaacatcaggacctgactctcttatttgaagaaagtgctctttttgtcacaaggtgaactcacagattgtctgtggtctgcattctccgcagaaaattaaaaatttcttgtgattttgaaaatggcatgatataatggactaactcagagggacttgtaaaataaagtagatgatattcatgtttaatgtactgtgttcattatagtggtgcactg

SEQ ID NO: 116894 - DNA, 1094 bp, Homo sapiens
cttataatctaccctccagcttttcagtagaatgccttctttgatcttgcagtagcaaaattggtgtctaaaaagtctatgtatatctagtaaaaaggcaactgcttaaatatcactcttggaactttagaaggcagaaacattttttgtgttttaagaaatggagtctcactctgtcaccaggctggagtgcagtggtgtgatcatggcttattgtaacctcaaactctcaagttcaaacaatcctcctgcctcagtctcaataactgggatgacaagcatgggccaccatgcctggctaattaaaaaaactttttttgtagagataggtctcactatgttgcccaggctgatctcaaactcctagcctcaagcgaccctcctgcattgtcttcccaaagtgctgggattacaggagtgagctactgtattcagcccaggaattcttaagcaggaatctggctgccttttggggatgagccaggtgtttgaacttaaacaattagccattggatgcagaaacatctttattttccaaattatgttttaatatttatttttgctttatagaatttaatgagcatctgttttgccaaatataaaattttccagctggatgcggtggctcacgcctgtaattctagcattttgggaggctgaggcaggtggatcacctgaggtcaggagttcaagaccagcctgggcaacatggtgaaaccccatctctactaaaatacaaaaattagctgggcatgatggtgggtgcctgtaatcccagctactcgggaggctgagatggtagaatcgcttgaacctgggagactgtggttgcagtgagtgggtggctgagcgagactctgtctcaaaaaaaaaaaaattccatgatgataggaaaattatataaggttttcttgaatatttagctatttggccgtaatttgtggtatagaaaaagaatgttttattttgctaatttgctatactgccattttttccatagtacctagtctaaagttggtgaaattaaggcaaagtcactttgagctgtcaatgtgagaaatagagctaaaatatattttcaattattggtcagt

SEQ ID NO: 116895 - DNA, 5978 bp, Homo sapiens
ctagacactctgcagatagtagcttactcttttagaagatgctgtaattctcaatgtttaggtgagaaagcagaggctgagacttgtacagagtcacaaagctgagatatgaacacaggtcagttacagtctacaatatagagacgaaagactaagaaagaatgtgttacatttgtatgtacagatacgaaatgatctccaggatatggtatataaatggtgggggcagagaagcagaggggcccggtagtatttaatgtgttaccattatatacaaagacaaattgggtgggaaagtatgcatgcagataatacttgcaggcaggatacattagaaactagtaacagtagtggcctttgggaagcgtttctgagagaatggggattggcagtgggagagagatttattttcatttgaatttttaccaagcacttttcaaaagccctacagattactgtcatgaatgcatgaagttcacaaatgctcatccacatttccaatagagacattctcaataagctcagagctgagacattgttcttaccctagatcattgtgatttacagagaaagagcaatataagatcaattgtacaaaactcaaatgttaggaatttctcctgtgttatagcagacacaaccagagtcttcaaggagaggggcataagtccaggattaaagtacataagatggcatataagtcctcaagccagagggtgctccatttcatgaggaagactcatggtatagagtctttggattaaatgaagtagaggacgctttgtgtttttcacccaaagaagtgatgatttgcaggtgtagcaagttctagaatgtggaggatgtctggatgagaatcacttagcaaggaggaatgtttgggaaaagagagggtaaagaaactgggaaaagacagtaacataataatagctctcacatctatccggcctttgacgggtattgtgaagtttttgtttatttcttctgggtcagaaaaaggaagaagttagtataaattttcatacaaaagggttagaacaagacattctgacctagaattgttatatgggtggctatggagatgatttctgaaaatatggtggaggagctttgttttggcaaaagtgtgattgtggctcttcttttccaagtgcacagatcagaattagaccattgactgagttatggtccaagtctgtggtccctccctctctcctttgtaagaacctctgctctgagggatgtttaaattacctcttgactgattatttaagccatttaattgagaagcgacttagtggggtggtaggggagcttaaaaaaaagagtgtgaaagttgtacctgatttgagtagccctgaattcctggtctgccttggttgtgacctgtaacttgtcattcagcattctcagctttcatccctttatccataaaatacaataattgggtatgtaagctttaaagattcctcttctttctaaaattcctttattctgtctgacttacctgcccacagagttggaaggaccaaatatgaaaaatagatacagtggaattttagaaagttttttttttaagtatatgggtttttaccatttcaaaagtcttgcaaagttgtgaaaaagatcttcccagattataaaatgtagttttgccattggaaatacacagtactttttgtgtttggaaaaaccttctagccaattctttaaaacatctcaggctggatgcggtggcttacacctgtaatcccagcactttgggaggctgaggtgggtggatcacaaggtcaggagtgtaagaccagcctggccaacgtggtgaaaccctgtctctactaaaaatacaaaaattagccggacgcagtggcaggcgcctgtaatcccagctactcaggaggctgaggcagaagaatcgcttgaacctgcggggcggaggctgcaatgagccgagatcgcgccactgcactccagtatgggtgacagagtaagactccgtctcaaaagaaaaaagcctaaagttcaaatgaaactcttattgacaaattgaataaagttaactttaaccatggctctattacagtttaaaaattattcttttagtccaaactgacgagatgaatatgagattttgcctgtttggttaactcatagttaaaaagtgctgtctttctgggtaaaaataaaaagaagacattccttcttagaaagtttttgcatagctttgtctctgcctttgagttgtgtgtgaacacaaccttagactagtcgtttcttgaacctgctccttcttttggaagtcagcagtgggaattggctctacctcggcagttgtttgttgttgcaattcttgattttactaatgcattgggcaaatttacctgtttttttacccctcctgttcttgacaggtgggggctggagggtgtgtctgtcagcggtttgggattctgttttggggatagatattcctgagtagatggcatctgaggattccacacctttgctttactatcagaattcattgttctgaggtgatggtttctatgccagtattttcttcagactttgaaaactctgggattgatttttttattggctctgtttggccataagttactcattacttattaatatcaatgttaaagattttgggggttctcagagttcagggttattttggtaggttatagggagagataggtgaggtaaagaagaaagaaactactttcggtcgggcacggtggctcaatcctgtaattccagcactttgggaggccaaggcgggcagatcaccagaggtcaggagttcaagaccagcctggccaacatgacgaaaccctgtctctactaaaaatacaaaagctagctggacatggttggtgtgtacctgtagtcctagctacttggaaggctgaggcacaagaatcgcttgaacccgggaggcagaggttgcaagcagggattgtgccactgcactccagcctgggcgacagagccagactccatcttaaaaaaaaaaaaaaaaactagtttcacttgtggagcaggtgccctgcttggcccttgggtcactggcactgtgctggtctttggagcaggagtccagaaggggtggaggaagagccctctgtaacagtggacttgctcctctcttctctcctggggtaagaatggggcctctgaggaaaccgcccagattccttctccagaaaagatgatgtgcagtccagcagatgagtcagttatctggggacaaccaagccttttggggctgctttacggtccaggtaccaggtacagctttgaacagagaagctggtttgcagagaaagaagaatggagttggctcactgtgagaatcacacagctttgagaagagaggggaagggaggcttagtagctatgaactgaagtctgtgagatcctgttgtgcattcaccatgaattcctttctaatttgagctgatttccttgcatgaaaacagtggataacattactgggtataaccctttcagtatccccatgagaaagatgggtggtagtctcatcttactgatgaggaaactgaggcatggaaacattaagtacttgtttgagattacacaggcagtaagcgcaaagccaggatcctaacccaggtctttgggatactatggtacatgcttggaaagtaaatggaagttaagaaaggtgaaaggtctagaatgatttgaaaatatacaacttctgttttttccccatgtgtgatttcttcagtagctctaacttgttttcaacaaatactcttgagaagaccatacattctgctcatttatagtcagagtcagcctacttttactttaagccatttttagaagaaaatgtgtaagttctttggggcatcttacctagccaagagagagggggaaaggcagtaactgttaattgcaaggagcattaggtagaccatatagtcaggtgtatgtttgttgcaggctgttagcctttgttggcatccttttctattctgccttgaaacttaggcttattttccatctgtaaaagatttattaatgtatggcgagtctggttagattttctctaaaaagttaatgttttcagtcttcttgggagtgtttagcattccaaacatagctacgaaaattagaaaagcaagcaaaatgaaagggctattatatattcaagttaaaatcacagctttagtgagttaccataaatgacaccttttttctttttcttcttattcaacaagaatttattgggcacctctttggcataagaccctattttatagagcacagaaaatggaataaagcttggcccctaatctgtaggaactaagtcatatacaaataacacagccgtcagttatttagcacttactaaattccaaacacagtgctaaaggctttatataaattgtctaatttaatccagctgtgcactatataagtagttagtggtgttcccattttacacaggagaaaactgtggcccaaagtagtttaataacttgtccaagatcacaggatcaatttacaatgggtaaactggcagagctgagaaataaatctaagtttgttggactttcaaccttgtacacttaaccagctgctttgcaagactagagaagcaatgctggaatgcaggcaggacatatcaagtggcatagagtggagcactgacagagttctaagtgtccggaaggataatttgcttatggctagaggcagtccatgatgctattgcaaaagaagggggttttaatggacaggtgaattaaggcagtagatttcaggctcgtgtatgcaactgctagggtggattgtataggggagaaaaagtagtagcttcctcacttatcactaggttcatggctgaggtccccataacaaaagattaacaagagaaaagtgtacaactttgtttaatataagttttatatacatgagagcctttagaaatgaagacccaaagaaatgagatatgtgtatattcatggacagtcatgcagaagtatgactagaggacaaaagggtatattctaatggtaataacctggaggggggcttagcaaaggttggttgtttggattcttcttggtttccctgtatgatatcccctccctctgggtaaagcaggatatctatcacatgagggattccaggggaaaaaggaggaagaaggtcagagagttaccttctaggttttagacctgtttcaggagaaaatgacagagggttgggagatgagaggggctttcttgcttctgctgttttctcaaatgccaaggtgttatagtttggggtagcgtgtcctgatctgagtcaggtggggagggcaacacacagaggctttctaagatgtacttgggcacaggtagttttcattgaatcaatttctagattctcttttctaaaaggcatattcctgtggtagtatacatactggttcttctgtccagcctgcccttttgcaatggaccttcttccattttgcaaaagaaaagagccctttcctacatctggaatctgttagactgctttgtccataagctttgaacctcttggggttggtattgggaaggtaaatgactctaattatcaagtgacatatccttttctaagtcattttctcatttttacttgcaacaaaattgaaggaggacccagcggatttgtcacttgatagaacattcagaataattttggataatatatcactgttagatatctaactccttagaagttctttgactcagtggtgatgtctttataacagaatacattacatatacctctacttattttgaacatgggttcacagcatcgaaaatcaaaataaaagtaggaatagacttgttgctaaactgtttcattctagcaaaaaataacatttgtaaatagatttgatacatgtaatcattagggaaataaaaccacctctgtttacctcattaaaaattgctttctgg

SEQ ID NO: 116896 - DNA, 1246 bp, Homo sapiens
aagtacagtttcatttgatgaagtatagctctgggctgctaagaaatagcaatgtcaaaacaatagttatttattgaacacttcctctgattggcacattgtgtcagatgcaagtcagcagaacctcagtgtggcttgtggcagtcaaatctgtgttttgaaggcagaggaaaggtgagttatctgaatagagacggatgtatcagtgcgatccagtaagctggatcctggtactttgctggttcagcttcagtaatccatgtactagacatgtaatattataaagtcacttagccagcttgagccttgatttcttcatctgtcagatgagttgctgtcatggggatgtgtctgaaatgggctgagtatcttgtcagaacttgtagaggcttggtacactttagtttccttctcctaaaccaaaaggatgtctttctattcacagtgtggaccactgtgaatccatctgtcaatgtctgaggtatattcgctgtaatggcatgaacttcatatacaaaggatgatgttattatgttgaggtgctgtgggcttttgagagtgaggggtaaggagaggccattcaagtacagtgagaggggcttggaaaggaaattggacactctcacttaaatctagaacattcagtataaatcgagtgtgaagaactgggccagtcagagcatactatgtgaaggtttcttctgtcctgcctgcctacagattttagcaccccagggcagctgttgggagcagtatcaggatcacagagttaggaagtgtctttcttactatgtttctactcttcagagtagcatttagtccaagccttttttttttttttcattgtggtaaaaccataacattaaatttaccatcttaagcattttaagagtaagttcaatagtattaaatatattcacattgttgtacaaccaatctctagagtgttttcatcttatgactctgaaactataccccgtaaacaccaattaccccttcctgctctccccagctcttggtgatcgtctttctactttgtttctatgattttgactactttagtacttcatataaatggaatcatctagtatttgttcaagccatttttcttctctgatttttttttttacaccaacatctctaccctcctctcctccccacctcagatcttcactgctctccagccctcttgggattttctatgactatgaattggaaagaacaaacttcttacagtgtgttcatt

SEQ ID NO: 116897 - DNA, 1050 bp, Homo sapiens
caaaaaaaacacaaaacatttgtatataattttttaaaaagtcgtgatgggggttattactttttgttagtttgtatcattaatttatactaaatgagtttttactttagaagacctttctttttaattccgaagttaaagtaattcaatcaaactagatgactagtccccttaacttgcatcccagttgtctgtaagtttaaaaagcatgtttattcacctctcaatcaggagtaataaatgccctggcagctaaaaagccattgtgtttagaatttgccaagtgcaggccctggcacctttatgaggaagtacattccagaatcaagtgccctgcacccagctgcctgcttccccacccagaggaggtcagcatcagggcaggcagccagagcattcctgcaagtctaaactgcctcagaggagcttgggtaaagccagaaaagggacggcaggaggaaaaagtgccctcctgttacaaccctctctctgacaagttcttggcaactcacacagttggattcctgtcaaaggagatcgtctctgctgtaagtaggcaatgaagacagaatatttggatataattcataattagctataagaaaagtaatgggtgaagccatttgggatggatacacaaggctttgattatctgatgcagcattttaagttcttaaaaatatctcactgaacacacaaatacttgcagcataatctttgaactattgcaaagcaagataagatgacatttttggcattcccattctgcctctgtggaaggggctgcaaacagagtgcataaggggttgtgaaaatgatttctgagaggatggtttgtgcacagtgtgcaagaggacagctacttaccgcttggaccaagccagttgtttctgtgcagcggagtggacctagtgttgatgtatcttccagtgtttcaagagaagtacaaaatctggatgttcatgtgaacttcctagaatttgaaatactagcaattaattttattataagaagactttgtgtgctaagttaaacatttctgatcaacag

SEQ ID NO: 116898 - DNA, 3743 bp, Homo sapiens
gtttatcctgtaaatgtaagatgaataggatttggggccattaaaagacttttttcctcccatagatggctgtacttgtggtgaatcaaactagacttgtagaaatgcgtttttcctgtacctaaatgatatttacctgcatgaaagccagggtcattcagttgctcaaattcagcagttgtggaataaattgttagtaaggtgaatgttcactgaaatccagcaaactaaatcacatgattccttgggaaaattacttgagaagtttggcccagccccagggaaacctgccctggaatctgcatggaatgtatagagcagcagtgctttgcatggggttctaggcctgccttcagtcttcctggacacttgatctggcccaggcagggtgggcatagtaaatggctaattgtgccatgacagagtccagaataaaatcataccgagtggtcttgtgggggatggtttacaacctgctgtgtgagtacaacatggagctcatgtggaatcattgccttcccacagtttagcccaacttaatttctttattatttagtgaccttaaagactgtcagcaacctttatttctagcccatcattctactgaaatctaattcctcctttaataaattctttcttcctgtttcctcctctgaaagattttccttctatctaatgtaaatctcctcctagaatttaataaccactcccttgatcaatattgcaatgagaatcaattaaaaaccagggagtctgtgtgttttttcttctctccatatttggcagatgttctgaatgacctgttgtttaattttgtggctgtgtggttttacctttgctaatcaaaatgttgcactctcaagtggcaggacagctttgcaaatgagccgagatctttctattcagcttccccggcctgatcagaatgtgacaagaagtcgaagcaagacttaccctaagcgaatagcacaaacacagccagctggtaagtcatggttcccctgagttatctatgtaaccttgttttcctttaggctggtagtgtaagatatactcaggtgatgtctataactctacagtctttctattgaaatttccaatattaaaattttctaatattagaaattttaatttgatcttggaaatgttcaagcagacagtaattttaagaagacatatagtcatcttgaatcaccatggcctgcttaatgactgtactttctttttttttcttttttgagttaggatcttgctgtgtcaccaggctggattgcagtggcatgattatagctcactgctgccttgacctcctgggcccaagtgatgttctgacctcaggtagctgagactataggcacatactaccatgcctggttattttatttttattttattttattttatttatattttattttattttattttattttaattttatttattttatattattttattttattgagatagggtctcactatgttgcccaggctggtctcaaactcttgggctcaagtgatcatctctcttcagcctcccaaagtgctaggattacaggcatgaaccaccatgcctggccccatacgttctttttgaaggggttttattttacataaaatcttggctgggcacaatggctcatacctgtaatgtcagtgctttgggaggctgaagcaggaggatggctggagcccaggaattcagggttacagtgagctatgatcatgccactacactccagcctgggtgatagactgagaccctgtttcttaaaacaaacaacaaaaaccacacaagacaaaatgctaaactgagtaatttcttaatttgatgtatttgagttgaaattgaaaaaactcttagcaagagtcttgaaaaaaacaaacaaacaacaaaaaacagcacttctgggcatgatggtaaggctgtcgtcctagctactcaagaggctagggcagaagtatcgcttgagcctgggagtttgagtatagcctgagcaacaaagtgaggcccctatctattaaaaatacaaattaaaaaaaaggagcactattgaggtaacttaatttgagcttcatttgtacagaatccagttggttctttgttattattggtcttttattgtgtaacataatacacatatagaaagtatataaataaaatatccatacttatggacatatacatacatgtatacatatgtgtgtagacacatacaaagtttaatctagcctgcatcccaaaagtgccacatgggcatttctctgataagtgttctcaccatttcctcccctcagttagaggaaacttctgtttgactttgtggtaatttcattcctttcttttcattataatttgtcagtttcctgaacaaattagtttattttgcctgtttttaacattagatgaatggatcatagtatgtctttttttgtgtcttgattcttcctgccaacattatatacagtgtgtactaaagcacattcctttttcttgctgtgagtattcttgtgtttgacaatttattcattctactgttgatggatatttgggttattcagatttttttttaatgaagacactgtgtctttaataaaaccacctaatcaagcagctttaatccatgttcagtgctcattgctcacagaattttactgtgaagtaatattgctgacgttagtttgtggcttgcttatagatcacccttgtctaacactctccagtgtcctttcacagatattatcttgtttgagcctcaccctgtgaggtggggcaagggaaagagtacataccattttacagatgaggaagatgtgcttctagcagttattcagaggtgtggctgggacaggagcccaggtctcctgggtctagcacattataggaagtaaatgaaatttttagtaacaatattaacattggaacattgtgtgaaaattgacctagcattatgacatctatcatttcatttaatccttttgtcaagcctgtgaagaaaagtgtatgagtttattttaccattcctgtgtgtgagaatgtcacctgacttactgcttctaaagtcaaattaagtctcactctagttcccctcctcttgttgggctggaaggaaataaagttctttctggtggttctacactgacaagaataaaacatgactaaatttgcaatagattaccttgccacatcactattattttgcctcccttcaggtaatgaggaaactaagacgtgaaaggcagtttggctaaaactactgtggagtaggtttactgggcattggttactgacttgtttgagtccattgagagagaacacgctcatatgcaacaagttacatgaagcttatgtattacttacacatgggcatcagaggacaaaggatgtctaggatttgttgtaagctggtccccctaatgcacagcccagcctttttggaggacagcctcccagcatcaggtggatctctctctctctctctctctcttttttttttttttttgagacaaggtttcaccttgtcacccagtctggaatgcagtgttgtggccatagctcacagtagctttgaacttatggctcaagcaatcctcccacctcagccttctgtgtagctgggattacaggcatacgccaccacgcccggctaatgtttttttaatcttttattttttgtagagatggggtcttgctgtgtttaggctggtctcagactcccagcctcaagcaatccttacatc

SEQ ID NO: 116899 - DNA, 2555 bp, Homo sapiens
gagcaggtaatagtcagtacttggactgttcttccagttgtggcataaaacatcaccaggattatagagagaatgtctccttgtccctgaaaaggagctggtagaaagacatctgtcttaatgttcatactattaaaattgtaattatcctctttaacatacgctgttgttggcttccacaaatttagccatactttatttctcaaatttattgaaatgcaaatgttgtggctactgggaattattattaggaagttattggattttgcatattaagtatcatttcttccaaggaagtgattaaaagtaacctttgcaaaattggaggccatgctaaatctgttccaattttgtggctgatgttaactgcctagtaagtcttaatgaatcttaaatctacatgtctatatgtaggagacactaacattacaccatccttggaagaaagacgatgcccagaggttaggcagggatgggtctctgattgctgggggttcattagcacacagactgtttattgtcaaaagagggcaagcaaccagactttaaccagcacaatatgcctgcccctttcttgagacattccggagacatcctggaatgaaagcagagctctggaaacacattctcttcctttcaccctgcaggcttttaaagaatagggtataaagaacagcttaacaggtggctgcagtgtatgaatgcaggtatctgggtgtgtttgtgtgtgtaattgtgtatgtgtttatagtgatgtgttagtgtctttgtggttgtgcaccatacatatatgtgatggaggaagacaagagttctagtctttactctgtcttgcattttaaggcttgcaaaatgccaaggacggtagcactttttgggaaaactagtgcttacttaagggaaaaatcggactttttttagtgatatgggaaaatgaagattaaaaattaaatttgtgaggaaaggctgagctgaaatctgatgttccagtactttttgttgttgttgttactgttgttttattaccagggaccaataatctgaaatagaaatctttgattaaacattttgttatacattgctatcttctctgagccccttacaaattaaccttgcctttacctgtcattaagttgtggggtgctcctagttttgattaatgagttgtgtagaatttacacttgagaattgagaaagaaggcttagaaactcccctgggaacccagatcctcactgtaggactcaactcacaggagctgtcatgagatttcacattctatgaagcatggaagagagaccaagttctcctaagaacctcctttgtgtcagttgctttcacatgtgcagctttatttaatccacacaatgacctgccaaagaggtttcatatccccctttatatagatgagaaattggagcctccaaaagtaaagtaagcgtccctaatcagtaagtggcaaagctggggttttgaacctgagtatttctactctcgttcttttctttctgtctcacttagaggctgaaggggctgctggcagtgccactcagcatgcaaagggctgtatttatgccagaggcagcagggaagtgggtgatcacagaaataaaactgtgtcctgtcgtaacagagagccaccaaacatgtgcagggactttcatcaccttacactgtaaatctccatacttgtcaattactttctgctacaaggaaataggatgctatataagaatacttctgccaggaaattgtaagaacaagtagaaatataaatgaggaaaatgaggctgcaaggatttttacaaataactttctgaagaccacttagctggggaaaggcagagctttgctttaaacagggcttgcaacttcaaacccaacagctacatgtgctgttccttctcccatgccatcagcctatgccatactgaccagcaggaggtcagaaagcttgttctagtgctgggtcctgtatagcctatggcagatcactttacgcttctggtccttggtcttattaatcttaggatatgattttctcatttctcttttgttcctagagagaaaccatgagaaaaatttgaataataaaaaaaatctgactgtgaaatgcctcagtggttcacatattgggttatatttttagggggaacattttttcctctgtgagtgaagtgtacagtgcccaggtctttctgttaatagtctgttgaaagtaggccttatcttcatactccagaccatttataataatgaaacttttcactttatggggatttttagctttttggaaatctatgttatcctgtgtacctttttagaagaagttacatttcaagcaaaagaaaatctgtcagtttgctcctctcccctcccgaatttccatgaactgttactgaacatgaagaacaatcatggatgcgccctggcatctttattcccctggtagctgataccacacgtcccaacttagcctgatgcagagtcatttttataagttttgtaggcatcttcatttttaataaaggtagaggaagtagtaaggaggagaaac

SEQ ID NO: 116900 - DNA, 1026 bp, Homo sapiens
ctattatatgatattttatgtatgcatattgttgaatttgatccactcagtgacttgatgcaggatggagagacatggcatcagaggcattatttaattttcccagattatgctgctggggtggtcactcctggtggttcttggcttgagattctttactcattgctttatgtgtgacttgttcatccctgaaagtaatacacttaaggactggatttgtgggcatcttttttttactgggagttgattttcacatggtccgtgcttttcctgtattagtggccatttatgagggagattttgtagtatttcacttctaccgtccaaactatctattgtcatggggcaatgtaaaagtaggtaataaaggtgctttaagatttaagtgtaatttataaaattttaatcgatggaaggtgattttaatgcacctctccaaaaatagttaccaagagacagttattatttatatattatcaataatctctctgcttgaatttttgttacttaaagggggctgttatttgaagaatgctatcttccttccctggtcattattcatattctgtctctctttctctcttagtgtaacgaaacctcattcttttttgaagctcggagtaaaactgcttgcaagcacctctggaagtgcagtgtggaacatcatacattttttaggtaaattgatgtaaaaattttgtttgttgtcttaataaatgaaaatggcatttatttttataaaaagaattctgtctaaaacagaaatttggaattgtttcccttttattaattttctcaattcctaattctctggattatattaatacaaacatgcacacattcatgtatgtgtagatatatatacacataggcacttatacacatagatacagttatatctttgatactgcaagaaaggatcgaggtaatattttttaggtttatgtaaaacatgcagccattgctagcacctatgtagtattggtggaaatggagtgttctgtgcataattaatttgaaaagcct

SEQ ID NO: 116901 - DNA, 1030 bp, Homo sapiens
gatttttcagttaaaaaatacgtaaccatattacatacgtttcaaaattttttaaaaaaatgtgtgtgtatctatatgtagagggttgtttatgtatagtgcaatattttttaaactagagtatgtgcttaccatacacttccctgaaagaaagttctttgatcaaataaattagaacaacccacaaccttactagctcttggagattcacagtacatattagcgcattaaaggtctgagtgtttagcccagtgtttcccatacttatctgagcaaagaacccttctatgccaatatcgcaagaccttagtgttgtaagaaatgctctttggggagcattgtgtaaagactggaaagaataagatcatgttttattcagtgtcttaacatttccttctgacttccttttccaagtaatgacaaaattggtgaattttgttgcaggactcaccctaaattcattagccaggtggaaactcaggatgcctagaaaagagagcatgaaaaaatatgaggaaagccattaaaacagatattgtgcccaggatatcatgtgtactaacatagtttaatttttaaaactatagtcagtttcaccatttagaaagataaaatttttcaaaagacttacaattttgtaagctttctttggtatctatttccagttggagaataaagatttcagtttgactacttgccttcctttgcatgatcagtaattaagaagaaagttattttagtcatttgctaccagccgtctgactatttttgtttctctccctggaacctaaactgagttaatgattgcgagttaatgtaaatcttgtgtggattggatagaaagaaaaaagcaaaaatctcacagtactttagacttgtaattgtcacacttctttttagcctcttccccacctctatggagcatcagtaggaaacctctctgctgtagactttcaggtacttatataatgattgcattttacttttcttagaagtactcatctcttttgctcttcagtgatgacctaca

SEQ ID NO: 116902 - DNA, 1047 bp, Homo sapiens
agatgtggggtagaagacctaaagaaggtggggtggttccagcacactgcctggttcagcctgactcttcttaggggagggcctctcttaactgtgggcatgagctcagactcagcacttgagaatggattgaggacttgcggggaaattgggtgttacattaactctgggcttcaccctccatgatcggatgtgcatttaagaaagcacactctggctgcagggtggaacatgccacagacgtgagcacagaggcagacagagtaggagatgtgatcaaggggagacaagaggggactcactgcaaagacggaaagaagtcggcagatttgggaagcatttaggaggttaaattgtttctgattggtagcagattcaatgtttttgtggaaaataggaatttaggataatactggaatttcttggttttggcaacaagaggaggatgtaattcctaacacaggactaagcccagaaattggcatgtagtaagcacacttgtgaaataaatgaaagaatgaataaatgctgctgtgcttacttttatgtataatacctcaggaaactaacctcagctaaagttaccccgtgtgacaggatgtagaaccaaaaggttcctggcaactctggctgtgagtaatgagatccacttggcagaactctccggcttgctttaaggagagtacacgggaagcgatgatggccaggagtcatcactgtttgtcaacaagcgcaagaggtctcacttacgttaagccaagggttcctttcacattttacatggtaatatagatttttaaaaagtatttttatttgaaaacaactcaaaatttatttaaaaagttgtaaaaattaaaatattacgaagaacatattcatttactgttacctagagtcacttatggttaacattttacttcacttcctttgttatttgtgccttctttctctccatacacacacaggcctttctctttagaacagcttgagagtaagttacgtatgtcatagactataaatatgtaagtgtgtatttcctaagaatag

SEQ ID NO: 116903 - DNA, 2007 bp, Homo sapiens
cagtatataaaggagccagtattcaccagtctttttccactggatacttccctgattttctgaaaggttaatacttaaaaacagcagcaacaccatctgctttgttttttaggcctcggattacaaaggttcacttcaaggagactcaatttgaactcagagtactgggaaaagatgtaagtttccaagcccttagcttaaattagaagaggggtgtcttgtgtgttcatttgtagcttaaaagacattgtgaagaaatgttttcttcagctgcttccacatggaaccaggttaattaactcacatgcacaacttctcaaggaaggaaagggaagtgaatagaaatgagtgagagggtaatggagaaatgggcattttagatttagcaaaggaaagcaaaacctttctaaggcagaggagagaataggaggtgatcattgttgttagtgcaatttgctttccagtactctctgtgagggtagaaggtaggagttataatcagaagggtatagcctgcattcaggactgccaaaatgcattctaattttgctctaatgtaaattaaacaaccttttgggagtcttacttctgctcttttcctcattgagtgtgatagacaaaccagatggaaattctggatgctttcaagggagaatgtaaaaatgccggcctttgctttgcaacttggcaatgtcctctgggagtatttgggtaatgggcacagaacttgtcagtgcctggatgtgctttcatgccttgatgtgtgtctttgagaaaaatggtcgaaagaaggcaaggatgtgaaagcttccttttgatctacctgtgaaaataatgcttcattgaagtgctactagtgtaaaccacatattatgggatacatgagtgaaaataagatgtttaatccatatttatgggatacatgagtgaaaacacgatataggagaatctactcttctgtctttttgatactaactttgtgcagaacaaaaactaagtggagttgaattgattttcttgattaaagaaaagtaaattggtgcttatgcatgcacacactgagacacaggaataggagagctgcagctacatttggggtatggtatttggcagagtgcctcacatgtagtaggtacttcataagtatctgttgaatgatcaatgagctgatgcactgagacactgtgtgctgccacatcagaaaacctgatgctactctttgttctcctaataggaaaaaaacattatctcatcctgaactatatggcatgctgccatttactgatacaattaaaactggattttgaaatgagttttaacaacttgtaaggaaggggaattccagatttttaaagaaatgatagtacagaagccatatagttgttcttatggtttagtttggaggaaatccaatgtgttcttcagctcctgattagacatctcaattttaaaagatgtgcattataatataagactgaattaaaatcatgcaaaaagtagagtagctaattaggagggttttgtagtttctccctatgttgccattaggttcacatgaataataattcatctaaataataataatgcaaggagtaagatctgttagatatatttgaaagtaatgtttcaagtttttttagcagaatatgataatcaaaagacttatggaagcattactattattcagagtattctttccttataagttatttttgtgagtgaggtcctctggtgaatgactttcatgttattattacagtgccttaaaatatatgtctactactgtctcaggataaatatttggcaaagtcccagctaagctgaactttcatcttcttggacttcatgattaggcaaaaacaacagcaacaaaattgatatcatcatgttatttttcaaatgacagtctccatcgaatgaccctgtttcctgtgtactcggcttaggtgtctcccacccccacctcattccttcctcagctttgagatgaaatggatgtctggggag

SEQ ID NO: 116904 - DNA, 1046 bp, Homo sapiens
aatgaattgctggagagtatttatagactgattttttttaatcaattggattatggaactcagtttttaaagaaccctaataaaactttatctagtgcaaataacactcatgcattcattttgtatatgtcttttgctcattagcatttcctccaagaagaaacaatctcatattatttttacagttagaagcattcctgtttaatgtggcaataaaagctatagattgtggggaagaagtagttccctgatatattagattccaatttcattaggtcattaatgcttcatagcactgtcctttaagaatactgctaaaactgtagaatcattatcgttttaccttccctccctttagccacattaatcttgttaggttttcagtttttaaaagaaaactttccataggaaatttataaagagagtcttctgcaaaatgcttctacatttgtataatgtttatcctaattagaaatcaccttctgttgatggtagaaatttatggcaaatgagctagatttattagactcttcagtgcattcctttaagatttgaattttaagaactgaaagtgggcattggcaggtattcctccaaatgtattgctttatgttctttgtgaatataattttgcaggttaccatttatcttagagtagaaataacattctcacaaacagtgctgtgcatgtccttggtatctactctatgactttttcattttaagatcctgtttttaaaatttggatttattattgccttaaaataaaggttctctagtctttaccagaagagattatacttttacatttttgagcactcttaaagttataggtggaagtaggaagaaacatgatagagacttcaaaaaattcaagtgtgtgtctgctagtgactgcctaaactttctagagagagttggggtggggatgcagtgggtttcatgattgtccgcatcggagataaatcaagccattcaaaagcacccttgatagatgccagtggttctcagtctttaactgtacagaagtatcacctgggagtcct

SEQ ID NO: 116905 - DNA, 1044 bp, Homo sapiens
ataatgagccagaatggatttggtaaatgaaattaatataagtatcacttcagagtataaaattttgtcaccaagaagcaaaggccttcttgaaatacaaggacttaagtttgcattagtaaaaagtattatttgttttcccattgaatacaatgaagatagtttgcatccctgtaagtgcagtagctgctgtaaaataaggctctttgtttttgtgctgggtgtaggggtcagattccttctgaggctgagctgaattacttgaggactgccaaatccctggagatgtatggcgttgacctccatcccgtctatgtgagtaacatttaattaacacaaaatattttaagctgatgacatttttcttaaaaagtcactgagactcccaaaggaaagctgcagtcctgttgtttagcaagcagatgatacttttttatctgtttttctaacacaaagcagctctcgtgtggattaaaccctaatgagttttgcataaaaatctgtgattatatttccatgtgtagaaaacaattaagtgggcttgaaaacacaatctggataacagatacaaagggcttagctaaacatcaaaacaatataaaattgatgtataggccaggcgtggttgctcatgcctgtaagtaatcccagcacttggggaggcagaggtgggtggatcatctgaggtcaggagtttgagaccagcctggccaacatggcgaaaccctgactctactaaaaatacaaaaattagctggacgtggtggcgggcgcctgtaatcccagccactcgggaggctgagacaggagaatggcttgaaccacctgggaggcagaggttgcagtgagccgagatcgtgccactgcactccagcctggcaacagagcaagaccccatctcaaaaaaaaaaaaaaaaaaaaaattggtgtgtaattgactgtattagacagaaaacaggaggatttttcaaaaaatagattttatggcagcaaaacataaatacaatcacttgccaggtaaaggatgcgttaggcaataggcca

SEQ ID NO: 116906 - DNA, 1535 bp, Homo sapiens
aattatttagttgtcttatatgtgaattttagtaagacatttgaaaaaatgtttaagcatgttaggaatattttatttctatgttttaaggactattttcctaaaatggaaaaaactatgttatctttcttttttagcggagcttggagattatgacccatataaacatactgcaggatatgtatctgagtaccggtttgttcctgatcagaaggaagaacttgaagaagccatagaaaggattcataaaactctaatgtaagaatcattacaccatgtcttattgcatcatccatcagtcatcatcttctgatattcacaagaaaagtttctagaatgataaattcttcacctgtgcatttaatattctaatactcctctttgtatagtttaactgattttaactctaaaatgctcatcgaaaacttcagtaatttaaaaagtgtaaaggagaaagtaatttcaatatgtaaagttaccattttttggtcaatggcctttcagacatctctttgtatgtacaatttcccagagaaaatttgtcatacataggttcatgtatttatgatattacatagtggaatcattctgtaaatactagattttgcagtctttttttttttcagtcaccagtatcttgtgaaattaatctttcagctataaatatgtttaatcacaacaatttttaaccataaatgcattaatatattcttcaatgtttcctctgtctgaagtatcccagttcttcacggttataagccaagtcctattcaggccatagcaacgagtctggaaatagtgatgatgccagtgtgaaacctttgagggtatggtgataacactgcatgcatttctgagagtagacacgctcccctagtaggattttcaattcatggcctatagcactgaagttttaatttcattatagttattttggttaaattctttacaccggttaacattgctttattccctgttatgtaacacttcctcttgaatatacttggtttcagatctattatagttaaggaaaaaaaacatggctgggcgtggtggctcacgcctgcaatcccagcactttgggaggccgaggcaggtagatcacctgaggtcaggagtttgagaacagcctggccaaaatggtgaaatcccatctctactaaaaatacaaaaattagccgggcgtggtggcatgtgcctgtaatctcagttacttgggaggctgaggcaggagaatcgcttgaaccctggaggtggaggttgcagtgagccgagatcacgccgttgcactccagcctgggcaacaagagtgaaactccatctcaaaaaaaaaaaaagaaaaaaatgtagaattaatctggtcacaaaaaaatgtttgcctaaaggatccgtttcagtgagtgtagaagcagaagtcagctgctgaattgcagtcagagaaagaggccctctatgttgtattagcatgcactagaaggctctccaacctgattgtagagtccttcattttcagattctgctgaagtagatggtca

SEQ ID NO: 116907 - DNA, 1047 bp, Homo sapiens
agccccctcacacaagaatggggggtgactttattttaattgaaggtgattggttgttaaccttgattatcagggtccgaaacctcaggtttgagtagtgtaagagatcgttaatctctctttttgtttctcttttagatatcagtttttcttgcaggtgaagcaagatgtccttcagggccgtctgccctgtcccgtcaacactgctgctcagctgggagcgtatgccatccagtgtaggtgccacttaagcatatttgcctcagaaatgtctggagaaagtatttgcatttttaaaagggagtttacatactaaaactcttcttatccatgagattttgcaaaaaaaagaaattgaatttatttggaattcaagttttgttcagtgttccttcggaacaggtaaaagtggagcctagtacaaatcccttatggtaggtcgtatggaggtttagtcactggaatagcattgattcttgattaagtggagggtctaacaatctgttctatctacatctcatctgagtttattgattttcctccccacaccctctcccaagcttctatgtgtcagagatcccattgctcctgcattgctgttgtgaagagtctgcatggccaggtgctattgctaggttccgcatgtggcatgggtgttgagctcagtgctcttcagctcttcatgttaatacggtggctgtgtggggtggctccaggatgcattgtcattttggagactgaggctgagactacttccagtgacgattagacaccttctaagaatcaagctagatgtggggagaataagatagcatggtccttgcccttgtggcacttgcagactaaaaataatctagaagaaatatgctaggaaaaatgtcatagatgaagtgggttggggcttgcaaggtagattaacataggaagaagcatttgtataggagtaatatagtgggctttcttgtatcattttgcttctttgtgtaaattgtaatgggatatgtgcagcattgtattgcatttccatgatcattatttcaggcaaag

SEQ ID NO: 116908 - DNA, 1031 bp, Homo sapiens
taagaaataataattccctgatggtctatgcagaataaatctgatctctctattctttattagtactgtagataattcgtgtcctcaggagagctgttaaacttattttcagttctgattcaaaacatgacatccttccctgtattgtgtgtccttcatagctctgtatcttccagatttgataagtataatacatacatttgtttaaaagacaggcttgggaatcagaaaggctgagtgaggtctgcatccttgctttgtcattcactagttctgtaatcctgagaagattgcatagccttttgtaaagtctcagttttttcatccgtgcaatgggattacagtatttcttcaaaaagatgcttggaggaatatgtaagagtgtacttgcaaagtacttaccataatgcaaagatgtaagtgttcaataatgataaaggtagctgacatggaaataatggttattgttttatattttcaaattattgattaaaacatttggaaaagaccagcttggagccctgagataggtcttcttgcatgtttaagtcaatccagtaatcatatccttcttattgtaggtgctgatttaactatgaatcattttactatcccctctagcctgcatttcttgaatttgtatgtcaagacagaatgcccttacacttcattcagtaactatctggagtaccatgttacagtgtgctgagtaaaaggagtttcagtggtgaccagggcaagatctggtttcagtctgcccgaagagagaatctgtcagttgtcttgctgacagccctatctgaaatgccattggaatgtccctgaacttttaaggatcttaaaactctttctacaagtagaaaataatgttagttccagatgactcattcataatattttttagagtctcaaaacaggtgttcgatttttttcttagcttttaaaataatatttcacagcattttgctgaggattgatattatgttcatgtcttctttttgcaacccagaatcttcccttggtgaagatgg

SEQ ID NO: 116909 - DNA, 1068 bp, Homo sapiens
acaggctagagtgtagtggtgtaatcatagctcactgtgacctcaaactcctgggttcacagaatcctcccgcctcagcctcaggagtagctgggactacaggtgtgtgccactacacctagctaatactttttttttttttgtcttgttatgttggccaggctgatcttgaactgctggcttctagcaatcctcctgccttggcctcccagagtgctgggattaccagcgtgagtcactgtgccagcgtagacctcatttttagaaccaagcagatgtctgcattcacattgttcattatcacattgttaatgagcactttgaaaagtagacatgccagtttaagcttttgcagagcacatctttctgggtaaagggccattaggatggggaggatatgttgaggggagggatggtattttcattagagtttcagagggaaactgaattcaagtggtataaaaaaatacacttatatctgtaactcgttagggaattgcaaggggacagcattttttaaaaaataaaatgaaagtccttcatattcaggttgtgagtaatctctgcctgtgcctaagtgtcctcagttgtaaaactggagatgtacctgtttcaaggtttttgtaagcattaaatggaataatatatataaagctcttatgattgtccgtgtctcgtactatgtttgatgaatgctaatacttatttcattctatcctttttctagatgtatagtggaattatatcttcaataggggttagggtccaaaaatacttgagttaattttaagaagggataaaaaagatcattgttttataatgcattacttcacctctgttcaccacacacatgaacaggaatttcccaacagaatctactgatggctcattaacggaatacatggatttttgtataatttacaacccacaatattttcagtacaaccagttgtattgaaagttttagaccagcttgtgtagttaagaacacagtgacatagatggcttgcaattagtgtccatgatttgttgcctaaaacatatggttgaatttaggtaagttaaatg

SEQ ID NO: 116910 - DNA, 1046 bp, Homo sapiens
gcttggaaatatgcacttttggaaacagtacagattagattgataccctcagaaataaaaatatttctagtaaaagcataatataatgtgttcagcacccaaggggtttgtgtcttcttgcacaatatgagtgtttattttttatttgcccatgtacatacaattccaggctttgtttctgattttaaaaaaaagtttgtaggcatagttcttctttggtaaattaatgagatgagaaaggttttcttaaatacgtgagaacacatttttagattcagaaatgtttaagaatgaaacaaatattgtccctaattttattatgtagcctcactgatgacttttttcctgtaaaaaaaggtaagagttatcataagaaaattctaatgaattagtttaaggatagaatgtttctagcccttcttcccagagtttgccatttagtaattttttttgtactcttccaggaaaaaaaactcaaatatatattaactgatactttttcacaaaaggtatgatatttctgtgctcggaaatttagatagttggtcttttccacatgagcacatgcagatgcccttctgtctgtttaaacatttgcatggtatatgtcctgtggctggggctgacttaaatagtccacatgctgctgagcatttaagttgttttcagctttttgcagataggtttaaaaactatttttttttaatgaaatgataggtgggtggttttttaaaccatttattttttttctttcttcactatgaaaaattacatatatactatagaaaatgggaaaaacatatataataaaaattgtccataacctcaccaaccagacataagaaccagcaacattctggtgtatttggccctgtcttttatctgtgtgtgtgtatgtgtcgaggtcctatcgtcacagttctgaaccttgctgtttttatcttatgttttcttgtttctttagacaatcttggagtgtaattgtaaatagctgtataatattatactgtaactttgactaatttatgattttagtgaaatttaat

SEQ ID NO: 116911 - DNA, 1050 bp, Homo sapiens
caaaaaatatctggctagacatatccttgtccaaaatgttcatttctatagcctttgattgctttctgaaacagtgatgcatatgagagtattatctcactctaaaggtattattattttgtatttccctgagaagctgtatagaatggtgcaccccaaagtgctgagccctagatgatagcaaacttttttttcttccctgtgattttaggcaagttgtttaactccttggagtttaatgtgccttgcatatgttcccaagtttttgttgttgagaatcaaatgtttatgaaacattttcgtacattatgaagtgtaaccaaatggtaataatgccttatatttagaacacagccattttatatgtgaatgggaaatgaaggtctagtttgggccagaagaccttagagaaaattagccaaaacctaatgtttttaactgtgtacttttaacatttttgcttaactgttcatactgaacatttgaaatgcgtgggcttggtgaatagggtgtaatctgtcatgttccaaagaatagaagcagctctgaggcctggagaaggcctcttccctttgtgcaccatctcagcagcatctgtgctcctccccgccccctaggtaccaaccccagctgcctgcgggcacaggcagacccatctgctcaggaacatggagcttgattgacacagacggataagctgagggtggacttcctggctcttctaaatatttaatagtctgtgcctccctgacatctatgttcagggatagaggtgtatttgtcagaaatacaaacacagtggttaaacaaacataaaagttaaacataaggaatcaactccaataataagaaattctagcagtttcttttaaagtttagtttttaaaaaagctgtagcataaggagtgtctttacacaggaaggcacagatgaggggaggggcaggatcctcatcttgatggtctcccacatgccaggaacagggttccagggtgctgcacacataagtatgtgtatgtaatattaataaatagtaacatagttcatatg

SEQ ID NO: 116912 - DNA, 1017 bp, Homo sapiens
actggaaacctggactgcaaagccatccgaaagtcctgtttctatgaatgtcagcatcattgttgtttctcatcgcctttccacctctgtagtggaaaccactggagtttacaagttacagctctagcatatttgaaccgattaaaaaaataccagttggaaaaccagaaaaatttcaggaatgattttttttttttttttttttttgagacggtatcttgctctggcacccaggctggagtgcagtggcgagctcttggctcactgcaatctctgcctcctgcgttcaagcaattcttctgcctcagcctcacaagtagctgggattacaagcgcccaccaccatgcccagctgatttttttttttttttgtatttttagtagagatggggtttcaccttgttggccaggctggtctcgaattcctgacctcaggtgatccacccacctgagccttccaaaagtgctgggattacaggtgtgagccattgcacccagccaattattttaaaataaactcacaggtttcttttataggaaaagttgatatttctatcaaggtgatgaaaaaatgttaattattttaaggtgcattattaaagtgttcctaagcacatttaaagtgtctacttatttacatggtatgaaatattttatttaagtatcagtctataatgcagtcactttttcattctaaaaatgcaatattaaaaatttgcataagactcgtggtgtcttatgcctgtaatcccagcagtttgggtggctgaggcaggtggatcacctgaggtcaggagttgaagaccagcctggccaacatggtgaagcctcgtctctgctaaaaatacaaaaattagccagatgtggtggcgagtgcctgtaatcccagctattcgggaggctgaggcagagaggatggcttaaaacccaggaggcggaggttgcagtgacctgagatcccaccactgcactccagcctggatgacagagcgagactccatctcaaaaaaaaaaaaa

SEQ ID NO: 116913 - DNA, 1056 bp, Homo sapiens
attttatttttaatttaatgttatttttaaaagatggggtcatgccatattggccagggtggtcttaaacttctggcctcaagcagtccttcctcccctgcctcccaaagtgctgggatttcaggtgtgagccaccgtgcctggcctattttttcttttactgttcttgctgcagaaaactcttatgtatgtttgtgtgtgtatatgagagaagtgtttaactgaccaagttttaaaatgttgtttaaataacattttgcaaatattcttgaagtaaaagctaatgaaaagcaactaatttctttaattgtccttttcttcctcacacagtattggctggatcctgcaaaaacccttgctgaacacaaagaactgatcaacagtaggtatttagcttttactttgttaaagggtggcttgaaaacgatgacaaagtccatgattagttgggtgcagaagtgggctttagtactggagaaagaagtgaatactagtacttgagtaccagaatatgggaatgtgtgtattgtgtgcattgctaggccctctccaaagtcagattaaatttaatcagtttctgagtggatcttagtatggaatttttcctagaggcaggtctttccttgattttgtctgtggtttttctgtatgcttgtctttaaaatttgaccttaaaacaaaaaaggcaaatagacattaacgggggtggtaggtgggctgcagggatgggtcataatgtccaagcttttaaagagcttgagtttcttgggttatggcatggttttgccattcagaccactcagtttcctaagccagtaagtaagaggtgcctttgtgatctgaaaagtggtcttcagagagagaccatttttgggagctagctttttggttttatcaatacaaatattataaggagatgcaatataattaagtatatattccttaatcttaatttccagaacccaagtttttatttataagcacaaacagaggctccttaagtgcgcaaaaaatactctttttaaaaaaattgtctgtttcaattgaaataaaagg

SEQ ID NO: 116914 - DNA, 1327 bp, Homo sapiens
tggggcaggtggaaagactgaatggactacttccctttctggaagttctccatgaatattgattgcttagctgagtatttgttagctgttaggcaacactgacttcaatagggtgttcaattgtaaaggacttagagtattacattctgtgttattacatggaaatttactcacttgctttaagagcagttgagctgatagacatgtactttatacagatttaaggctctgttatctcccatttatgtattttgagaaagtttttttgaacatgctatttaacgatttttttagtaaagccattgtatactcaccctgcagttaattttccttgtacatgattttattatctcatatgtattcatcttatataagtaattattgtctcaccacattgtattgtaattacatggctgtgtgtctcctgctgggctgtgagtgcgaggttagtcacgggtctcattcaactttgtgttcccatactaaggacagtgtctgacatgtcatgtaaagaacatgtatagtggatatccataagtgatgaatgaatgaatgatatcccagttttagagtctacctctagaatattggcactccatgaccagtattctggatgtattccttaaaacagggatattgtgttcattggcaattttttgtgcccttttttctcttaaactatagagtaacaggctgctgtgtttcactctgatcttccatgtgctctgtttgattgcttgttgataatgaatggtgacaagtgccatcatagcatggctgctttggttccaaggtcacatctttcccttggttgaacgtaagtgggttttacatttcaagatcttggcttctgaaacctggtgacttgtgtttattatttatgttcttgggcatttatcattgtctgacctctgtaacccctggtttccattttgatcaaatgagatttgtgtgtggccggctctagggtgatgcttagcatagcaaatgtgcagtgagttgattgaatagcctttgactgagtcttgctgctgctgcttcgtgctgcagaattgtaatttctaacttttcttgaaactgttattttacttttttcacctctcaaatttaatcactctcaaggaaagagatttattttaaaatagaacagattatcattaatgtaaaatttttgatagattaaccagtttttcccattatatgtagttaaaattttttcttcctattttctttagctggctttagtgactgaaaagcattctggagacaaggaaacaaagacaaaacaaaacaaaatgaatcaaaaaatctgaaaaaaaattacaaa

SEQ ID NO: 116915 - DNA, 1590 bp, Homo sapiens
taccttttgataggaatagtgttgactaatttaaagacatgttttaatacatgagattcctctgaccaaaaattatttatattctttttacatataaaatgcacttatccctcccaaggcctcccaatattcttatttattgtgacatgggacttgagcttaagatataccatctccagcttgcagtgagccgagattgcgccactgcactccagcctgggtgacagagcgagactccatcataaaaaaaaaaaaaagatatatcatctcctctaatcagactcttcgaacattttccctgaagtttaacccttgagtacagttccttttgatctgaagatatgtgaattaaggtgataagatatgtttcctgcctacccgccccaaacatacagtggtggaacatgcataggataaccagtataaatgcttccagttagaaaggggcaaaacaggaggcacacaacaattactagtccataatactagttttgaaatctagccagacacatgtggtgatttctctgattaggacttggtcctattgcctaggagttgttcactatgacgattggccctgtcttctcggctcttggttctgttgtctgggcttgcttgcttttttaataaaaagtagtgtgtatttgcggtggagtagtgttctcggcctggattttgcctaaggaagattgggagttcaaaggcctcttttcagtttgtagtatctctgtccctttcagcccaagctggtataattcttctaaaagtttttgtggatttctaatgaatcaacctttaattaactttattagacaaaggcagcacccacagattgctctggaataagctcttctgtaccttagattccctgtaaggctgttgggacacggtgccgttaagattattagaggatcttgttttgaaagggtccatgaggcatggtgttaaatcttataaattgtattacatctaataaaggattttacagttatagcatgtttacctgacagcatgctggattcattctttgcccagaagccatttcttaattgcagcattgtttgccttctgataggactaggaatgcgaaagttttattttcaaactcagtaaaaagtcctggctcctttatattttaatagttcttctttctttttagcttatctctctcttcttacatttcatttatagccagcaaaatgaagccaatcagcaatttcaacagtttacctggaaacctccttatctgaatcatccagttcgtttggtacattttttattccacatttttttctgtttccaatagctttctctgctttaattgaggctcttagagacagcctccctgcaagccctcaggcttctaccaatactctccttaaggtccttcttgctacttcatcccaaaaacacacagtggaaagtagagggagtggggccagatcatggaaggccttataggttattagaaggattttgtgttttactttgagtgcgaaaggaaaccactggaggatattgaagaaaagagttaactgatttgatccgtgttgaaatgattttctctaactgcaagggcagactcaagga

SEQ ID NO: 116916 - DNA, 1115 bp, Homo sapiens
ttaatgattttagacattagaaaactagtttttttttaaatttagggtttcgacacaaagctctgataaattaaccttgatttaaccttattctgaatcttaagagaattttctccttgaatataataaacagtttaatcgtgatgtgtcagtagcctactaataaaatgtattttatggaatattttctattctacttatattttataaaattgcaaatttgctgcatgtactaaaagctaagtgactagtttgtctatcattttaggacctgttccaataagagagatgttcttggaattgttaaaaagctgtgcaggtgcttttttgtttcatgggaaagtgggagttacctactttcccttctggactatgagttttgagagctgctttatgaattaacagaagtgggcctttaaaagctgatgatctgtaggagcttagtttattctttcatgatacccatcagtattggaggccgcaggatattttatagaggatattcaggaagtttcttgtttaacattttttagagttatatccttactcatatcagcacagcctgaactgggactgtgaggaaagatgagcatttgctgttgctcatctccattcaatcacatagcagatacttaccaggcagccactgtgtctcaggaagtatggcacaatggtgagtaagagccaaggtctctggtctcaaggagtttatttccaggggtgagacagaccataaaaagatactcaaatatcaggtactgaatgctttgaaaataagatgatatgctagagttttgtgaaggcttcttccattgggtggtatgtagagaaaaagtctctacccatgtaattacaggtgtgagccactgctcctggccgaggcctgtggaacttctgaccaactggcttcaagttggagttcccatgaccttctctttgggtttgattaatttgctagagcagcttacaaaactcagaaacgcagaatatatagatgaagagatgtgtaaggtgaggtatgggggaacggggcatggaacttctatgccctcctgggcacgccaccctccaggaacctgcatgtgttcggctacctagaagctccctggaccaag

SEQ ID NO: 116917 - DNA, 1607 bp, Homo sapiens
tccccgaccccccagaaatattttgggccttcttgtatcacatattacaaatacaacattgtttgtgtctattgaataataccatttgatcggatactttttgaagggaagcattgaatcctattcaccactttcttaccacctctgtcactgcaaaacaagtgatctgtaatgttactgagtgaaagaactctcgcctggactgtgtgggccgctcactgggaggcgagggccttgacaagagcattcccacacctccccttcccacgcctgcatgctccctccttctcttatgaaaggcctctcctgctgttcattttaaccagatttaacttacatttaaaaaaaaagaaaaagctttactgagatattaggaagttagattgaaaattcttattgggattataagaaacaacaggtacaggatatttttaatgtgctggcagctactaggtgctgtttagaatattcttgtctggttagaggtatagtggtgtagtatgtaataaaaggaggcatattatatgaggatttgagttcaaacaatgtcatgtgtaactgtatgatggtggatcccatgattttaaaaaattgtttataataaatagcacttctaaaagtagatttttctatttcttcttggttaaacagtgtttaataggaaaggaagagatgatgttcttctggaacattttctgtttagagtgggtgtgccctcttctgagcacagtcatgtgaaacaccatgagaattcagcagctgacatgcctgaaataaccccgggaagtgctgagaggggagcctcccaaacggctcccccaaagtcgcttcttgcactgcatgctttcctcactgcggcatcgggaaaagcagagcatgctttgactgattggtcttcagtttgttgattttgacacggactcaaaaacggctcttgaaggacccaggtttgtgtaggatcacctccatggcacattttgaactttagttcttttttccttctttccctcaaatggttgattgcagtaggcatgaatgtttcttccatgggtcatgtataatattttatcctgcggtttctaggtttagggaggtgaagggctgaattctatcttggagagaaagttttctttgttaatggcacccaatgccttcttcaccaaaactaaattaaactaaattaaaaggagggagaggatgaggaaaaataactaatgggtaccaggcttaatgcctgggtcacaaaattaatcagtgcagcagaccctcatgacacgagattacctgtataacaaacctgtacctgtatccctgaatttaaaagttaaaaaaaaaaatgcttccatcgaacaacaattgaaaacaataaaggtacaaagtacttaataacaaaactatcaggaatggtagaaatgtcaacatatacatacatgtatatatatatccatatatccatatacatttatatttttgtatatacaaccaggtacgtaggtatgctaggtgttcttatcaataaatgcagtacctgagaaatttctgtgacccataccttcttagttatatacataagtgaaaggaatattgatttctttactatgaacatt

SEQ ID NO: 116918 - DNA, 1468 bp, Homo sapiens
actaaatcagaacacatgatagctctttgtagatgataaggcattgaacatgtaaaaggcctttcctgttgaaactaggatgggagaaaatattgctggtgatatcagcggaatgaaggaagaaggaaaaagtctggaagaaagaaaagaaaaaattaaataaactgtagattcttaaatacctttgagatttttgaagatgagttttgttgatactgaaagcagtaataaatataaatgtgatatctcaatactacttctggttttaagattagttttgaaagggaaagcgcttagcctgggctagagcctattttctgttccactctggcttgtgccagtcaggttcgttcttgatccagactggtgtgtttggggatgtaggtctctcatattagggccttggtttgacttacagaaaattcccagaaattatagttatgtcttactttaatgttagcacctgaggctcctttacagattactccttgaaaggcagaagttgtatataattagggcttttctcagaatatggaaatcaacgtggcattgagaattaggtcctgggtctgctgcccttttacttcagaagtcaaaggagggggaatgtgtgaagcacacagatgaagacagcatgcaaacactgtcttctgccagtgaactctgtttttcccttgctaagacaataaaagcaatcagaaacttcccactttcttgaccaccccacccccaaacacacttagttgcttcatacccttcctttcctgtcaccagtgtctgtgagctggatcttaccaccttgctttttctgttttgtgtctctgtaccctacctgctccctctttccagtcagtgtttgggtgtgttcaagtctttcccatttagaacctcccgttcccctcctcctttgccctcccttatctgctgctgtctttggctccttctgcatcacgcgtaaacttcagaaaaccttgtctaagtttcttacattcacttctgaaatcccattgtttcctaaacatatcaccatgcagcttttttcccgatcacatcactgaaactggccctgccttgccagttgctaaatccaagagactctgtcagtccttgtcttacttgacctttcttttgctttgacactaacaacttgcccattcttgaaatcttctcattttgttcttctggcactatattctttttgtttctctctcttcatgttttctctagttattcctgttcagtcttctctacgattgtgattccactgcctgttccataaaatgttggtgttcaccaggattttgtccttagttctcttaggctctaactctgttcaggcccacacatttagtgctacctttgctagtactgtttacctctgagataatttccttaaccatctaaactaagctgtgtatgtgttaatatttgtattctcttccctgcccccgagtactctgagtattga

SEQ ID NO: 116919 - DNA, 2013 bp, Homo sapiens
cactgcgatttaaaaagtattttccaaagcaatttctataatacattttgctttaaatcacgtttttttcttcataattgaggcacaacttacagagaagaaccatggtctgatacaattgctgctattgtgagtgaaactaataaaagatgagaaccatgactgtgtactacttaggaacaaaagggcagttaaaaaatataaaactgaattatttttgcagaagtcaacgaaaggttccgttgtccttgaccacgtattccatcacgtaaaccttgtggagatagattattttgggctacgttactgtgacagaagccatcagacggtgagtaaggtgactttgtgttaaatttttctggttataaatttcactctatctctggcttttcctgatatggttttaggtggttaggttctttgtcactgaaaaagactttgaaaatctcaaacatgttttcccctgataatttctttgcattttttcctcttctgccaaaagtctgtagagttgctggattcacagcttctgtacatgtgtagtcgtctttgcagatggcatatgtggtttccagatttgcaaccttatcatagtgaatgcaaagcatgagtgaacatggaggactgaatatgtcgtttaatatgtgttagaaggcaagtggctagtctcttgaggtgagagatattaattgccttttaagaaagggaatggttagagaagaaataacagtgtaaaaaaaaaagtgactacctaagttttataagtgagatgagctgttacaaaataaaataagtagaggtttttttgttcatgaacctgatgaaataagagtaataaaggcaacttagcttttagttcttatgtcagttgttcacaaaggttaattcagagggtcttccagtccggagtagagagttactaagaaattcaccacaatggaaaaactttggagatgaagattttgaaggacgaaaggatatttattaatgtgacttttggtttagtctaagaaagtaaagatcttagcttcagataggcacagcctcattatgcagaatgctcacatgcttatctcagaaataccctatttgacttgccttttatttttcatcctactcaactgctgttgaaatagagatgtcctcctcttccttcatttgttctcccatcctccactgggtcatttgtggtacattcagtgaagaacatgattttctgagtggtgtttccactattgatggtgatcacttgtgacttttcttgagctggttccttaatcttttctgtttcacaggaggatttcataaggttggaatgaaaaattgggtatgttggatagctttgcatagaaaggaataactttctaaaggctagtggtcattatggcatgttgcaaaaaaggggaacagacatgtttagaagtccactgaattctatcttgtacagaccatgaataaatatagcagtactgtaaatctatacagaaagattaaattgaaggctaaagaaggtgtcatgtgctacattcatatttttgaaataacatttttttcctagcagagaaaactacagttttctgatcttatctactatgtcagactttgcctggaaagattgactgtcttgctaaagttatatagaccttgtcggtctctatcttcccccttaccttttttaaactttgcaaaggaaaaatgtgaaaagctagagaatttcaaaacaatggcccctactgtagcagttagtgttgctagtttattgaaagttttgtagggtttaaattaagaacatttttttcctcttacttttactcctaaaggtttggcatttatcatagtgtttataatacaggttttaggagaaatgacacatttaggagaaagctcttaagtcatattgttttgatgtgataagaatatcaggtgtgcaaatgacatgaaaaaagtattctttccctgtttttgttatattctaatggtaaactcagctaaaatagagatgatttgtaaaca

SEQ ID NO: 116920 - DNA, 1032 bp, Homo sapiens
ttgggcagatattattaatttgttttgcaaataaggacatccggtttgaaagtgattcagcagacttgccgacagtcacatagccttgtggagacctgtaaggatgcttggtagagtaccataaagcctctctttttgatgtggcagataaccctgcgggccacccactgtgggaatggcttgctaccttcaactgaagagggggtggggtgctgaaagtatttcccccacaatggcttaggtgtactcagatccattcacaccccctttttcctgtagagagtgacatggatttcatttgcagggcagtccctgggattagagttgtattgtggagccactgaacagataaaatcagaaagggtgtatggtgcagtagtgcagtgaaacgagccatgaaccggaaggcaggaaatgtggagtctcagcatcttcattgtttaaaatgatgacttggtattagatgttgtctaggattatagatgaggatttagggccagagagattaagtggcagttccaggtcacccagctagttaatagcagagccaggactaaatagggagggtttgtattaagagaattagtaatgagagctagtagtgtcctttctccaactcaggcagccagctatcagcagttgtgttcctttggtaagaaaaacttcactatggtgctcttcagtaaaatatgataagaaccaaatctgtaattttaaaattttcagctagttgcatttaaaaagtaaaaaggatgattttaataacgttttatttaattcaatatatctaaaatattatttcaacatgtaatcaataaaaaattagcaattttgtttttatatggtcttcaaaatccagtgtgtattttatatttatagtacatctcaatttggaccagctgcatttcaaggacttagcagccacacatggctagtggctaccgtatcggactgcacagctctcaggttaagggctggttaaacacacactgttcaagttgctttgaaacatttcactgtgcatttgccact

SEQ ID NO: 116921 - DNA, 1028 bp, Homo sapiens
ttttctcatattctgtatctcttaaactatatagatctggtaagatttcaaagaaagtggtaaacattttctgcttatacatctacattaggttcactttttttctgttaaatcgattaatcttcctcttataaggcttaaaaggtgtctgactgttcaagaaggagggtccttaacactgatcccctctgtgagttggtgcttgggtgttaatagatacagactctagcacagttgcttttgtttttgtgcctcttggcaatggaaatctctcccctgccctcctgtactctgtgccaagccctggccaggacctgacgagacatcctgtgtccagggctcctttgtgcccaatcagtgcaaagccaggaggctttgttcctctacttgacagagtggttattcctgggccatattgacttcacgaaaatgaacatgactttcggggtgaggctgtaccctagtataggccagtgttttgtgaaacatttcctaaagttgtgttctctcctaaagtttgatctttgcttggtaggacatctgtgaaatacccagaccccttatatcagtttttattttcttatactcactgttgtaatccaaaacatgtctcagataggtctcaatcagtttaggggtttattttgcaaaaattaaggatcatgactcatgacacagcctcaggaggtcctgagaacatgcgcccaaggtggttgggttacagcttggttttatacattttagggagacagaagtcaggcaaagacataaattaatacatgtaaggtatacattggtttggcccagaaaggtgggacagcacaaagggaatgatggggttacatgtcataggggaatttaaagatttttctgactggcagttggtagacagagataaattattatataaagacctggaatcaatagaaaggagtgtctgggttaagataaggggttgtggagactaaggtttgtattatgtagatgaagtctcatatgtggccatctttagaggcaatagatggcaa

SEQ ID NO: 116922 - DNA, 1385 bp, Homo sapiens
ctctccactgtatacttcagtcctataataatggagccagtttatttatgggggcagtgctgtcaggccttgactgaccttgtcaaggagcctgacactgttattttaaacccatcagtggtgtgatagccagccctgattcacagcttgtgtttatggtttgatgattagaatctcatcctttggccaaggaacacagccacatttgaaaagctcctattgtgcaattcctgctctcttcgctggcacctaaacccagtcgccaggcctgttgatttttccctccagtatctcttgcattcatatgctcttctcccttcattctcccccaccctgtcactttcttttatttacaaatgttctctgagtgcctactgcatgctaggtaaggcgccaaaatggtctggagataaagtgtgagcacagcaggagacagagggagatagccattcttgagcagtagttggcaaacctttgctgtaaatgattaggcaataaatattttgagctttgtgggccattaggtctctgttgcacctcttggactctgccacagacaatgtgtaaaacaatagtggacgtgtgttctaataaatgcttaggcagtgactcagatttggcccatgtgttgtagttttccaaccctgttctagagggtgagggaggccgttaacaaatacacaatgtgtgtatgtgtttgtcaagttataactgctacgaagagaatggaaagctaggtatctttttgtgtgtggtggcggggggtgttcttttttatatacgctggtagaggaagcctcccccatctccagacagtgggggaaacaaatcataggatacctgatggtttgaagggccttcctggtgagggagcacaggtgcagcgacctggtatgaccatgtattgggcttgttcaggttaacagcagggagccagccatgctggagagagccggagcaggtgggcaggcagtctgagacagtgccgagagaagagttggtaggggggtcaccagcagacagggagaaagggctccccacaaagaaagtagcttctttgaaggtttgaaggggtctgagaagctgatctgctatgggaaggtagcagtttagtttggctagagagcagatgagatgggatactcaggggtgtgagaagactgagattagtaaagtcagcttcaaatgtcatgccagaggaatttcactgtattcatgggcatattttttaaggcaaggaacactgcttgtgttttagaaaaggtgacacatggcattttggagggtaagaggcagggatgtggatgggaagaaggttgaaggcctgacctgaacctaaggggatggaggcaaggcgagcgatttaggagatatctcaccctcag

SEQ ID NO: 116923 - DNA, 1036 bp, Homo sapiens
atgggacaaatgacttccccaatataacacagctggtaagtaccaaagttgaaattcaaacccaggcagtctggatccagaatctgaattcttaatcactgtagtaccttgtctccatactatatatttcttcttaagcagaaggactgagaaactcatttttagctgcctcttaggatgtgtttgaaattatgaacctaaatttgaccaagtgtttttcgggggctgttgggagaatggaatcaattaatgcttcaaagcacttgagaacccttaatgtaaaaaactgttatggaaagtgtatacctctctgtaaagccaactgtctgttattcccaaattcttatttgtgctttgtatgctagttgcttccaaatgggatctatttctatcggccacattctgaatatgacacttttcatttaaagtcagttgtacattatagaaatcctctaagaaacctgtttagaaaccgttctatccaaagtactttgcatagtttctaggttataagggatttgtttatggtgacaagattgactgctgaaatgtgtgcttgggagtgaatgcctcagaagtgtagcaatttactacaaaacgtgtgtatctgtgcacgatggaattttcttactttgtatgccagtctgccaactggcagcataaaagtgacctacgagagtctcagtggtgctctcttatgaagtccacccctttgggtctgatctgcttacttcttcaacccaggtggccatggaggcagttgctcctgctgctggctgctgactgctgactgctcttgctcgactaggaacaatagaccctcagctctaatgcatttcacatgtattggattaaactggtaactaatgcatcacgtggggaaattggcctggctgataaaagggccttgaaaatgtgcctggtgcttttgcaactctgtaaaatctgccaccagcacacctacttgtcaggactgcctgttacctccagcccaccacactggattgtgctgagcacaatttctatgaataaagca

SEQ ID NO: 116924 - DNA, 1088 bp, Homo sapiens
gtttactgttgaggttcgttttctctctccataaaacacctgaatacttcattagtgtctgatcacattcctcaccctgaagtgccttactttgcagatttgccgtgagctcacccctcccccacctgcttccctatgtgagtttccccttcccctgcagtgtgattcaggggacttcccagatgctttaggttttgtctgcaactagaaacattcagaattactgtgttttaaaatcgaactttctaacaaaatggcttcccataaagtaggttttggctacgttattatttatcatatctgaaaatgattatttagaaatttgaggactgtgttcttggagatacaaagaaataaaaagccatggcttttgagaggtttataggctactaggaaaaatcatatatactgcataactttaatacaggcatgatgtggtaaatggacaaaggtggaggtgtcgcagatggtttcatgaaggagaagacttgaggaggactttgaaagctgggtacggacttcaactggcagagactatagagtgaggataggcaattcaggtggagggagtgacatagagaaaagtgtaataggtagggcacatgttggcttatcttgagcatttgagtttgactggagtggaggcaggttggagataaacatagactgaggaattgagccacatagtagagaagctcaaatgctaacctaaacagtgcagatatggtaagcagtagggagcctttgaaggtttcccgtagaggaaggatgtgaggattgggtcctgggaggatggatctggcagtgagcaataggttgggtgtattggaggggtcgagacagggcccctgtggctgggtagctggaccggagagtggtaatgctgaagctttgtctttagagtgctggaagacacaggggatgcccctttactgtggctgctcaggtgcttgacttaaacttttctctaattttccactagttcacattctttctcactgctgtattccacaaatattcaattatgttctaaagggaagcccaaagctcagacagtgaaagggaggaagaagagaattctgttaccg

SEQ ID NO: 116925 - DNA, 1026 bp, Homo sapiens
gttaaagttgagaaccattgttctacatctgtactatttagcatggtagcttctagccacatatgcgtatttaaacaaatgaattaaaattaaacaaaatatataaagattgagtccctcagtcatacctgacacttttcaagtactctgtagacatgtgtggctagcggctgctctattggactgcatattacagaatatttctgtcatggcaacagttcggttgggcaatgctgttctacaccatgctgtctcccatccttcacactgtcgtcgtcttcgcccctatgatctttgccactactttttatagcagtttgttcacatggcctaactttgggccatgtcatcacctggaacttgttttgctttgcaagattttttaactcatcattcctctttgaccagaactttctgtcctgtccgtaaatgtcaccctctctgcctgttttcccactatcagcttcctctaggtttcatttatcttttccatgccattttggaccccatgttgttctggacatctccttcagtgtctttctttttctcaccacacccatggtgggcgtctcttgtgctgaatgtgaatccatttacattctctgcttctttgatctcattactgctaaagaaaatcatctaacagtgtcagcataatttttcagtctcattccgaaactcaaatctgcatggcagtactctcactcattcttaggcagctctctgtttgtccctatagcagctgttataggcttttaagctccctggtatcctggtcttcccactcctcctcggtctcagcaaatgatctacaggcaatgctgcacaaactctttgcacctccttcccttcacctctattcttgcccttgtctcagtgcagaggccctgcctctttccaaggttcacttctccagttggttatctgagccctgtcttcctgtaccaggggactttgctcaagtctcctatcctaaaaaaaaaagtatactttcttgacctctgcatacctgtaaaatgatgtcct

SEQ ID NO: 116926 - DNA, 2064 bp, Homo sapiens
aaagtggtaagttagacagtgatgtaataggagttaccacccttaagtatcaagtttttgatgatagtattaacctctacagttctcccatggatgcagtatttattttggttttctgttgtggtagggaggggaagttcagtcttccagttggtcattcctatctgttgtaatagcccatattccatcgtcagggagccattgtgggacttctacccacaatgtggagtacgtttactgtcaagtggagtattaagttttatacaatccccaccttaccccccttccaaaatttaacataagttatctctcaagtaatcagtcaagtaacataatccagctacccaagtggagtgtatttactgcaataatacattcaaaaactgcaaaataaccataagaggggttcgtggacttactggatccatgagatgcgagaggccaaagcttcatgaatcacttgaacacagtaaactttactttgactgatagaggcattttagatccctaggatctagtgaaactcaacctttttaaaagtagaaaagtaaggattctctgaggcagtaaaagcaaatagaatgtgtatttgttatggctttgtttccagttctaagatctctcagtatatctctaagaagagcatccctgggggatcactgagggagaagaggtgaaggagtggaattctccatgggtggtgttcttcggcaaaacatagttcctgcagagtttgtggttgtatcgggagagggttcggaagagtattgttttccacattcttagtggtctcaaacctcacttctaatgaggaaccagaaatgaactcatcatattggaaattgtgttccaactgtgaaactcaacttgtgctgatagataaacacatttagcgctccagaagcctgtgaaacctcattttgaagtgtgaaacatgtttgtggaaaggaggttataggtgtttctttttctcatgagaaggatctttagtctgtgaagaaatttcatacttaatttaaaaaattattttggtaaaaatctgaagatagtggattcatctgaaacccttgatctgcatgcactgcattgcttaatttcaaccattttagttgcatagaaactatctttgaaatagctttcggtttctagtggtttacaagttccaagtaagtgagaatactttatcatgtattttattttgcaagttaatgaaatagattatatttggtagtgacaaatgaaatttgagtataaatctgtgttcatgtctttatgtgaaattttagagaaacaacaaaactgcaacctaaggcatttgttggtcagattttcattcctcctgcctttttctggtcctatttcaatttttttcccccttcctccttttgtttattttggcaactttaaaaaaaatcagataaaatacttctttccagagttacacataaatgtagcatactgtcattattaatgctattaatgctctctgagactaataaaagatgtagttaaaatgcaaattaaataggttttctagtagagtcttggcatatggtttgcaaagactacaacatcaattaagccaggtttgaactagatcaattgtgaatcataaagtatatactgttaatctgtggagaaatgactattactgtggaatccagattcaaaaatgctattttcattcatgaaaaatcttttctggatggtgtttgtaaatggggagctagatggcatggggaaacacagaaaaacattactcgactgataacttatgttaaattttggaagcgaggtaaggtgggggttgtataaaactgaagtaatgattcctccacacccttccttatctaactaaattttgactttctccttaccacagagcttccctcatttttctatgcctatctgcagtgttgccggagagctgagtctatattttcttgtcttatcactatctgttccaggttgtttattttccctttattacttattgcattattttactttgtccatacactcaactttgttaatttttgacttctagctcccacctcaacatag

SEQ ID NO: 116927 - DNA, 1015 bp, Homo sapiens
ctttctattcccgttgtgcctttccatctattcagtcttccagtgtcatgtatatagtatctttctttactctaatatccagtcaaaatgactgaatctgtaacctaaattttgagctgtgtcctgtatttattatcctaaatatgggattaaaaagaaagttgatacaatcgattcatttaaaactttcttctatagtctgtcctgaagttagtgctcattccaatatcttacatcttttgcagatcagagcctgacggttacatccaataatattttgaattaaaacaaactgaaatattctgttacccagaaaacctcattccccgagcatcctttttaataagtattgggccatgtagaggaaattagaattatttttttctttcttaaaataattactataaatatgaaaccttttaaaatatatggaaatcaacattattaatttttaagccaatgaaaatttattaatgaaggtttgatgtcccattggaaatgatttagcattagacaggagtaatttgctgtaagggtattttatgtaaggtttgagccattttgtaggctgggtttacaaggttagcacttcagaggctgattatttcttcactgtacatttccaggattcagcatatgatgcccctcagtgggtgataatgccttcgttatgtctcagtacaaacagctgtgcttattaaagatgtgactaacaggctgaaaggatgcagtgcatcacttcattccattatgcctttaaaaagatagaatgctagggcttaatttttaaagtagttagaaataagagtagttgaatggactaattaaaccatattaaaaatttaattatttggctaacaatgagctcacaactatttctgaaacagtaaaccttagaggaagaaaggagtaatgtcctagtttcaagtaattcagtgcatgttgcccacattatttccagaaacatcctaccgatttgaacacccactaggagcttgtgagactgaaaccttat

SEQ ID NO: 116928 - DNA, 1027 bp, Homo sapiens
cttcggccatgatcataagtttcctgaggtctccccagccatgtgcaactgtgagttaattaaacctctttctttcataagttacccagtctcaagtgcttctttatagcagtgcgaaaatggactaatacacccagtctcaggtatttctttatagcaatgcaagaacggcctaacacataaatgtaatctagggctggtagtgtgatattgaaccagtgggagacatgatgggcccatggagaagtgtcttgaatttgactttgaaggattagtcaaagggggtgaagggatgcccactggagctcctaggtcagtgggctgctggctgagcccagaggcaaagaggagtatcagcttgcatacagttggtgttactaggtaggtgaagggcctgaagccattaaggggatttaagacgtgatgtgtgataggtcaaagcagagaagaaccctggtggtatttaaggaaattaagctggcagttaccacctgcaggctggattagagctttagggagggaatctggagtctgagaaagtgttatgtgtggtgatgagagctagaattcagcatggaagtggagtagagaaaaaaagatagtgaggatgttttggatagtcattctttaaacagatatatttcgagaaccttccaggtgccaggcagtgggctgggccctggatgcagccatgaagccggctgacacactgcctcccagtatggagcttacaacttagtggggaacctggatggtgattacacaggtctgggaggatatggttgtggtgacatgagagtatacaacaggggaatctgattgaatgggaggggagccttcctgagaatgggatgtttgggctgaatgggggtgacaggaggcagaagttcaaggcagagggagcaacctgagcaaaggtcctgaggcagaaacagaaagaacccagtgtggctggggtataaggaggagaaaggaaagagctggtgatatgtgatgatcatagcaggggagggtgtattgagaggaa

SEQ ID NO: 116929 - DNA, 1115 bp, Homo sapiens
tttgggtggagaataaagcatatgcaatccatatacatatttacatatttgctgtcacatgattctggtatttttggtgtatcagttcacatgggtaacatttttaaaaattctttaaaattaatgagagaacattgagaattagtttcctcttatgtaggaacttttagttcttcactgagtgaaggatgaagaaagaattcctcagatcctgggtagtgaatacgttaaatgcatgtttgatgcaagtgtttgatgattaggataaatggccaagcttttttctagctctgaaggtctgctggatgtggctagttttcaagcctggaggtagtgtctgtggcttacctagtctggagtcacaatcaactttttattactcaggttctgcaggttactgtgactttttcatttcctctcatagataggggacagataggggccaggaaaatcagtgaaatttcctattttcaacaatgtggatgcttgtttggtagggaaagaagagtgaagctgtttgttctttcttggactcatgagtattttgattttttaatgactcattttttggaacttcttattttcatcattagggctacttcatagagtaagaccatatatagttaaaagttatccagaaggaatagggagccagtcagttccatggaagttttaacagtacttgcactcaagatattttgtgtctccatgtgatgtctaacacccagtggtgttcagtaaatgttaatacctttgccttcttgacactagtcaggctgttgtgggggatacaaaatgaacatacattaaattagaacaacaaaattgatagagtttggatgtttgtccttacacaaatctcatgttgaattgtactccccaacactggaggtggggtctggtgggaggtgtttgggtcatggggttggatccctcatggcttggtcctgtctttgcattagtgaatgagttcttgcaagacctggtcatttaaaagtgtgtggcacctccctctgacactttctttcttgctcctgttcccactgtgtgacctgcctgctccccctttgccttccaccatcagtaaaagctctctgaggcctccccagaagcca

SEQ ID NO: 116930 - DNA, 1035 bp, Homo sapiens
gtttttggattttagatttggagaagagatttggcctcctgaaagttgaaagtgaggccttgtgaggatggactgtgtctctgaaggccatgcagcatggagaggtagcatgaacatagagaagggagttttgtggaggaagacgggggatctggggaatgcttgaactagcagtccctcctgtgcaccaggccctgcacttgatgcagggcgtgaagaggtgaattagattgcttctaaccatccggaacttaaatctagagttatgctttgagaaataatcagcttgatgaaaatacttttcattgagtgtctacaataagaaagaaaaagtctatgtagtggaagaaggagagaatatagactccgaatatctggattctgcttccagctccttcatttcctagcttggagaagtcacttaatgttttgcagtcatagtttatccatttataaaattaaactgatgctaatattatcccattaatatgacaagtattgggaggcttaagggagataatggttgaaaaaacttacaaaatgttaaggtgccatagatttttaaaaatcattatcttgtggctccatcatttactcactgttggcaagttaactctgtgcctgagttttgtcatcagtgaaatgagaataacactatctgcatcacagattgttgggagagttgaattaaatagtacatgtaagggcttagaatagtgcctagcacatgataacatggtaaatgccaaatgtgtgttagctgccattattatatagtcatataatgccatgcctcatgagagatgatatagttagatagtgctgtgccttatgggaggtgaaatcatgacagaatgtccttagacataggttctaagcaatgaagcaaggggcagtttttcttagaaggcttcttaatgtttacatttgcatttgccgattagaaaactgatttattgcatggaacagagcttactttgaaaacaacaaccagctttctctctttttttcttcttcctccttttttgatgtcaa

SEQ ID NO: 116931 - DNA, 1814 bp, Homo sapiens
cctggccgtattggtcatttgtatatcttttttggagaagtgtctgtttacattgtttgccagtttttaaaactgatttgtctttttgagtataagaatttaaaaattctgaatgcaagttccttatcagatgtttaatttgcaaatattttctcccatttgggtcatctttatactttctgaagggttccttatatacccacaaatttttgattttgacgaagtccagtttatctatattttttcctatgttgcttgtgcttttggtgtcatatctgagaaaccattgcctaacctaaggcctgaagatttactcttatgtttgcttttaagatttttaatagccttaggtcttacatttaggtctatgacccattcttcatttgcacatgtcgcaacaccatttgttaaaaagactgtttttttccattgaattgtcttggcacccttataaaaaaaatcaattaaaaataaatgtgaggagttaactctgggctctgaattctatcccattgatctacatgactatctttatgcatcttgtttatttttactagttccttggtaaggtagatgtgggtaattcaacagagaaaacattcctagttaaaaacatttaatattttgagaaaaatttcctgtaaacttcctggagcagcgacactgtatattttgctcactgttaaatcttcaagaacctaaaagaatgccaggcacgtggtggtgctcagtaaatatttgtcaaaagactgattgaaggattgttttagtcctgctgctgctaatgcttttgtaacttaaaactgtgcttgaatatttagacttccaaaacttttctctataagctctgagtgttgttatttatgttctgttaaggatttggctttggttcttgtaggatttttctgtaaatcacttggtggaagactggaaaaaagggtatttgcataggttttatgaataattttttggtaggtttgacaggtgaagatgttaatgtcatttaaatatacatggattttcatctattatcttgaaacatatttagcaggttttagagtgcaatgtgtgctgctttcctcacaggaaataatgtagacagctggaagactgcttctaaacacacacacccttcccacctccatgacttcctttcaaccttgaactttggggatttctagcaggattgtaggttaaggcatttggagcagctgtggctttgtggaattgaactacaatcctctatgactgagggaaattgtaggaaatcttagtggtatcaaaactggcataatataagctttacagtcttttctggatggcacattttaaaagtcaatagtattcaaacgcttgaaaaatcccaataaatgtgtgggctactgctccctttgtcaagagaatctcaagcattcagaatctagataatgtggtagcttcacaaaatctttcacacgaactcgtttctgcttgtcattgctttttcctgtcagccactcatgcttttgcccagtagttctactgtctgatcctctgcaccaaagctgcatgcagtcccatatcctcagttaattcagccccacgatgctacccaaagtgcagcagacagccagggcaagagtgtggaagagctgacataattacaacagagtgggtttcagttatgatggaaagttaggcctgacatggacatttggagtcatctaatccagcccacactttctacaggggagggaacagagacttagcacatgggcctagactcttctctctggtttttctcttggttctttttttggtgctcactcactgtg

SEQ ID NO: 116932 - DNA, 1016 bp, Homo sapiens
aaactactgcaatgaaatgcagtctggattagggtcagaagagggcctctccagctccgcatcaaggagaagtcttcacaaaaaagtgaaacctaggcagaactctccttcatgagagctgatacatcactcaaacaaaaggaggtgggtggggctttctacacacagaaaaaggtgagagggaatgtggaaaattcagagactaggaagcagctccatctggctagagtatcagacaagtatgaggagatggtgggagaaagaatagaaaggaggttgggacttgaaaatgactgccactcgcagctaggaatttaacccaagcacagaggctgactagacattaaagtattctaggcaggaggcaagaaagagcactctagatgcaggtggttaatgctggaagcaggggccttgcagggattaggaggccctgcaaattgtccagctgagaactgagaagggcctgaagtgcagcagcaatgaaaacaggggaaaagaaacaatttggaagatgtttaggaggtgggaattccaagacctggaaggatgtggaaacttaaggatcctgacccaagaggtagactggacactgatggtgacaacagtacccacaactctcctccttccttcctgagcccctcccccatgtagccactggcctcagggaaactgaccccactcccacccagcttcaggaaagaccctttattcttctacaggtgatcccattgcccttatcgcccaagaatggccatgagactcattctagctaaaagactcaagggaagtctgctggaggacttcaggagaaagcctttctcctagaaaagactgtctctattactatcctacatattgccatatacaaatatcacctcttcatctctagaatttggccattgctaccacctgaggatggcactggctccaagatagcagagcaaggatgaaatgagagaagctgggaccttgatgtcactgacccgccctgaacctcctttccttgcccctgg

SEQ ID NO: 116933 - DNA, 1051 bp, Homo sapiens
taggaacgacaccttctgagccctcgggaaagcgcatttagtaatgtggagtcctcatcttgagggggactatgtttcagcggttggttagaaagtgctttgtttagagaacagtgggggccgtgagtgagggtcaggttgctgagctagcccagagagactatttgagttgttaaatcactcaggttccaccttgaccttcatcagacctgtgtttgagaagcaggcttggaacctctgctgccttaattgcgacttgtcgaaattggtttttctctgccatcctcgctgctcctgacttagtttggccctttcacctgggccagcctcctaatgggagtgctgtatggtcaccatcagtctttcccctccctgctccctgtcctgtgttcaatcaaatccttgtctgccttgtaattactggctttgtgattggacaagtgattttttttttttttgccagccccagtttccttatctgtaagctgaggggcatgatatctgcctcataggatgactgtgagaatttgaggaaagaattttaggtacataggataaaaggtgctcaataaatgatagctattagtatgtatgatatattatttgcaaatacatttatttctgaatttcagtttgggatatcgaatctctgccacccctgcctaaggttgcacaggttctccgaggggtatgagtggttgttagaagtgggagagcagtggtgatttgatattcatatatatttgtcagatctgtctgtaggagaaatagtatcatgttccatttgtgcatctactcacattgcctcaaccaccactagaatgctgaaactccacatctgtacctgtagtcccaacttccttattttctggattctgatcacttactagattctgcactagatgcctaagccagccatcactaccctcctccagacctgcttatcttcctgtgcttccaagtttgatgaatgatctcacactctatcagtaaagatgctttggtcaccagttatggagataccattgcaaactacttgaacatgaggaag

SEQ ID NO: 116934 - DNA, 1982 bp, Homo sapiens
cataggctctaaagtcagattacctgggtttaaattttggcaccgctaattacttactagccgagtcgtttctgagtttcagtttccccatctgtaaaatgaagagaaatgatgtacagtattcaccttctacattcatgctgtcttgcacatgataagcacccagcaaattttaactttattccacctttcctcctcttctccttgttgtagtggctcattccttcctagagataaagtccaagcttcattgtttgacttagcaccctacctgatctagccctgccagtccaagtgacttgccctctaggtatgcagaaactgctcacggtttcccaaatattccagattgttttgagactttatgcatgagattcctgctgattggtgtaccattttgtttctccataaacacatacttatcggaagcatccttgaatcaagtgtcccatctgctaggcagccttcacttctgcctgaccaagcggaggtaggtgcctatttgtgcctcacacatccctgttacagcatctgtcacactgcatgcattatttctggacacatctgtctcctccagcagcctgtgagctgctacctgtgatccccaggagtcagagctgtatacttcatgtggtagatgcttattaactataatttgatagaagaatgagtggagtgttacagctggaataggctgtattgaaaatcttctagataatggagttcctttgctattttatttttactagaaaagaccctagaataaagtgaatcccactgtgaaaaatctgttgtcaagatactctaatttttgtattgataatgggtagaaaatgagacggtgcagtggactgaatgcatgcagtacattgaaaagctgactagcagctatttcagaaaacatgaatcacaccgtttttgtattttgtaagtaccaaatctttctcttctaaatttaatgctccccttccaacctgagtctttccgaagaagagcatatttcccaaatggaaaatagatcctcatactttagtgacttttcttccttgtctcccattcttgaaactgagaaccatgttggttggtttcacagtgggggtttatgctattgtgaaccagcactgtaatttttaatcttgctgaatcacctgtgtgttactcttgaagctgtttaaacctaatctgacactgctctaaggcttactggaaaagatggtgtaaatacattaaatattgggtttttatgaaaaaattatatttttcattctgatgcaaagtgtgtttgtctgcaggcctgttgtaaacatgacaagtcagagatcaaactggctgcatctacggctcctgcctctctgagattgactgctttggttcagctttatctctgacaattttaatcacatctgaagctcctgcatattgctcctggtcatcctgctttgggttgtgatgactaaccaccgtttgtttctgcaccataagttttgtttccacgtttcatatgttaagattaaacaggcacctgttatcacatgtcctgggcatagactcagtgtgctaaattcaggaaccagtcagtttactttgtgactcaaaaaccttgtaagtacaatttagagtgtctataccattgtaaaaaatgtgattgcattcctgtgtcctctgagccatgcatgtatttcctgtgttcttttttaagtgaaatagtcattatgtcttaatgctgcgtattgtgaatccctttctctataactacacactcttgcaaagagattcatcaaggtctggaatagttccttcggaggctgtcttaatgatcgctgaagacataaagggcctgcagcccttccaaaatgtgtgagaagtttgttttccagcacaggatattgacatgccaagaggaagttagaacaagagagatggggacaggcagggaaaacagagaagtgctgagcgatagctcacacagacaataaccaaaa

SEQ ID NO: 116935 - DNA, 1037 bp, Homo sapiens
caggcgcgtgccaccacgcccagctaatttttgtgcttttagtagagacggggtttcaccatatcggccaggctggtctcgaactcctgacctcatgatccgccagcctcggcctcccaaagtgctgggattatggacgagagccactgcacccggccggatgtggagcaatttaaattctcataatcctggagtgcatgcaagatggtataaccactttggataagttttgtagtttcttaaaaagctgaacatagaccttccttaagattttggaggaagactttctctgcctatccagagaaacaaattaacaagatgctattcaaacactttttcccaggaaaatcatatagttttcaacatgtgcataacataatatgctctatttaaagctttgcatcaaaggctttgatctcttttcagtgatttttgttttaacattttgttaaatgttaaacattaacattttgtcatgataagcctaggtagacgagtcaaatggcaaataaattcagaataaacataattctacagaaatatgcagggcttccatctgtgaaagactgcaggaatcctcaatctggaagaagaaatttcattttacgtaaaacaggcccccaccccttgctgaaacatgtatttcaaaatgcaaactcagaattctttttaaagcaccatattctttttagtaagatgtatttaaacaatcttctgtgatctttttataatcttacatttttcaaacttaagaaagttaactgtaatacgtaaaagaaagaagcctgaatttcttgacaatagatacataaataatttaattactaacatacctgagagcaacgcagcagaatcaccagggcttgttaaaacactgatttctggccctaaccccagggtttctgatttagtagtcatggaatgggacctaagaatttgcatttctgacaagttcccaggtgatgctaatgctgcagattggcaagcggactttgagaatcactgctctggagattgtctttcaaaaaaaatagttg

SEQ ID NO: 116936 - DNA, 1037 bp, Homo sapiens
tgttctctcttttctcaaatgggagttgatactgaagctatcctgttctcttgccagtattttatatgaagttgtatgacttggttaaatgggaagagcaacatttggagggggactgaatattacccagacaacctacacttggagctggttgaatacatagaagatacttagattaactgtctttgaggagttttctaggatctagctaattaatatccactgccactgtcatgggagaccactgagattcgactgatgttctggccacagatgctgactcttgacaccaccccaaagctgcacacactagcgtgctgccctcttctgagttcttagtgttctgaagctatgctgtgccctatgcctaactggacagaagacccctcctcctcaccctgcctgcatcctcatgtctcacagtgtctcagaatcccttatgaaaacagttcctttcatgtgtgccagtagccactttctccataggactcaaacccaaatttatggggctggccaaggggaacatcactgagactctgccatgttccctcacagcttctcctggcctctgcatcttgggcaccctgcctctcttctttttcagtcagcaaaacaaagcaaaccctcctggcaggcctgccttaccagttcagcagacaagcctggtcctgtctgaagcccagttatgagtcattgcagaaaataaactgatgtaagcattcctatattctatttaagaaagcctcaagggtcttggagtgattgagcagaaaagccaaagtacttgaaactgacttaccatttaatttttagaataatccgttggctttgagcagaggtggtagagaaaatttatttattaatgagtaagaggtatcatccataaaaggaaaacatgatttttctttatttcaattgaggctgcaaagttgagagcagtagatggcatgtacccccatattctgaaaagaggtgatagatcatctctatagtacttgctaagaggtgactccacactgcctctgttacttcttcta

SEQ ID NO: 116937 - DNA, 2025 bp, Homo sapiens
tcaccctctcccctccccgcactccccattcaggcctccagttggcccctggctttgcaggtcctccattctcacgcagtggatgggggtcgcgacgcccgccgtcctccacctttcctggctgctgctggagcttcgcccctgcaagtggtgccccattcgcgttaggtgggtgggtcgtccgcccttcccattttagtcgcttccccatcttcctcgtttggaccctcttgcttcctctaaaagttttaaactctctgcctgggaaaatacctgatagcccggcatgtggagttacaaagaaagggctgttatccaaaggccggtgaattttgttcactttgatgggagaatcaagtccccaggagccttggatggttaggtcagagtctgactccttgacccaccaagtagaggaatggtgcctctgttggcaaatgattgttcatctaaatcattcatttttttcggctgtaggaaatctttggtctctgaactgttgaggtgggggcgtgagctttctagatctagtgaaagaattggaaactgttatattcgttttaaaaaagaagaccttatgcagtacatgtaagacatcacttaatggtacaagcaaggataagtgatttattcttttattcagtgttagcttaaattgcctactgacgtcttagaattccatgttgtacaagccctttgtttctatttagaaaggactaaaatggagaaaagctttttaagttcaaaacttcttaaattgcttgtattctcgattgttgttactgttcaaccctccttaggagtacttgatattttctatatgatttagtcttgtgccagtctcagtactccctcctttattagtggagcaagggtagtcagaattactggtgtaaaaaactgtcctaaataacgtagtaccttgccagagtctaagtgcaaaatgtgggatcaaagcggtagtggaggaagttgccatggctaatttttccatctttccctggatggaagggttggataacgtgtcaagagccccaaaattgtagaagtgagattaaaaatataaatgatagcttgccctttgaaattgcaaatgggtggaccttttttattaacattaaattgagcaatatcgttttcttgaagttatgctagatgttctccaaagttgttaagcacaaactatgcctgctgtattagaattgtatgttaaaaatttttaacgtgtgggttataaatagcctggcagatttgtttacttttcattctgtctcataacacataatctatttttccctttactgtggacttttgaccttttaatgcatttttaaaatttagagatagaattgttcagcttaaaagaaggaggaatatttttatgtttgcttcttgtatgggctagttcattcgttgctagccttcacttttctggaaccagagcctgtgtgtttttagagctggttgtctctgaattctctgcatacagtttgaaggggcagtagcaaagcaggggttgctgagccccaatcagtggctcactgcttctggcaaaatgatttgtagctctgtatcaaaaaacatctgaccacaaactctttaaaacctctcactttggcagggtgtggtggctcatgcctgtaattccagcactttgggagaggccaaagcgcatggatcgcatgagtccaggagttcgagaccagcctaggcaacatggcaaagcctcatctgtacaaaaaaaaatacaaaaataagccaggcatggtggtgcatgcctgtgattccagctacttgggaggctgaggcaggaggattgttggagcccgggatgtggaggttgcagtgagccaagattgtgccattgcactccagtctgggtgacagtaagaccctgtctcctaacaaacaaacaaaccctctcactcttccactcttatggaatttggtattttttcctttctctctctctttctctttgtgaaccttctttgtctccctgttcttccaacccattaccctaat

SEQ ID NO: 116938 - DNA, 1052 bp, Homo sapiens
gggacatcagagacagctatgtgaggatattggtcagtttttatgccagttggtgctctctgctgggtctctagtgttgtgttccttttcttctcatttcctcaggtttttatagcaaataacttaatctcttcctttgctgagaaaaatctcaaccatctgaggtatatttccacttcacttttttcatctcagtgtcatctctttatatatatatatctcagaggaagaaatgaccttctttcttttcaagagcaaccccctccctccagatgtgtccatgtaccctttcccatctttctttctctagaaactgtccattttcacttcctgtccaccttcttcagcctctccctctctagcctacatagatgcttgtatcttctgccatataagtgtgtgtgctgttcaactctaggaggacgttctaaagcttgagtctgctatgccactgtatttctattcttttctttaaagacttattctttcatcccaggaagctgttatagtaggaagaacattgacttttgagcaagatagaacttttgatctgggtttttgaagtcttttaaaaccactttagtagctgtgtaactgtgggtatgttactattcagatttcattctgtatctataaaatatgttatacttagctcacagggtggtggttaaagaaattaatacatgttaaatgtccatccaagtgtttggtacattgtagagttcttactaaatgcttctgtgctttgcactcgtactgcctttaccatttcaccactgaaactactgttttaaaagttatctgtgacctccgaatcaccaaatccaatgacgtttcctctgtcatccttggtttccttagacccaggggtccccaaaccccaggctgcagacaggtatcagtccttggcttgtttggtgttaggaactgggcagcatagcaggaggtgagcagcaggggagcaagcattaccacctgagctccacctcctggcagatcagtggcggcattagattctcatagtagtgccaaccttgttttgaactgcacat

SEQ ID NO: 116939 - DNA, 1336 bp, Homo sapiens
ataaaaaaaaaattgccaccaatgatgttcatattatagccccttcatttatttccaaagaaagagagaaggccacttctcctagccttttcccaagaatcctaagctctagtttgattaaacaaacatagatcatgctgccaaacctgtaacaatatctttgtctagagggatggaattatcctaagtggcttagccagtggagtgaatcttacctgaaaatagagactgcaacacaatacggggaaggggtggatcctggggaagtaaccagtgtcctcaaggttccatatgcttttcactgtgttctcttggtgatcatatcctttatgatataaaccatcatttctgtggggctgtttcttggttctgtaactccctacttccatttcctcctgtatatgtctatcttatatatactaccctaagtttaactcatactaaactgagtcagtttgatctcttcaccaaccctcacctagtgtgtgtgtgcacatatatgttttgttgtttgtgagaccgacggggtttcactctgccacccagactggcatgtagtggcataatcacaactcactgtaacctagacctctcaggctcaagcagtcctcccatctcagcccttagcctcctgagtaactaggactacaggtgtgcatcaccacacccagcccttttttttttttttttaagcgaccggggcttgctgtattccccaggctggtgtcaaactcctgggctcaagtgatccacctgggattctcaaagtgctgggactgcaggcatgagccactgcacccagcagcatgtgcgcgtttgtattcctcttcccccgatttctcttttctaactacctctctctcaacaacccagtcttgaaatctttcagaaatcttggttcttctcccactgtcaatcacgtgtcagatcttgaatatatcttgtttagttaggcccccaagttgtataatacccagttaacattgatttaaacagtatctcgggctaggcgctgtggctcacgcctgtaatcccagcacttggggaggctgaggcgggcggatcacttgaggttaggagtttgagaccagcctggctaacatagtgaaaccccatctctactaaaaataaaaaaattagccgggtatggtggcaggcgcctgtaatccccactactcaggaggctgaggcaggagaatcacttgaacccaggaagtggaggttgcagtgagccaggattgcatcactgcactccagcctgggtgacagagcgagactccatagcaaaaaaaaaaaaaaaaccagtatctcacataaaaagtccagaaatggagta

SEQ ID NO: 116940 - DNA, 2436 bp, Homo sapiens
aatttttttgtactttgagtagatacggggtttcaccatgtttgctaggctggtcttgaagtcccggcctcccagaatgctgggattacaggtatgagccaccgtgcccagcccctactcatacagttttgttgtgcattttaattcattcttattttttctctttcttcctcattattgttgttgttactgtttcatactgccaatattttatttaagttaatgcatgtctttaccatctttttacttttcgtatgatcttgcacttaagattgctttctttgattttgaaggatctgaaacacaccctttagaatgtcctttagtctgcttgaaaatgtctttattttatctcagtcttaaaggatatttttgctaggtacagaattctaggttagcagtggttactttatttcagcacatttcattgttattgagacctcaactctttgtgtctcaacttttaagataatgtgattttgtttggctgcttttgagatttttatctttggctttggctttctgttttactaagctgtgattaggcatcggattctttgggctgtgtgaatatatggattggtgtcttatcagtcctggaagtttcttagccattattttttcaaatattgtctttgcttcatattctgtctcctgtcattttgggactagtttagtatgttaggccttcttatcctgtctcttacctcttttctttttctttttctttttctttttttttttttttttttttttttttttgcttctttttgacctcaaggcattgttctggatattgcttcagacttatcttcaaagttcacattttttttttcacctatgcctaatctgttattaactcattcagtaaatacctaatttaggttattttttagtatagaattcttatttggttcttttcaaaactgtatcactttttacagttttcaattttaagcaaaaatatttaagtgtggcctttatccccttgaatgtagtaagcatagttatttttcagtttgtgtctgataattccaatgttgggaagtctctaggaagctgattcagttgtgttgtagaaataaattgatgtatataatgtaagatgaagttaatctttctctaaagaaggttttcatttgctgtcaccaagtgcctgggggtgtgagaacatcttaatgaaatttcaaatctttaactttcctgggccacccagatgagttgaaactgacttcagtccatggtttccttctggttccttctttatttctaggttgcagccctttagggtctcagccggaagccaatgctgttttcactgcagtcctcacccttggtgggtctcagactctggctttggtcccctgtgcctgcaatgcaggcaacaaacaaccaagctcagcctcttaaatgcttctttgttggcaaactcacaaaaggcaaaagctggggtcacctttctgggttcctgacttctagtggatttgagcttcttattcattcctcgttattttgctggttatttggtgctgttaagatcattttactatcttatctagctttttaaattgtctttgtaaggatacttggtctgaataacctggtctgctgtttctacgagtgtaagtccaaatatttctttgactaacttgttcagaaagactggaaatttctacattagccattcctttgtgttagggctcctttgatggtgcaaattagatacctggaaaaggtagactttaagctatggttgccttttaattcctttaaagttaggttagttcctaggactttgcaaagccctaagggaaggagacagaggatattttgtatgaccggagaagcaaaaaatacttgtatgtgagtagtgccttagggtaggaattatgtaagcaaatagaatgtaatgtgaacatttttgaagtgggactgtatggaggagggagaatgtactaaactgaggagggactgcagacaaatttgtcttttagtatttttgttggaagtaggttcattttcattctttccttctttacttcttctttcttttctttctttggacagagtcttgctctgttgcccaggctggagtacagtggcacaatcttggctcactgcaacctctgctttctaggttcaagcaattctcctgcctcagccctccgagtagctgggattacaggtgtgcaccaccacgcccggctaatttttttttttaatttttagtagaggtggggttttaccatgttggccaggcttgtctggaactcctgacctcaaatgatccacccaccttggcctcccagagtgctgggattacaggtgtgagccactgcacccagcctcattttcaataataattctttttttttttttttggagacagagtcttactgtgtcgcccaggctggagtggcgtgatctccactcact

SEQ ID NO: 116941 - DNA, 1087 bp, Homo sapiens
gtaagagagtgccactcggttctgttccccagaggaagtcactgttgtttcttgagtgttcaagcagcatattcttaatatcagaatagtgttagaaacaaaacagtttcaaaaggagaaggaggggccgggcacagtggctcacgcctgtaatcccagcactttgggaggctgaggtggatggatcccttgagtccaggagtttgagaccagccggggcaacatggtgaaaccccatctctacaaaaacatacaaaaaaaaaaaatagctgggctcagtagtgcaggcctgtagtcccaggtacttgggaggctgagttgggaggatcacctgagcccaggaggttgagtctgcagcaaggtgtgatcatgccactgcattccagcctgggcaacagtgagaccctatctcaaaaaaacccaaagcaccacatatcaaaaaaattcctttactatggaattcccaagtattttgttgagaaaatctaagtatttgaattaaatagcagaccttcttcagaaaaagattaggaaaaagcccttaccgtagtatatgaggtacagactggttcaggatcaagatccttattaatagcctgtgtctatttgaaatgggagagttccctgacccctgttgcaggatgtgcaacaggggagtggctcatctgttcaggccaccgtccatgctcaaaccccttatgggagggggagcacacagacgggcaggtgcagaagccggggcaagtgcccctgggctccggccccctggcagcatccaggggtgggagcctgcagctcctgaagcccaagtgggcatgtgttacagtgagcccctttagccttgcagacgacttaagtgttaaccagctaagtaccctcctggtacccaggtccttgtctggcatccaggaagattcaggttgtacacggacttgaaggatgaatgcatgggttttatcgagttgtggaggtggctctcagtgagatggatggggagctggaagggggatggagtgggaagatgatcttcccctggagtttggctatccagtaggcaatttcctctctgaccatccccagccaaact

SEQ ID NO: 116942 - DNA, 1031 bp, Homo sapiens
ctcagcctcccaaagtgctgggaatacaggcgtgagccaccgtgcccgaccagtgtattttatatgtggctcaagacaattcttccagtgttgctcagggaagccaaaatattggacatccctggaaaacactgcataccttgaaattgaagttttaaccgattaggacatgttaagaatttagaaaaataaagttcttacgcacagttttttctaaatcttttgttaattgggtaaaatggttgccagaggtgattgtgttttttttttgttttgtcaacatcatagaatttataaacttttttataaagagtatgacttagttttttttttcctgcaatcatattttccagttgaaaaagcttttggccattacattcagctataaattagtaacagtgtgcatatgatttctgattatttttcctcttgagccagaactagaaactggtcctgtaatatctgtggatcttgttctaattatatatccctttttatttgaaatacttagtattttcattgcctatatggtgaattctgagttttttaacctaacacacaatattgaaatctctgccctgaaaaattcctaaacatccttgaagtctagttctgttactactttctctctgaaatcttttttgattacctagctggaaacgatctaatctcccattctttaacagtacattcccttgtattaaaacttcttctgtaaatgtcttagtcctcttctagattataaattgtcttactcattattgtatcatctacattcatacattgaacaaaaagcaccaagcactgttatagatgcgagggaaagagcagtgcaggagaatcttggttcttgtcttcatgggatttatattccactttggaaaacaatgatgagagagacagaaaattaaataaatacatagatagagcttttcagatctcaaatgcttagaatgtgaaactccatcatgtggtagaaagtgtgaggatagcaccagtgcgttgataaggtgatcatggaaggtgtgatc

SEQ ID NO: 116943 - DNA, 1029 bp, Homo sapiens
aaccgatggcctttccttggcacagggtccactgcagcatgccaaacgaggaggcaggggcgtcgtccccccgccccccactgcagcactggagatggatttcctgtacttcggatccagggtttttgacagaagaggaagaagggggaggggtagaagtgttaaggggagtctgctgagaaaagctgtttttgaagccagaaggggtttttgtttttataatgccatttgacagagtggaataacagtatctaaggaaacgggtagaggacaacaaagaatggagcatattcatggcgaggagcaaaagctctaccccattgaaaggcttcttttcctccctggcgacaaggacacatgcattggtggccaaaagagagaggagacaaaaccgctgcagatggctgatgtgaatctagtggaaagagctactggggatgagagaaagaggaggaggcaggtactgcagagcgtgagtggtggtgttggttggtgaaatactggtcaccagtagtgtgcctgcttttgtaaaacatctaagtaaactccctgtgaacagggtggcaaacagataccagtgtctttgttagttacaaaatgcagtggtagtggctttttgcggacgactgcagcagtgctttttctccctctgttaggccgaaaagacaactgcagaggaataagaaaccttgcagcaaatgctggggtagaagcccatttacaagaagccatagtttataaatgcagcctgaacagcagaaaaaaaattactgttttttaaagtaggaataatgtcaggctatgaatgttttgtcattggaatgtattggacactttgattctacatcacgaaagtgatgctcaaattctttgatttaacataaatcctatacgaaatcttaataaattatgtatgaaacagtggatcttttcttttgttagtgaagcttttatgccattaattaggtcattcaagagcaaaccactttacaacgtaaattactttgtcaaaaattatggtgaacaaat

SEQ ID NO: 116944 - DNA, 1901 bp, Homo sapiens
acccttggcaaccaccactccactttttgtctcaaagaatttgactattctgggaacctctaataagaaaaaccatttaatatttattcttttgcacctggcttatttcacttagcataatgtctcgaaggttcatccatactgtagccatgtgtcagaatttctttcctttttaggtctaaatgatgttccattgcatgtatatgccacattttgttcattcatctgtcagtggacacttcaggttgtttccaccttttgtctatcatgaataatgctactatgaacgtgggtgtgcaagtgtctgcttgggttttactttttttgtgtgtactcaaacctgtgtttttaatttacataatttttgaacattattaactcaatactgtttttaagatctatccattttactttatgtccatctagtttgtgatgctaactctgctctatagtattctatagtacctatcactgttcctccagtgaaggccgtaagttttctccaaatcccgttaaccacaaacacctttatgatatacattcttatacatatctccttggactatgttatttatgtatttctgtataacaaattgtaccaaaacttagtggcttaaacagtttctgtggggcaagaattcaggaatgtcttagttggatggtctgactgaggcaggatctcttatgaagtagcagtcacgatgtcagtcacagatacagtcatctgaagggcttgactagactgacggatcttcttccaagatggctaactcacatagtctcagtttttcattggctattggcaagagacctcagttccttgtcacgtgggcctctccatggggctgcttgaatgtcttcatgacatagcagctggcttccctcaatgattctaacagaaaggccatttatgacctagactcagaagccacacaccattgcttctgctgtattctctttattagatatgagtcactaagtccagcccaccaaagagaggaattaggatccacctcttaaaggagtagggtcaaagaatttatgatatattttaagatcattacatcgaccagtgaaacagtttcactggatttatccctaggagagggatcactggataataagggcattgtttcctattgctgttgtaacaaattaacacaaacttagtggtttaagagaacacaaatgtattatcttgcagtcctggagatcagacacggttttcactggaccaaaatcaagatatcagtggctctgcgtctcctctagagattctattgaagaatccattttcttgcttttcttcagcttcttgcattccttgtctcatggcctctttctccatcttcagtgccagcagcattctaaatctctctctgaatctgaccctctgctgctcttgtcacatattcttctctgacccttctgcctccttcttaaaagaacctttgtgattacattgggtccacccagataatccaggaaaatcagcttcaagatctttaacttaatcacatctgcaaagttcctttagccacataaggtaacacattcataagttttggggactaggatttggccatctttgtggggccatacacaggcatactcatctggttctccattttttttaagctgaaggatttttttagttatttttacttttgcgaatgtgtgttactttcttttggtaatttcagattttcatttaccaagtttatttaaagcatagtataatatataatgatcaccaagatggtaagcagatattcattgttcaattagattcttgattttatcatcacttaatttatatcagtgtatcagctacttctgacatagtctgtaatagaaactgagaaacgttaaagcaacacagccttattaaatttctcttt

SEQ ID NO: 116945 - DNA, 1023 bp, Homo sapiens
cttgatccatttatgaagactctgtcctcaaataaggtcacatttgacatgacattttttggtgtttttttgtttgttggtttttttccctctgttgcgcaggctagagtagcttctgggctcaagcagtcctcccaactgagcctcccaagtagctaggattacaaacatgtgccaccacagctgactaatttttaatttttttttcataaggagagagtctcactatattgcacaggctggtctcgaactcctgtctacaagtgatcctcccacctcagcctcccagagtgctgggattacaggtgtgagccactgtgctcacacctgtaacatatctttttatgaaacacagttcaacccataacactcccttaatacttggtaccttgtgaataataagatacctaaatatggtaccttgtggataacaaggcatattgtcttactttttttatggaaaagtcatcttggacattctctgaacttgtgccctctctttctgttgtctgccctctgtggctgataatgcaccctttctgttcattcttacgtgtatatttgtcttttatatggctgtcgctgagtaaagcattttgggaattacaaaagctaagtattagatatagaccttgtcttcaagatatttatgctccagctgggaagacaaaacaccccaaggtaaaatggaataatttgagaagttaggccaaattgtatagtatttactgttcagccagcaggaagattcattattggctagagacatcaggaaggttttgtgtaagaaactgagctgggccttaaaggatgaggatatattataacagcagaggaaaaaaggatgtggtattcagaaaggggaggaggtataaacaaaaatataaaggtaagaaatagtttgtagaggaaagtgaggagagacttacttgaggaaggttatcttggaacttaataggaaataagttttgaaggtagactattatcagatataatagattgtgaacaccagacagaagttat

SEQ ID NO: 116946 - DNA, 1016 bp, Homo sapiens
tatttgggttaccttggggtgtttgaaaacccaaattaggaaattatgctttagaccacctgtttttgtaaattaagttttattagagcatgggcatgcccatctatttatgtgtttggggctgcttttgtgctacagctacaaagtcaagtagttgcaacagaaatcatacgacccacaaagccttataatatttattatctggcccttacagaaaatgcttgccaacccccgctcctggtcgttgggatgggcatcttgagacctgcccacacgtggtatgggcttggataggtctagccagtgttatgtagctatttacagaatgtaagcaaaggaaagtgtggggaaagaatatggcaaacagaaaactgaatatcaccacctaatggggccttagtagggaagagaaagagaaatagaaaagggttgttaaagagaaaattaaaatggatgaggtgaattctgcttggaatttaaaactttttggtatattattgattttgtatctggcaagcctaaaatttttatatttctaagatgtttctattttgtttctttccaatgataacactttctcttttttaaattttactgtgtgaattaggacttccaggattatgttgactggaagtgtggatagtagacatcttattcctgattttaaagagaatgtctgtaacatttcactatgaagaatgaagtttatagctgggtgtggagcgcctgtaatcccagcagtttgggaggtggaggcgggcggatcacttgaggtcaggagtttgagaccagcctggccaacaggtaaaaccccatctctgtaatcccagctactcgggaggctgagggatgagaattgcttgaacctgggaggttacagtgagcccagatcatgccactgcactccagcctgggcaacagagcaagactccatctatttaaaaaacaaaaaaaagaatgaggtttacaaaattagctgggcatgttggcttgtgtctgtagtcccagttactcta

SEQ ID NO: 116947 - DNA, 2020 bp, Homo sapiens
atttacaaattgtgaaatgaattaaaatgaaagggcaaagattaaatcatgaccaggcctgaaattaacacacaagactcaatttttttcaaccaaagacttttgtaggtgatccctgcctgcaggactccccttcctcctcagatgtcattggattgtaccaggtttactgtagattctagccgttgtagaactaactagatctaagatgagtcccctgatttcctttggtagagtcttccaattgctgaactccaatattgtcgtgactagccagtgttacaacctgtctgccttattttgtgtaatggatttcatattacagaggcatttttttaatgtcaagatgtttaagtattgcttaagtgcaaactacttaatactttttagctattaagtaattaagataggcaggattttatttgttccaaaatgatttgacctaaactaaaaagagaatgtggatctcctgaatcttacttggttaatcttaatataactcctagcattctataattcttcctaaagtcctcttacctggctatcttttgtatcttctttgtctctcctcttctttcccagtcataataactgccagactctgcttcatttctctttgacagtctctactcctaaggtcatccattctctttaggtatcttttggcctcagtttgagcacagcagatcccaagaccacatatgccatagcataggctattatagtcaaccttttgaataaatgtgattgaactttatgttagtaattcttatttaccatcttcctatcaaaaaggcttaaagtcttcatttaatgctctccttcatgtccattttgttaaatgattgccttttaatgacatcttagaacttcagaactatttcaccatggaggatgtgtaagattagccttttatcaaataaaaagtgtgaaatggaatatgtaatctcattaatccattctggctctaaaattctgtgactatcagataaaattcagaaataaaatagtattactaatataaataaatttttatcataattatatttcctaagttttgcctgtaagaatgggtaaaatatctttaaaaccttgaagaaattattacttgatagaaagtttaatccatctgtgagaaggcaaatgtattcagacacaactaaagttctctcttctattttaatttcatttatcttgaactaagactccactgtttcatcctcttagatgctgctacttgaacaatattgttttgagaccaaaaactagcatattaacacaattcttcttaaacgtcttaagagttttgtttcctttacccctttctttaaaaacaagcagccactaaattttttagtagtgaatttcaaaatcctttttaaccttataggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggtatcaagactgtgacttttaattgtagtttatccatttttattcagtattccctcttgtaaacttgaggtaagacactttacttaaaagtgtattttaaattaagcaataatatgtaaactctttcttgcaaaagttagcatttatatttttaaataagatatattgaattcattcagtgaatcatataaagaaaataagtgtaaaactccaatggctagttagttcttagttctttttaagattaaagagaagagaccaaatatagcatcactgtactgaggcaaggttttctgtgtagttcatagaaactagcctcatgattttagaatatgccttgaatattaagtgtagccttcctccccaactccctcagatcttgccaccccttaagtgctgcagtgataggtgatcaagaaaatcaggataccctactgggaagagccatgaactgaaagtcagtacctggttctatcc

SEQ ID NO: 116948 - DNA, 2259 bp, Homo sapiens
ttgtttctccctcttggctattttaacatttgagttcctggtccagttcttcctgtctgttcactactcttattccttactaatttcctattctatcctagtttttttcctatgcatttcaaggtttcccttattctccagacttttgtgtgtcactgaggtaactgtttctgcttctcttttaccctttatattcagtatcatcacagctcaacctttgctcatgtgtcctattctctttttccatccctctatcaatcttttctactctaattagcctcttctgtggtaaaactgtccccagcaatgacagacatccaatatacctacttcaaatcccttgggaaataaggtagactataaacaaacattttattctttccacaaactatgggtgacctaaaaagacttgcattagttgcctaacaggttaaaaaagagtagtttggtattttaacattgatcaacacattacatttcaaatcattatacttggcatgtgtttttaaaagttttaaaatacagaattaaaatattctttcatctactttagtatggtatatttcgcagagaactcctcctggcaggcctgtttagatagtacatgtctgttttgtagtgtagaactctgagatctcttttttaaagtttgtttaattccttaagcaattcaaaactcatatttgagagacaatgtaacttacccttagatccatctccacactgaagtggaatgtctctcagagtgacaatagaagtcacaccctcaaatttctacagtggaatatctagttgatcatttatatgtgtggtataatacaagttgagtatcccttacccaaaattgcttcaggccagaagtgttttggattttatattttttcagatttttaaatacttgtattatacttcttgagcattcctaattcgaaaatccaaaatctgaaatgctccattgagcatttcgtttgagtgtcatgttggtgctcagaaagctcaagactttggagcatttcagacttcaaattttcggatttagaatgctcaacctatatacatcaggaatagtggcacttcagatatacctgaaaccaaccataaattttattttactcagcatgtgcttcaacagacatcttgtgaatccattaacatatttccttagaattggacatgtggtaccataacaattacagccctgtaatgaaattatatctctttttaaggttttatgctgtgaaagagcataaaccatgagctatttattttgtcttagaatattgttttgtgtagacacttttgaaaccattggcacttcctactgtggattaaaattaatccacacaatggttatttctcccaaaatcacttgctagactttgtaataccttatataaactcgaatcacgtttcctgttcattaatctctttacccccaaaaaaggcaaaaggaggctgggcaccgtggctcatacctataatcctagcactttcggaggccaagcagaaagattgtttgagctcaggaatttgagaccagcctgggcaacatggcaagactctgtttctgcaaaaaaatacaaaaattagccaggtgtggcgtatatctgtggtcccagctacttggaaggctgaggtgggaagattgtactccagcctgggcaaaagagccagacctggtctgtctgaaaaacaaaaacaaaaacaaaacaaaaaacagcaaaaagtaggtctcctccaaccggattacttaaagtctaaaatttatgtagtagtaccatctagtggcaaaagaggacactgctttgctatttgattatatgtgtctttgtagcagccagggaaataagtgtttatgggttagggaaatgtgaacactgtatattaaggaaatatttatttttaagtataatgatattattgtgtttgtgtttagaaagaatccttgtttaaatatacatattgaaatatttacaaagaagttgtatgatgcctgagctttattttaaaaataagtctgaggcagaggggtggaaatagaggaagtggatatgggtgtagatgagataaaactgaccatgaattgataattattgatgtgggatatgaaggtacatggggctttgttataattttctgcatacttaggtatatgtttgaaattttttgtaatgaaaataaaatagagattacatggaatttagatgatatgaaatcagataaatgcagaattatagctaatcttaaaaaaagttgtgt

SEQ ID NO: 116949 - DNA, 1081 bp, Homo sapiens
gatgtttaaaagactgatcacaccaaatgtggagcattggaatgctcaggcattgctgagagaagtattaaaaaccattttggcagtttcctttaaaattaaaccctatgactcagtgtttgcactcctagaaatgtactcaagagaagtgagggcaagtgtccactaaacggtacaagaatgttcatagtgacattctaaataatagcctgcagactggtaacagcccagatgcccctttaagaggagaaaggatagataaattgggctgtatttatacagtggactgctacatactatacaacatttaaaaacaatgaactgataaggcaacagcatggacagatttcacagatactatgttgaacaaaaaaagtgagacacaaaatacttatgtactgtgtgattccatttatatgaaggtcaagagcatgccaaactcttctgataaagaagccagaatagtggttacctctaggaaatgaagattggtaaaaggagcttgagggaaccctctggggtgctagaaatgtattttcacctagatagtgattacatgggtgtgaaaattcactggatatttaggattagtgtattttacatatgtgtgttgtgcctcaataaaacaggaaaaaaattacttgaggtcagtttttattgtggaatagccataaactgttcacagcaaactagtaaataatgtaggtcatattggatggtatcatcttaaggcaaagtaactggatgtgactgtaaatttacacagattttgttgatgaggttcataactcaaagcacttacaaaagtaatttaacacatcattggagtaagttagtagctttccaaggtgactactttgggaatctttttaaaaattgtttgaccttaaatcttatttacctttatgcttatagctatcaatagatttctaacaatgtgtacagaaatttttaaaaatagaactttattacaagttgagtatattcactattttattaaattaggaagtgtggacaaaaaaaatcaaaatcaactatttttttttaaatttaaatcccatcaccagaggtaaaagtaacc

SEQ ID NO: 116950 - DNA, 1056 bp, Homo sapiens
aattagtatactagcagaatatacttaaatgtggtatataaaagcttgaatgttgaagttgttaaatagattatgtgttaatttggtgttttttatggtcatgttggtgcacgcttaagagacatggattctaaacacataagtagcttttgtaacttgagcaagtctctgggtctcacttgttttatctgaaaaatgagaataatttgcattgttggtttttaggtttgaaataatgaatgtatcttaaatgtgtttctaataccttgcacagagactccccataatcaccattatctcaaaatatcactattattatttggccatgatttatttattaataatgaataataggtaatatatataaggtgcgtgctttgagagtgatctgaatttttttctcagcatacttaaatgtcaagaaatacagaatcatgtcttgaagttatttagaatttcatgttaatatattgtgttctttttaacaggaagtacttaaacaactacaaggaagtattgaagatgaagctatggcttcttctggacagattgatttattagagcgtcttaaaggtagattttaaaaaggtgttttaaaataattttttaagctcaaattgtcatctttaggtgtgtagatccaagtacagcttctctcgatttgggtgttggtatcagttttcttggtatgttagccttaccctcaggatgtaattgttaaagtacaaataaataaaaaatgtatttgtgtgtcatttcttcagttaaacatttaactggctttgaatgaactattttaaatccctcccttaaataattttcggctctttgtaaagcttgttgctattctgccagtcactaaatagggctttagtattctatatgccatagacttgagcctactgtttcattggaagaagtattgtcttcttcattcaggatagaaatactttaaccttttcacatatataagttgattataattcatttttagcagttttaaaaggatatctttctcattctgttgcttgaaaattccagtgtcagaacagagaa

SEQ ID NO: 116951 - DNA, 1024 bp, Homo sapiens
tctttttaatactctaattttaatgactgtaatattctaagtcctacctttaaaaattgaaatcaatgtaaattttttgagtaattcattattagcactttaggtagagaagtttgcaataacaactgatgtaagtattgctcttctgcagtctttattagcattgtttaaacgtacctttttttaaaaaaaaaaaaataggtcattgcttcttgctgatcttgacaaagaagaaaaggaaaaagactggtattacgctcaacttcagaatctcactaaaagaatagatagtcttcctttaactgaaaatgtaagtaacttggcagtacaacttatttgaaactttaataacttgatattttaaagtacctaggtaatccattaaaattcaggataactgaatttatagttatttgtaaattgcaatatgttttacccaactttaggcctgaatatataatagttaatgaatttttgttggtaaagatgataaaactttattgtgctcaaatgttttatttaaagctcttatttagaaaatctataaagtttgaattctagaggacctcagggttcaactaggcaactagttttttaactccgtgtattgaattgccaaacatactctatagaaatatttatcaccatctgcctattttttgtactgtgttgcaggaatcatgccaaatagtttttgcaataaaaatatctctgaaaatattctagatataaatgccaatagctatagcacggatattagcatttttgcaagcactaaagctggtttgttttgtccaccagtattcacaataaattaacagtatgcagttgaataacattctgatttactacaaagggttatttttcttggcctctgctgaaccagtaaaacatatactgaaaagatcgaacctgcatataatgaatgtgttggagtaaagaaaaaacatgcaagtcaatagtttagattacagaagtttgttcaccgatttatgacagcaggtcctaaactgccaacatctct

SEQ ID NO: 116952 - DNA, 1023 bp, Homo sapiens
aaagttctctcaacttaatctgtatgtatatggtaatccttaccttaagttgaagtatgagcttaagaatgatggacttgtttcttgatatttctatgttgtccacgttaatatgctagtatttaataattaaaagtagtgcctcttcagtagagaagagtcataaggcaactgaatttaacctcactctaactggaccaattatatattttaagtgaaataggccaatctaattaaagccacttgtgactttggcaaataagtgtttgaattccacgtcacatcagggatccagattgagtctgacacctataatcaaatttaaacactccttggagtaaaaaataattttctcatgcaccatgactgacgtatttgcttattcattttctttattggttcttatatgcttttttgcttttactgattaacgtaaatacaagatattgatacttttttattatttgtggttttagttttccttacaaacagatatgaccagaaggcaattggaatatgaagcaaggcaaatcagagttgcgatggaagaacaactaggtacctgccaggatatggaaaaacgagcacaggtaagttacttgtttctaagtgataaaacagcgaagagctattaggaataaaatgaattacagctctgttaatattgattaaattttattaaagacataaggctgtgtttattttggctctatttcaaaataagatttatcatggctgctgagcaacataatcaatattcacatagttgtgtctttaccatattcatttcccctggtactgttctgttctgccttggaattataagggagagacagagttagatggtggtcttccggtagctaatgactagcttcagttctcctttgaaatttttacttcttgtaatcttagactgtataaaggcattcagaacatgtcactgctcttcaaattgtgcacttaaaaaaccctcattcaaggataataggaaggaaacaaagagaattttaggagagatgaagt

SEQ ID NO: 116953 - DNA, 1094 bp, Homo sapiens
taagaatatgcttctattagttcattaaaatgtaaagcttaaaatgtcttattaagtatttaaatttattttactgagttaaaacaaacatacttcattcagtattactagttagcattatattggaaaacaagtggtaaattaggacaaaggcaatcatgtttaaacagcacatttgagttatgtatctgtcttttgtttagggaattagttgcaacatttatatattcctacacatatgtagaaggaagaaaaatttaatcctatatgacagaaaaaaatatttacataggaatagatctactcgtagtgctttgggtcatcttccaattattatgtactttggaaaccttacctatccagtaagctggctatgataaattggatccatattacacttactacatcaaaataaattctaagtagattagatttaatgtcaaaatgaaaatcattaaaaatataaaaagattagaagaaaatgtgggtagcgtttttataatcatgatgtaggtgggagacccataaagaaaggattgatagatttcacgttacagcatgagacttcagtatgccaggaaatcatagcgagattccaaaacaaacaaccaagatcacattatttgcaaacatttatgacgtgtaaaaagttaaaattcaagatgcaaaaaacagtatttatataccagctatttaaagagtatcttaaaatggttccaagccatcgtagaagtaaaaaaataaataataattttaaaaataaaattaaaatgggcaaaggatatgaacaggaaataaaagaagaaattaaaatgacttgtaaacatggaaagatggtcaactttactaatcatgatatataaatacaaattaaaactaaagtcagatttcgtgggggggccatttagttggcaaaaatcaataacactcagtaatggtgagcaaacaggcattctcatatgttgcttttaattgtatgacatgaaacaggctttctggagagcaattttgtcaaatgcatctagcattatttataatgtgcctgttgtgaagctcatcactacaacatctaagattttttgctaatgagataa

SEQ ID NO: 116954 - DNA, 1040 bp, Homo sapiens
gcctcccaaattgctgggataacaggcgtgagccactgcgcccggccaattacaacttttttaatttaaaaatagcaagtatgctgggcatggtggctcacacctataatcccaacacttagggaggccaagcgggaaggattgcttcagggtagaagttcgagttcaacctgggcaacatagggagactttgcctctgcaaaaaaaaataaaaattagccgtgtgtggtagtcccagctacttgggaggccgtgtgggaggatcacttgagcctgggaggtcaaggctgcagtgggctatgatcatgccactgcattccagcctgggtaacaaggcaaaaaatattttttttaatttttattttttgtctaaaaaataaaaaaaaaaacttaaaagcaagtaagtatgatctcattatacatatgtataatgtgtgtatatgcatagagaaatgtgtgggagaatgttctttaaactgttatcaatagttatctctgagtgttgggatttttgtgggttttacttattcttttgtgtgtcgttttattttttgtaatgaacatgtattactataatttataacacccaaaacccattttcattttgggaaaatagaagaaagcactgtcttgatttccgttgtatggtagtttaggttgccatacttcagagtcctaccatgacatacatcatgtcatttatgtcagtatagggatggcagaggaaaagatctattgaaaatagtaaatcagggcccggtattcattcctcctttaagtgatgaactctgatagtgctgtgaattcagaggtaaacataagtatgtttgtttagcagtagcaatcatagacttgcccaccatattggtgtttgtatgacactaatgctgctaatactatctggttactttcagtcactgttttaaaacaatattgcagctattcccagatcctgatgtagatgtgtgacctgtatctgtgggactgtgatttgttattccaaaagtcctttcatctaaataggatctatacacatgatc

SEQ ID NO: 116955 - DNA, 1029 bp, Homo sapiens
ttgcagtgagttgagattgtaccactgcactctagcctgggtgacagagcaagactctatctcaaggaaaaaaaaaaaaaaaacgtaaaaccaaagtgctggaactacaggcgtgcaccaccatgcccagcctgtggaaagtgttgaccaaatatcttctgtatatcagagtgtttctatggcaattacagtttgacagtttactgtggtaattgtattttagggagttctgggtttttgtaatttgttatttggggaatttaagaaattagtttttccagtaccctttattctttttatacgttacattgttacttgtgaatcagccatatataatttttatataaacaatatttttatactatacaacttactcttgtcatttaataatactttgagatatcttttcctatctatatgtggtttatagatatggaagtttttaatccatttttctttcactattttttctttttttcaagcaacctaagcttttctatttgaaatttagaaccaggtctctggtaatagccagtatataataataaagctcaattaaaagtgggaaaaagatggaatgatagaaaaacccactctactgccactggtttttaaaactttttcttatggaaaattttaaacatttacaaagacaataatgtagtgattcatatcgacatgtaacctattcaccttaacctcccattttattttttaagaagattccaggcatcatcatcacttcttccctgtttcactgtgtatttacaaaagataaaagtacttattaaaaatacataactggccaggtgtggtggctcacacctgtaatctcagcatttccagaggccggggtgagcggatcacttgaggtcaggagttcaagaccagcctggccaacatggtgaaaccctgtctctactgaaaatacaaaaattagccagatgtggtggcgcacacgtgtagtcccagctactcgggaagctgaggcaggagaatcacttgaatccaggaggcagaggttgcagg

SEQ ID NO: 116956 - DNA, 1021 bp, Homo sapiens
agccctttctaaactgtgagatcttagagaacttggactgtagcaaattcatacttagttttctggcaatttggagcatttcagaatttgaacattccttcaatgcttttcatcaatgaacttatctgaatgtggttttatttatttagatctatgaaaaattactaccctagaatttcttcagtctttggttaagtccattctgcagtttaatgctcatatgcaagaaactctcttttctttagtttttctctaaaacatacttagtaagcgtataggtaaaaaatattttgaacagttataatggtcatacttttatgatgtatttaattgtttatcatacagacacttcatttggagtaccttaacatgatgttatctgtatttacctatagtctaaattataccatctataatgtgcttaatttttagggttcaactacacgaatggaccatgaaacagccagtgttttgagttctagtagcacacactctgcacctcgaaggctgacaagtcatctgggaaccaaggtaacagaagattacaaaccctggtcactaatgccatgactactttgctaagacattcttggccaggtgcagtggctcacacctgtaatcccagcattttgggaggccaaggcaggtggatcacttgaggccaggagttcaagaccagcctgggcaacgtggcaaaaccccatctctactaaaaatacaaaaatttagccagtgtggtggcacacacctgtggtcccagctactcaggaggctgaggcatgagaatagttggaacccaggaggcagaggttgcagtgagctgagattacaccgctttctagtggagaattctgattcacagtctcttgaagaaattacatatttttatacaacgaagcataaacaagggaaaaatcaggtttataaaaagtgccagattagctaatttttaattctttttcagtctttacatccacttttctgcaagaatactgagttccagccaaactggctcacttcc

SEQ ID NO: 116957 - DNA, 1277 bp, Homo sapiens
tctaatctgcttctaactaaatacgtagaatttattgtcagagagtaattagtacttaccagttgctttttaaaaaactgactacaaatcctggctctcactctgtatgatcatggcattttcctttttatgacaaaatgtttttaaatttataatcgtataattttaataatattatcatctgacgagaattaatgattgctgagaattagtacttaaaattgttgcagaaatgttttctgtttattgcttataggtatagattaaaagaaataagataaagttttaaattatgtaaagatttagataaactacattctctatgtgtgtgaaatccgttgtttttcactgattatagtcagtggattagcaccaacttatctaggcaaacagcactaacagtttgttagtgagtatgcaaaaacctacttttgcttttaatactgtatattaccactcatactatttactcacataaacaaattggtgatgatacatagattttgaaataacactgattacttcatcctggaaaggttttccggttttttgttttttttttggcggggggggttgttttgtttttttagagttatagtaaatatcccattcatcacttaattggtttttggcttttggatattaaagtcgtaattttgtttctaaactcatttggcccacaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaagtatgttctctatagtgtacatcgtagtgcatgtttcaaagcaaatgtgaaatttttaaacagaaaacatgtttagttaatatgctgtctttatgactaagaggagaaaattcatatcagccatttgtgctactcatatttaaaagattaagtctgtatttccctagaaaaatttagcaaaggaaaatgttatgtgcactactataagaacagta

SEQ ID NO: 116958 - DNA, 2383 bp, Homo sapiens
agcaagaaccatacgcttaattcccattttagtgtaattgtgcccttgctttttgtgccgtttatgttacattatgttccagccaccactttatattcctatcccctcatcgtttcattcgtcatttatcttaaaagtgatgaagtcatgagactcttacacagagaacctgaacagccaaaagtattgtctccttcagagtcatcactttgggaggctctgcaccttaagatttcaggcctgccctctggccatgctttccttcctagtggtgtagcaattggcctacctgattctctttcctccccctggtctcctgtggattctcagttaatcttatgaattctcccctcgttaatacaatctcagcatttgtgaacattttaaattttttaaaatgctaatcataacaggaaggggataaaaaataatgaataaacaggaaaacattcagttttaagatacctcaaaagttattctgtaaatgttcctgtattccaatggattgtagactaggactgagacattaatcatctggatttcaaaataaaacctagactcagtatttgttcctcttccttcttcaggtaggaaggctacccggggcatttcatcacaggagctagggcaggggctttcaggtgaggagcaggatggggcctctgggggtgtgactgctggggacatagccacaggggattaccttcttctcactcctcacctccagatttgcactggggcaaaaggaggattagggtgtgtggattgcggggagataatagtacaagacagcacaaggttttggcagtaagggataaggagaaaagaaatcccaaataggtaaaggggaattccttagttcagtcagctgggatggtcatttgtacatatatgaagattctacagctatcagtcatttaagtttgcacttattagtattagaagttttagaatataatttccatgatatatgtttattgattccctaatctaccccagaaactgtgctaggcactagatttttataatgattaagacctggtcctggctttcagggaactcacagtttatttgcattagtgtttcacaaaatacctaaatcataatgatcacccagaggcactcgtcaaactggattttctggcactgtagcaaacagaatctccaggggaagggcctaggaatcaatgtgataagtggcctggctgattcttatgttcgggaaattttgtgaaacaccagtagaatattcttgttgagcctgtgatatttattttagaacaaggcatttcatgctaatggtgactatctaaaccaaataaaacaaaagcaatatgctttttaaaattatcagtctttcttttgttcataagagtctaaattaaggattctgttgaatgtcacctgagtctgttggtgctctactatcggtagttttaccctattgggcaatagtccggtctatttagaccactgttttctaacaggcaccaagaaaattgtagaaggacatgttcatcatctttgcattaccatgaaacatcctgatttttcttagagcaaccagtttttaattgtatcaatccagtcatgaatttgcatattttagcaaatccatttataggtttaacctatgaattctattctgtgcctcaaaattctctgaaatcttttcatttgcctgaaatcaaaaagcacttcctcttttatctgatagtctaaatttttttgaatgttctttttttattagccatgttcttcctgaatctgttgatatctgccacattcttatttaatctttattttcagtatcaaatcctaagatttttagtttttccatacaagagtactcaactctttgatcatgtagtgccttcttggcatcttctttaggtgcattttatctttcttaagaaagtatcccagttattgtcacaccaggcaagattttatacagacaaaaggcatagtttgttttgttttggtattgatcctctgctttaaaatactcgacatcttggggatctcattagtataccaggccaagtcttaaggtcttccctgtcaatttcatgggtcaaaattctcagttcttttacaggctccttttcttttacccaagtgtaaaatggtggaattccttgaagctctgccctaggctcttttcctttctctctatgcttctgttatagtttttgtttttgttttcaaatttacagctcaatttgagttttttccctgagttttagacacattattgaactgactatgtgacatcttcccttaggtggtattttagacacttctaactcaactgtcacaaactgaattcgtaatctttcccatccctgaatctcttatcttttcccagtttccttttctc

SEQ ID NO: 116959 - DNA, 1144 bp, Homo sapiens
aaaaaaaacaaaactttttagtttttcttcatgcacagtttcatttaaaggcatccgtattcctaagggtaattatttgccaaaaaaaaaaaattaaagtagttaggccacagtgtatgacaataaagagtgtttataaagccctaataataataataagttacctttttctgcttatgttcacgaagaactagtgttagaaaatagccttcttcactgttggcaaggtgcagtgtatatgcagtaaatagaaaataattatttcgctcagcaagataaggggctgggggtggagaaactggcataaaatggaataattgtcagttgtactttataaatatattatacagaagttctttataacagtttttgtagcttataattctaaaggcaaatttaaaccatatattctcattgattgagtttttttttcctagtatttaagttaccaacttggtaccagtttgttttattttagatgattgtctttttcctcttgccctttttaaattagggggactacaggccattgcagaattattgcaagtggactgtgaaatgtatgggcttactaatgaccactacagtattacactaagacgatatgctggaatggctttgacaaacttgacttttggagatgtagccaacaaggtatgtttttataacatgtatttcttaagatagctcaggtatgagttaatttactttcatacaaatacattttactgattttcttttttttcactctcctcattaaacaatgactgataaaaacctgtgcttcacattcgcttatctttactcatttgtttgtcttatgcctaaacaaaggcaaaggtacatctacagatggaacacagtagtgaatttatgtaattgcattaaaaacaccattcataagaatatacttgtagggatcatttctgtgatccattactagagaagtttaactgtgtagaattaaaaaataaaagataaaacacttcctaggaatgggattaaaaatctaaaaattcttaagaccaaggcaagtgttacacacacattgattccatccaaataagaggctttactctaaaacctgttgcttatcatttctcaccacttattcactttatttctctagtttgacaaaggaaga

SEQ ID NO: 116960 - DNA, 1079 bp, Homo sapiens
attgtggttagactgtaggaaatctttttggcactgtagtagcatttaggaggaatttaaaaaaaaaaaaaaaaacaggatctccctctcttgcccaggctggagtgcagtggtgcgattatggctcacagtaacctcaagctcctgggatcctcctgcttcagcctcccaagtagctagaactactgcaggcgcatgccaccatgcccagctaatttttaaaaagttttcatagagacagggtctcactgtgttacccagaaggtcttgaactcctggtctcaggagatcctcctgcctcagcctcccaaagtgataggattacaggcgtgagtcaccacggctagccagaatttctttcttaatagatttctattcttactgctagcattaaaaacaaaaaagcaactagtatgattttatgtataaattaatctaaaattgattaatttgcaggttattgcgagtgttttgaggaatttgtcttggcgagcagatgtaaatagtaaaaagacgttgcgagaagttggaagtgtgaaagcattgatggaatgtgctttagaagttaaaaaggtacctttgaaaacatttagtactataatatgaatttcatgtttggcttttttttgctgccttcttttagccatgagatttcctaatttcttacctgtgtattattcagtactataatatgaatttcatgtttagctttttttgctgccttcttttagccatgagattccctaatttcttttttgagatggggtctctttctctcgcccaggctggagtgcagtggtctgatcttggctcactgcaacctccgtctcccatgttcaagtgattctcctgcctcagcctcctgagtagctgggattacagtgcacgccaccactcccggctatttgtatttttagtagagatggggtttcaccatgttggtaaggctggtctcgaactactcctgactttgtgatctgcccaactcggcctcccaaagtgctgggattataggcgcaagccatcacgcccagcctagattccctaatttcttacctgtttatctcaccagtccatag

SEQ ID NO: 116961 - DNA, 1190 bp, Homo sapiens
acccgcctgccttggccttccaaagtgctgggattacaggcatgatataatgcatggtcaatcttggaaaaactagctgtcagaaatttataatatccagttctgatttgggcctaattctggttagcagtattagaatttatttattttttccctctttttctacatttagtgcagcagtcatgaacattcttcttctctttttcattcaatatcaattccctctcaacttcagctactaatgagcaagagaatcagaactaccttctagctcccctgcatgttccacatcactttaactcactcagagctcttactctagagctttcctttaccagcactctgtactccgttcacttaaagctgttggtcccttactcttgtcttctacatattctctactggatccttcttttttatgtttcagttctctagaagaagcccaatgttttgaaaaacaaaaattttctgtggcttctattacagtgtttctcttttccagtaacaaccaaaaccctgaacaatggttttgaccaaatacctttgtgtatcagagtgtttctggggcagttacaatttgacagttgactttgacttgcttcatttctaaactggctgtactatcttgagttcctcctaattttgcttctgacacaacccttctccttgatcatagaatctagatttgtagatttatttaagtttttctattctaccttcacctgtattttatactttttggtcactcacttttgctgttactacttgtattaataacctctaattatttattttgtgtcttctaatttgaactataaaaacatttttgaaacaaaacctctggcccttgacatgtagccccacagagaggaacttttgtatttttctaccttcaactctcaactctgggccagttgcatcttaattcagtcctttaaattcttgctttttttgttctcaggatacttggagtgccccacctttatctcagtcacaatgtaattaaaattgggctcatcttgattgatgtgagaaggacaaaggcacttcttgcataaaagcactctatctgcctcctaccacttatgtgacaaattatgtctaaacctgctcctagattgttttgttcacttaatttcttgatgaagagagtaaagtagctatttattgggttagacccaaaatgtttg

SEQ ID NO: 116962 - DNA, 1179 bp, Homo sapiens
ccgtcagcctcccaaagtgctgggattacaggcatgagccactgtgcccggccacatgccgggccttaatccacttcctgttcacttttttttttcttttttcaagcaaccccagcctgagaataacccacattctattctgaaaatgttttcttttcataatgcacatcagttgtgcctcatattctaagatgtgtgtactatctaaacacttagaataaagtttataaaagtcattagttaaatattgtgttctgcttgttttatagagatatcactgatataaatactatttggtattttatgaacatttttctaaatggaaagttcttaatttaccagtgagggacgggcaataggatagattaaaaaatagcttttattcaatatcagtaacatagaagttaatgagagacaaattccaactctaattagatgacccatattctgtttcttactaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggtatatatagagttttatattacttttaaagtacagaattcatactctcaaaaagacctaattgtaagcaatgttttatataatcatgaaagttttaagccaaaatatatttattactgtgaaaagataactactaactcttagtttaactcattagtgtacttaatgtaataacagtttatagtattatagaggagactaaattaagcaaattatagttgagaggtgtagcccataggtggaggaaaaaatagtcacaaatattgtaacaaaataatccatttctattagtatagtataaaagagtatgaaaacaaaatttagaacaagacaaaaactatgagcgtgatccagagaatataaaggttcacatttttctaatgatgtcttagtatccataataataattttttttttttttttttgagacagggtctcactctgtctcccagactggagggcagtgttgtgatcttggctcactgcaacctccacctcctggg

SEQ ID NO: 116963 - DNA, 8473 bp, Homo sapiens
ccaaccatagattaaattaccacaaagttcctattcaacataggatttcatgatatagtttttaaattgggaaactgttatatgaatagagtaaatgtatgtgccccaccccctgcaaatgttttaagctattgggtcagaataggaaatgtagaattgacaaaaaataacacctttactttttttagtgtgacagattagtactttaaaacattaaacattacatgaaattagaacaaaaggagatgtggaatacttggaatttataggataattggtacaatcatattatgccttttgtcttctatccttttatttgttgttactgcatacacattgtgaccttaattttgtgatctcttgattttatttcaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtag

SEQ ID NO: 116964 - DNA, 1176 bp, Homo sapiens
aggttgatttcagatgaaaatatccagttttttaatatacagtggaagtgatcaataattagcaaataagatatttgaggacaactttacagattaccagggtaatgaaaaggaagtaatcaaagataagccccataaggatcaaatagcactgtaagtacagtaaaatgtttcttgattaaaatatggatcatgttgccacaggttaattacatgaaagaatgaatctcttgcagaggatgggagccagttgcacaatatctgaatatatgttatcccagggtttcttggaatctaaggaaaaaagcagagcaccagaaatgcaaaaagtaaattgcccatagttaaaggaacatctgagtagtcagatcattaaaatttatgaaacaattatttttcacaagtcatggtggctgaaatagagtgtataatttttttcctttcaaataagcgtattttcctcatattacactgacttaaaatttaaaaattactttgtaatgttgaaacctatagactgtggctcctgtaaaccccaggtcattttcctgccattcttacaactctgtctaagatctataaaagtatattctgctttttgttaggccattcatgcttttttcaacctgtacattctatgtatataatattgttcttggtgctaaatacactttcttttatctgatattcaggataattctttctctacatttgtgactatccacttattttctcgaataattaaaaatattcaacataatgtatgttagtgaaggtgaccaatgaatataaagcagcattagtgaaaaataactattgaaaaaaatgccaaacattaacttccctacctacaccaccttttggaatccagacccttagcctcattcactggtcactgaactacgtacccagtctttctccctgaccttggctatttgtaccagagttgtatctgacctagaggagactcatcatcagctggtcagtgaccagagacttgtatagcactgcttggaaataaaaaaatgatcaggccaatcaatttgaaatagtaacaaaggacatttctggccgggtcttgagtgctggaactgaaagagcacgcacacagttaaggctcaaattactatgactggcatcatgaagcttaaactaagaggaagccacctagtggag

SEQ ID NO: 116965 - DNA, 1024 bp, Homo sapiens
tgttatctgttgagtgtagttgtccaggttcttggcgttttgaataaggaattgaacaaaacacacaaagcaaggcagcgaaagcagatttattttaaacaaaagtacactccacagggtgggagccggctccagcaagctacccaagagctgttggttacagaattttctagggtttaaataccctctagacgtttcccattgacctgtgccagtctgattggttgagggagggggatcaatcagaaagaggagtaggcccgcggccagtctgattagttgctcgaggggaccactccgaggtactttgatttttcaactgccacgcagaaaaaggaggggttgaaaagggagtacccatctgatatctaggcagcatgaattggcctttggttccctgccacccgacccttttctcctgcctcttactgctctagtgataccacttatgctattgtctatggcaggtttatttgtatctatcctgcttatttaaataataagaagaccatcgcagagggaaggcgaatccccataagtaaggtaagcaagatggctggcaccttgatcctcgagggaatggggggtgtcatcctggtcgggccacgtaatcttgttagagccgcagggggttctcttcactgcatttatttagggcttgagaacacagccaagaattggggtgcgttcctcagtgttggtgaaaccagaaaggcattaattcatagctgaagggatatttttttaacgtctcttaatgagcctttgtttgtaaaggagtgggggcagagtgtagagttcacatgtttttaaaacaaaggttatgacggtgtttcccttgatataggaaatcaaaattatgacattgtacgatacattaataatgttcagaatgtagttgagatttttttaagtgtgtgaagaagacatgcagaaagttcagccctgttgagttttattaaagtgtcatttgtattttgtaatatgacagatttaagacacctaggtttgatgcagtgaattc

SEQ ID NO: 116966 - DNA, 1051 bp, Homo sapiens
ttctattaatagtttgaggctattataaatagatgttttttagagaacatatttttgcttttttgtagaacgcatctgggaatggaattgcagggccatagagaatgcatatattcagctttagtagatactagcagttttctaaagtgtttgtatgtgtaattgtttaagcagtcaataatcattgagcacctactatgttgagagtaccatgctaggtgctggggaatacactggttaacaaaacaaagcccctgccctcagaagtttatgttctgttggaggggagatgggcacacagttacgcattagtgttattcctaggaatttttaaaattacaatagaagcatctgtacttaatgaaaaaggaaacctagggttttggtacttgtttgattatagtatttgaaattatttacccaacactatggcagtgtccacttaaagcacatatatttagtgtttatgtttttaactgttcaggctgttgaaaatcctacagctacagagattcaagatgtatgttcagcagttggacttaacgtatttcttgaggtatgacgtggttcttcactattttccatactcatctaattgatgtaataactttcttaagtcctgtttttcttttgtttcgtttatgttagaaaaataaaatgtactctagagaatggaatcgtgatgtccaatacagaggcagagtccgggtccagctcaaacaggaagatgggagcctctgccttgtacagttcccatcacgtaagcttgtttaaatgaatcagtggggctcagggataggtttctcctacacaacacaaaaaaggttctaaaactgaaaggtaaaagtcagaatttgcattctgaagattaatttaaagacaggactactgctcatggagagaagcagtagttctaatttctttgaggtgaatgacctctttgaaaatgtaatgagacccactaaacatttttcaaaaaaattgttgtgtgaacattttataaacctctggaagtctgtcattgctcccaggttaagaatataaaattatt

SEQ ID NO: 116967 - DNA, 1022 bp, Homo sapiens
aaaccctgtatttcagtgtcttaagatacagtgatattctgactctgtttctacctgaggtatatttggatacatactccttagatcttcaagctgattactaggaccaaaccaaaatttttgtttcatacttagtgttttgccttttgattttattcatttaaatattttcagcattattctcactctcagtacatttcccccgacttgagctagtcagtgtcttcagtcatttgatttttgattttttaaaaaagttattttccattttcttgatgtgatagtttcttacactttgtgatattcaatttgatgactttttatgtcttatttctcagattatacactaagcctaacttctggttcctaggtaagtcagtaatgttgtatgcagcagaaatgatacctaaactaaaaacaaggacacaaaaaacaggaggtgctgaccaaagtcttcaacaaggagagggaagtaaaaaagggaaaggaaagaaaaagaagtaacctagtatcagcatcaagtatgtggtactactgtaagagacatgaatggagacttctaatttgtatcggagggaaacagaagctttttgtttgcatcatttaactgaactgtgaacccttgtgcctctcatctttatcatcggagttgacagtgaaacaaatttacatcagaagtttgcatctcgcgtatatgccgtataaaagaatttttttgtctttcaatgcagttttttggaagaaaatatttttaaatggacaatggactgtacaataagttacttgaaataagttgtttcagataaatttcaattagatttaaaataaacattttgtccaccttttaagttaatgaaataaaatttgaaactgacttttgcagcttttgcttatatactaatgctaggagaggagggataattaagaataaaatatgtagtgaaagtttccatagtgtgaggctaaaactagaagaaactgtggtaggtccttttgtgggtgggggacaggggagtctgtaa

SEQ ID NO: 116968 - DNA, 1060 bp, Homo sapiens
tgatgacctagttgtcatcagattgataatatattgataagtgaaatcttacaggcaagcacacagatacaaatagaatttgaacactactcttaaggaatctctgcttctttcaatgcttaaaggagaatagagggcagacagtttcggtgacactgtcacaacaaggggctaggctagatgaccttcaagtattttgctcaagtatttaggatttgtgctctaagaggtaccttctccatttcctggaaaccctcttagcccagaccacaaaccccaacatgatcgcacctgaacatgagtcatccaagttttgttatctagtagctacattaggcacaaagcttgcaagcttgcattccaaagaaagagctttgatatatttttctttccctcctaacaaacaaacagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataata

SEQ ID NO: 116969 - DNA, 1088 bp, Homo sapiens
aacttaccaagataagcctaccaagcacaggcctcctagatattaggcttatctgtacagggctttatacatgcagataagtactatattttcttaaattgatttctaagagttatgattaataaaagcctcttacagctatatactaaaacgtggtccaagttaggaagatagttaagctcctggacctggtgtgttttaccttttgttttttagtctcagcttttccttaccagctcattactcatcatgttttttccatctaaagaaagcccacctttaacctgcagaaaacactggtaatgcctttggggaaaataacagaggcatctcccatccccagagtagtgaaagacagtgtgtattctcagaatgtgccccctccaccctcctgttacccatgctggctctttttctgtgcagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaaggtaagactcaggaacaagatggccccacatgtgagaggagatgtgacacactgggctcaaataacaggcttcctggccttcttgtcttatcaccacccctcagccaaatgccaacattactctgggatttctttacaaagtctttgcctattgagaacacttacagttctcgacttttcccaagactcttcctccatgccacatttaatgtagccttcagtcagaacattaggaaaaatgactttccttggtaggcagcgattttagagaatcatctatattgatatgcaagtccatctcttctaattgtttatttaatttttttgtattatacttaattacataggtagttttaaataaatggagaaagcacctttcaaaagctatactagcaggaaaaattccatcaagcatttacgtagtaaatttctataattttacaaaaaattcttgatctttacttgaactgtacatgaggggaaaagagccccctcag

SEQ ID NO: 116970 - DNA, 2000 bp, Homo sapiens
tggccataagtaaatattttagaactctccttttagtacatgaaatgaaattcaaatttatgatatacttaattacaaaaaaagtctaactgcaatataaaggagaaacaaaatgaaagtaatttgtaatatatataagtatgcaaacaaaacaatactagaaaacataaaatattcataagtagaatcactgacagtggcagctatgaacaaaatcttccatatattcccataggttaagaatgtctgaggggtcaggcggtgctggcaagatggctgcacttgagaagatgacgtttcccaagaagatgacatttccagagaaaccaagccacaaaaagtacagggccgccctgaagaaggagaaacgaaagaaacgtcggcaggaacttgctcgactgagagactcaggactctcacaggaggaggaagaggacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacagctgcaatgtgaattctgcccagtgacccggtggaaaatggcgatttgtggtttatttgaaatacaacaatgtccaagaggaaaacactgcaactttcttcatgtgttcagaaatcccaacaatgaattctgggaagctaatagagacatctacttgtcttcagatcagactggctcctcctttggcaagaactccgagaggagggagaagatgggccaccacgaccactactacagcaggcagcggggaaggagaaaccctagtccagaccacacctacaaaagaaatggggaatccgagagaaaaaagagtagtcatagggggaagaaatctcacaaacgcacatcaaagagtcgggagaggcacaattcaccaagcagaggaagaaataggcaccgcagctgggaccagggccgccggagccagagccgcaggagccaccgcagccggagccaaagttcctctaggtgccgaagtcgtgggaggaggaagtcgggtaatagagacagaactgttcagagtccccaatccaaataaactagttttgttcttaaaaaaaaaaaaaaaaaaaaaaagaatggaccaggccaggtatagtggctcacacctgtaatcccagcactttaggaggctgaggtgggtggatcacttgaggtcaggagtttgaggccagcctggccaacatggcaaaaccccatttctactaaaaatacaaaaattagccaggtgtggtggcaggcgtctgtaatccaagctacttgggaagctgaggcaggagaatcgcttgaatctggaaggcggaggttgcagtgagtcgacatcatg

SEQ ID NO: 116971 - DNA, 1028 bp, Homo sapiens
ccactagtccaaaaattctattttttgagacacagtctcgctctgtcacccaggctggagtgaagtggcatgatgtcgactcactgcaacctccgccttccagattcaagcgattctcctgcctcagcttcccaagtagcttggattacagacgcctgccaccacacctggctaatttttgtatttttagtagaaatggggttttgccatgttggccaggctggcctcaaactcctgacctcaagtgatccacccacctcagcctcctaaagtgctgggattacaggtgtgagccactatacctggcctggtccattctttttttttttttttttttttttaagaacaaaactagtttatttggattggggactctgaacagttctgtctctattacccgacttcctcctcccacgacttcggcacctagaggaactttggctccggctgcggtggctcctgcggctctggctccggcggccctggtcccagctgcggtgcctatttcttcctctgcttggtgaattgtgcctctcccgactctttgatgtgcgtttgtgagatttcttccccctatgactactcttttttctctcggattccccatttcttttgtaggtgtggtctggactagggtttctccttccccgctgcctgctgtagtagtggtcgtggtggcccatcttctccctcctctcggagttcttgccaaaggaggagccagtctgatctgaagacaagtagatgtctctattagcttcccagaattcattgttgggatttctgaacacatgaagaaagttgcagtgttttcctcttggacattgttgtatttcaaataaaccacaaatcgccattttccaccgggtcactgggcagaattcacattgcagctgtcgtcctgcataccatcgtccgttaaacagagaaagggctgcttggcattcttcttccgactggtactgaacatatacattgcccctcaggtgaggttccaaattgcagctgaccttgaactgaatcacttt

SEQ ID NO: 116972 - DNA, 1050 bp, Homo sapiens
gtcaccttcattttaactattctccatacctcttgtaactcttatgctccctagccagagttattttttaaaatacaggttcatctatttagcaaaaatcaaatgccagtcacatgtgtggcactgtggtagcactttagatatggcaagaaataaggtagtcatactctctgtccttgttgaatgagcagtctacccaggcaagaaataggcaaagtagtgaccgtgtggtaagccctctaaagtaaataaacagttctggtagagaagacctgaggaatgagaaggggccagccaagagcagagccagggagagggagaagagtgtgtcaggccctgaggcagcacacagcttagctctgtgtgagcaaagagtggtgggggaggcaccagagaggtgcaggtgccagcaggtagggtcagtggtagaagtgtgcatttcattccagatggtggtagggagtttgcattttctgattgccttggatgggttttaaatagggggtgacatgatacgatttatattttaaggtcactttggctgctgtgacctctgtaaggagttcgcgatcttgccaaactattgccagtaatttacttccttcctttctcacctttcagcctttctcttgctgtttcctctccttgggccatcacaagaaggggagtagtgtcagtattgggtcaagagactgcaggatgcaaagatgaaattgggaaaagctcacttggcttcctagcttttctccctttggactccctttggaagtctgtgagtgaagctcaggtgcacctggctcctggtcagggtctgctgcacgttggagcatgtagatggttgaagacttgcccagtgctcactggggagcaaccagtaccttattgtatacccctcttcctactggttgttctttccgtgtgcataatttccctttgagctctttgagaacagggtctttcatctctgacttctagtttctagaatttttggccatcttatataggcaattcggaatctaattccagccttcctttcatcaagaactgttg

SEQ ID NO: 116973 - DNA, 1861 bp, Homo sapiens
tgcaggcgggagcaacaaggacgcctgcctcctttctgcctgctttttgcaatagtccgatttgagaaggggacccacgagagacacaaaatgcacgcccccacgccacatcctttttaccccgcaatgggttaagactgtcaacaggcaggccacctcgcagcgtccgcggagttgcaggcccgcccccgccagggtgtggcgctgtccccctggcgctgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgggtggccgggggtcgccgccgctggtagggccacgggagccgccgctgccccagctgctggggaaggaagcagggagaggactcgggaaaggtggagtcggagacagacgggacaagcagcatattcagggatcaggctggcctcccggaaagcgtgggcatcggaggaccccgcgggggctgcccaggctgagggtcgcggggctggagggcagctgcggcgccgggcgctggcagctggaagggccagcgctgacgtatgtctgccccgcggcccggcgccctattcctgctgtcctgcgcggtgggcgcggacggcggggcccctgcgggcgggcgcgttgacggaggtacccggtcctacccgaccctccgtggagctccgcccggagagggcgcctctcgggtgggcgggggctgctactgcagcgtgtgcgggagtccgggcctctcgggacgctccccgctgagcgcagcttcccaggctggagcgctgcccagcaggccctgcgagagggcggaagcgggtgcctgggaccgtcccgggcgccgggggttgctgcgcaaagcgccggggccccctgcgggaggtaggagaggcacaatggtggggctgcctggtatccccagacttcaaggcatagcccagcggacgcgcaggcccagctttcgtgtggtttgtttttctcgctcctttaatcgagtcgagaggaaaactcctacaacaggcccagcctcgcggtgtgggcggcggctgtcccgcgtgaacggctctcatgctgcccgacccacttctctccttgtggtccccaggtgtcatcggactggtggccttgtacctggtgttcggttatggagcctctctcctctgcaacctgataggatttggctacccagcctacatctcgtaagtgacacaccctgcagccgtccccttcccttcctccattcctccccgcagggctgctgcagtagactgcacatccgcaattcccgggagaaaagtgaaagctcggcggggagggatgaggttggacataaggggtggggatagtattcaccattttggaaccttaacttaatccctatctcttgacgattagcccagaggtattttcattagattatcctggtgaccagtgtcccctctctttggcacactaacaggaaagcgctaccactctgtcgtcctccctttactggtgggaggatctcagaaggtacagggagctgagcacttctgtctagtaattattttaatgagtatttcaccatatatttatgcacctagagagtaaaaccctatcaattaggtcttccttaattcataattacgt

SEQ ID NO: 116974 - DNA, 1076 bp, Homo sapiens
tcaaaagtgttcttaattccaacttgcaattttgatattgagaagatcgaagccattcagattttttttctttttacttctaatttgtgccaaggacaaaagccattcagattcttaatgttttgtatatgacctttttttttccccagtctggatgcttctaatatcttccttccatccccagtgttgtgaaattttgcagtgtctatttttgatccactacactgtcattccatagactatacatacttggaaactcatatccttcagtgctgaaaggtctcgtaagtcaatcctactgtgagtctttatgtttctatactgccttgccaggcatggtagtacatgcctgaaattccagctactaaagccaaggagttcaaattcagcctggtcaacaatgtgagaccccgtctctatttttttaaaaaaataccccccatatcaattacattaattttgcttttcatttttcccagttctcctcagcccgctctgttgaaatgctgaaattttaactgtcagaggcaaccgtaatattgccttagggacttgtggggaaggggaggggaattattcagcgtagtgttttaactttcagaaccaagtagtctattttctctatgtaagaaatgtgtttgtcttacttgaagagaaacccagacttcatcagtttttgataacatcttggtttctgaaggaacttcaatctgtaattggcattcagaatgcccttggcatggcagtctgtgtgatggcatttaagacctgtgaaatccttgagcccaacttgattaatcaacactgataaccaccacctttatcctttaaagtctgctttatctgtattttaaaaaatgaaaaaccctcaagtgtaagagccagctccctatctactcacataaaggagaagcgtattaatgaataaacctcccaaatgtctcatcattaatataaaaaggcatccaaaaatcacctaccatctaaggaaaatgtgaagcatgacaagaaagttttttaactgacgctgaagaaaacataattgaggaaccagaagaaaacaggagtgagggttg

SEQ ID NO: 116975 - DNA, 1019 bp, Homo sapiens
tgaaagtttgaactgaggctgtgcaggtgaggctttttgggaagtcctagtatattaatgagcaacagaatattggtttcttttccaatatttcttggtaatattttgtatgtgaagattatgtaatagcaaacattttaaaattgtatgaatatatttacctgtattcttggaaatgttgccagacatgggaggaagcggaggttttcttgctcacttttgttgttagtgagctcttaagctgatctctgtacttgtgaacagagggtacacaggctcagaacaaactgtattaaaagtgagatacatgtggtgtctcctctctaagactcatcttccctatagtatttctctcaaatattaattgcttccttgaacagtactgctcttggtcccttttctcagttggtgggtcaggtatgaagcacttaaatagcttaagataaatcgttatagtttgtaaatgtaatttttgtatgtgttttgtttttgacagccgatttattttgcatattcccagcgaggaaagagacaatgcaatccgagtgtgttttcagattgaacttgcccattggttttacttggatttctacatgcagaacacaccaggattacctcagtgtgggataagagactttgctaaagctgatatcctttttattactataatgactgactttcttgttagcaatatattttagcacaaatttctttttgcttgccttttcagattttaaaactattagagaaaaacatacttgattgctaaaatttgtcaaacataaatagtagacacaatttagtaataatcatattaataatcataatcattaatactcataataatcatacagaggacgccctaaaatgtacactgattaaattttatttttttcccatgcatagctagcctgtttgtacaactttactcttgctgctgcatgtaaccagatgatcttttaatcagattactgcctttctgatttatttagaattttttttcttttttttttttaaga

SEQ ID NO: 116976 - DNA, 1049 bp, Homo sapiens
gaatagctacatggagaaggaatgtttaatgtggtacacttcattaagtaacttcatggttactctgtgccaggccttatgcagtgaagagagtagactcagtatcttcaagaagatgagaaaagacaggaaaggaaatgattacagtgcagtgtggtaggatgtgatacagaagcacagtgttcagtgggaacagaagagggatacccacttacgatttggaggctgtgagtttgattcccatcttggccactcgaaaatcttgggtaggttatttaaatcatcttagatgaggatcccagtttcttcctgacaaagttattaatagtgcctaattcaaagggtaagtttaagaaacacatatatttgtacatgtaagtcgtttacttggcacagtgatcaataaatgttaatgtaataaatgttaactattactccaaaaaaaaaaaaagatttgggagctaaatagaagccttctctgagatagtgatttatgtgaggaaaatcggaggaaatgaaaaaagttactgtattttagactaaatgggaaagataagagatgatgctacagagtaattcagaggctaaaacatgtaggggtcttgtaggccatatttctttaaaaaacagattaaaaaaacttattttgggaaaaaactttcggagatggccaaagaacatgacaactgccatcatacccttcatctgtattcattcattattaacgttttcctacatttgcttatttctccgtataggggtatttttcaagactgctgtgaaatagtgtgaacagtgaactgggggaaggcaagattggattctgagaatccagttaacatgctattttattaatttactagagagagaaaacctgtggtagtagaaatgaatagaagagatcaaatttgagagctatttaggaggtaagattggtgatgatttggatatctgaggagaagtagaagaaaggatggtacccaggtttctagtatgagcagttgaggatcccagtttcttcctgaaaaataaggttactaatagtgcct

SEQ ID NO: 116977 - DNA, 1404 bp, Homo sapiens
cttctgtttcttgctatcactttatatatgtaattctatttcttgttattacgctaatatatataactacctggcattatgaatttgactcacttaacgagaaatgttctaggtgtttacatggtccagaattagtttgtgttagggatccaggactgtgagtactaaaaacttgatttgtgtgtaggctacaaatgaaaaagttaacaatgactttttaagagaaaacaaatgtagaaaaaacaaaaacacagtctgcctcggcctcccaaagtgctggggttacaggtgtgagccatggtgcctggccaaaatgctacacttaaatgagggaagatttgaataatttcacatgaaatacactattgatttaaatgggtctctttctgtatataatttctcaagccatattaaaggagaaagtaacttccttgacactatttatactcttcagtcattgtccgtttttgctgcctcaaggtgaagatgtggaaaaagttttggatgaatggaaggaatataaaatgggagtaccaacatatggtgcaattattcttgatgagacacttgaaaatgtgagtgtaatgaaataaagatttttagtgaaatggtgatcgttaatctgttaacaaaatttgttattgatgtagtgtttctaaattgaggttttaaaatatacttagatttttagtgctaaaaggccaagctttgtatattttatccgcatgctatgtctgcagattttttacttgttgcagttacggtgtggtacaaaaaagtgtcgcttaattgttgaagactttttttttttaaatgggcagaatgctttcacactggtggtgatgtattcagactcactgaagatactttaagaaaatactctgtaaaattattggcgataacagttacctcaagtaaggagaaaaatgcctttgatttttagaaaggagcatggaaaaggagggcaagtttgatttttacttctgcttgttttgtaggtactactagttcaggggtacctagcaaaatcaggctggggatttccaaaaggaaaagtaaataaagaagaagctcctcatgattgtgctgctagagaggtaagttattccattttgatacacagtaaatttggctattagggtctgaatgtattttttttagccatatagacttacttctttggactgtcttaaccctttccagaacttgagtgcatgaagtaacttactttttttttttttaaatcactgttgattgttttatccacatctcttttcatttattcttatctgttcccattttttttaatggtccattttgtattatctcttgttcctttctttgatgatatttttcccacctttccctttagaattagatttcctattggtaaaacattttggc

SEQ ID NO: 116978 - DNA, 1051 bp, Homo sapiens
taaggatgattacattgaacttcgaatcaatgaccagcttgctcgtttgtacatcattccaggaattccaaaagacacaaaatttaacccaaaaactagaagagaaattcgggtatgtaacaagagtattttcaggttactggacagtatcccaaatgaataagtagggaaatccttttataagctccttgataaaaattaactaaatgaattattttcttctgtgtttcagaacattgagtggttctctattgagaaattgccttgtcatagaaatgatatgacccccaaatccaaacttggtttggcacctaacaaattttttatggccattccctttatcaggtgtgttcatatttcttgaaatgtaactttcatgattgggatagtcatcttctgtctgtagccatattttgaaagtgaattcttaatgtttctgcagaccattaagggactggctttctcgaagatttggcgattcctcagacagtgacaatggattttcctcaactggtagcacgccggctaaacccactgtggaaaaattgaggtaaagaaatacattcatggaatcctgattttctaatagtttttaaaagtggaataatagtattttgcttctaaaatttgcagaggatgtaagatttctttttatagatactctttgttactggtctcacagataatagaagatttttttaaagggtttctgatgagatgaaaaaggttaattggagttggaaaggagcttcaggcaccttttaaaatagtatactcaagaggataccaactttttagatagaacactaggaaaggaaaaaaaatcttgtgtcgtgtgttcttagtgttacttctctgttgtcatatcctacttttaagataattgagtttctaaagacgtttggatggaggatatgttgaggtttgttttcttgtaggggagaggaaggatgctaatgtagtttgttaaattggagatagaacagtgaagacttgggcttttaaaaaaatttcccagcaagggacagtggctcacgcctgtaattccagc

SEQ ID NO: 116979 - DNA, 1120 bp, Homo sapiens
ttctcagatcatctttcagctaggatgtggtctgtaactgacttgtgcagggtcaaaaaattagcagggcatggtggcgtgtgtctgtagtctcagcaacttgggaggctgaggtgagaggatggctcgagcctgagaggttgaggccacggtgagctgtgatcctgccactgcactccagcctggatgacagagggaaacccagtctcaaaaagcaggaaaatgtacattcgtttcatctaaatttagatttatagtctgcatattttttaagagtacactataatcacttatagggaggagatggcctggataatttttttaagtctaggatgaaaaaaaatagtagtgtattaattcattcaagaaatatttattgaataccaggcactcatctgggtgatgaggataaagcagtgcagattaaaatctctgctctcatagaacttacattccagtggggaagatagacagtaaataagaaaatatgtagtctataaatttaactattaaggtgttaaaagaactataagtgaacattttctgatttgattattttttaaatcttggtgtagtcgaaccaaattccgccacagtcagcagttatttcctgacggttctcctggtgaccagtgggtaaagcacaggcaaccactgcagcaaaagccatataataatcattctgaaatgtctgaccttttaaaaggaaaggtgagtgatacacaattacagtcttttcagaaatttagatcatttggctttgaaatttttctcaattggagaattacatcttaatagttacagagagctctgagttactgatcaaagcctgtatgttccttacttatgatttgaagcagggctgaggcttcttaatgtttacagttccggtgtaaatccagttaataataagaattagcatctgacttttgtgtatatgctgccaatgaaaggttcatttaaaaataagtcataaggaaaatattttccaaattaacacaagtgggatctattggcttttgttcaggaagaaaaagtaacagcgtattgtaaacttcgattttcattgttgtattcgagtgtataattacactgctattaatacttgttttcctttttt

SEQ ID NO: 116980 - DNA, 1022 bp, Homo sapiens
aactggctgaaacaaattcatttagataaaattacttgccttcagactgtgccgtttcttttatgaatgttaagccttagtgctatgcgtgaatattttaaatacgtaaataattgcataaggatttggggagagtagaaagaatccagtattgtaaaggctaggaaacctcactctcagatctatataaggggtgcactgactttagaaggggaacattttggggaggtaatcactgtggttcttcccatacacacgttagtaaatttgtatgccttttttccaattaaaaggaacatttttccctcttttggaggcagtgttcaactttttaaggtgatactaagtatgagttttattaaagatacttgcaatttctccttcctcggttatgaaaactaggtgtgttgtctgattcggaaagtaatcctggtgaatgtagaaagctctttgttaaatactgatttagtagatgatacttggaagtgcagtagacttttttcttaggtgctattttgaattgtatgaaatttcctgtgcagtagatactcatttattcaccatctaaatttaaggctttcatatagaaaagcctaagaaatgaaaaagcattatcatattctttttctgtaatactgtctgtgatttaagcaagataatgctattttgaaagagatgccttaaccctattatggaaagttactgttaactgtgaagaaaggaactatcattagaatttagtttgatacagtcccacttgtttatttttgtttttgttacctgtgcttttgcggtcatatccaaaaaaaagtcattgtgaagatgggcatcagagagcttttttccctgttttcttctaggaatgctacagtttcgggtcttacatttaagtctttcatccatttcaagttcatttttatgtctggtatatgataaggatccagttcttttgcatgtggatatccagttttcccagcaccatttattgaagggtctattatttctcctcattagagttagta

SEQ ID NO: 116981 - DNA, 9385 bp, Homo sapiens
acagaatgcacataaaataggtaaagcacatacaggaggtaaagttacgctcattttgaaagcaaaggaatgtcaagggtcttaatggctgagattaagattttgaatatgtggaaataataatagattgaaaatgcagttgaccaccagtttatggaaaggaaaatacatattttggtggttctgtttagggttagagtctgggaagataaatatatactcaaaactaattgttttgtaacaaaaggcaaagggcagtatttgatttcttactaaggttactgagcttatttattttgttttttctttaaacagatgctgtatatgacttgcctagctccagtgaagaccagttgctagaacatgctgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctgagatgtcacattcgtcagcattacaggtgatctattttggtggcattttgtacttctctctgcttctaaccactgaggctctctaatcttcctctggagttttagtgaaaggatttattgagcagcttctggaatataatgtgcatgtccaaaatgaactcagcgcttcaaaaggacaaagtctgtagcctggaggggcttgagtggatgggagctgatgctgtgattttgagctgtggttacatgcagtcagtaaacctgtgagactgctggaggaaatgtagcagacagcatggaggctgggacccagcagctactttgggtcatgtctttactgtcctgcctccaaccctttagtctcgtagacttttgttcttgtggaaatttcttctgtattccagttgtgtaaatatgtatggaaaactgatattactaggttttacgttgcatctccagtattgatctttggaaactgatgttacattaggttccaattcgcaatagtagcagagactgacatgcttttattgacctgctaagcccctggatgatggagcgagaagggaaggggtatgcagtttacccaagtccaaataaagcatttcactaggttacacgttatgtatatgtgttacataacagtaacatacataactcactcctaggaatgtattttgcttcaggatttttaaattcaaataaggatggcagtgcccattttaaggaggatttcagctataactgaggacaatcaccagggcgttaagggggctttagtgttttggctgcatctgacctcattgaaggaatttcttgggagtcgggggtgtttgagtatatgtgtgtgtgtgtaactatcatgtgggttttaaaaatccttttttacagtggtatccacaaaatacttctctgcttataaatgttattgtagaaatctttattctgtgtaggtagcctatttaattgggttccactgaacctcatgggacttttaaaagaagggctatttaaggaattcacttggtagtactttgctttagcttttaaatggcttgattttaaaggagaaattctatttattaatgaaagtgtcacccttttggtgctaagcaggagaattcacaattaaagcagtgtgtatagaattatgatattcagaatcctgcatcttttaatgtgacaaatttttgaatcctgtgacttttgctttttaatgcattatatgattgtgtttggaagcttttactgttcttttcagaaatacggctgctttgcttgggtctcttcgagccatatttatagttggtcccagcattccagacttctggtaaattgttaaaggagtgaaaatgtagtttgcctggcagatgaataattttcactcatttattgtcttctggaaaccatttaacttttactgttttttatttttttggtatgtgtttttttttttctttttaagtgcatactttggccagtcttcctggtgcctgtagagttggatttttcagctctcaatactgaagcaaaagagattatagttaccagaagtatggcctctaatggtgttgagccttttcaagaaccaacaaattatctttgtgattacagtagtttaactatggttaaatgttactgctgttgcgctgctttatttaatgcactgtggaacaaaatataagggtactgttggggtgtgattatgataacttcaggcttttagctctcctcaaagtttgaggttaaaaaaatgttaaaagatgtgagttaaagtttatgtgtgtgatgtgacttaactatgcagaaaatatttaagttggatgtacttgttttaggtacatctactatacttattctctcaaacctgggtaatagtttctcagtgttcaggttaccttgagaaaggccatgcttagcgaactggatttctcctttgagaaattttagtatggtttgaggaaatcaagtgataaaggagtatgctgaatatgcaatcatttacttctactgagtgctgcattttaagatgctagatgagaagagtagttggttttgcttcattatgttttatgtctttgagagagatacaggtcttggaattcactttttaaatgttacgttccaaccttatatgttccaaggtgcagtgcactgtgaatcttttatttttaaaaaaatttgtaggtgcttttatgtataactttaatgatttataagatgctaaatgaattgtttttgtacctaaccattgtaatccaaaagataagggtgtggtttacatgcttttcaaaaatttttgttaagaagtagcaaatgaatggtttaggatttcaaatagtgataccctcctgagacatgagcatttggagaggcctgagaacctaatagaactcatatagtgtgagtgaaatttgattaaagatgttggaaaatgaagttggatttttgtattcatgtataaaggaaagtctcccagtgctgtcaaaggaattgtggttactacttgctgttctgagctttgaatatcgttatttttctattaaatatcaattagtaagtatagctaatgaagacatataatgaaagtaattttatgctgtaagattgaattggtacttttccttattaaggctttagtaatttgtatgtaatgtcaaataaaaggaattcaaatctgagtaaataacagcctcctactataggaattagattcttctataaaagtcaccatattgtatcctatagaaaagttaaggtctgagtgcatgtgtgcattaaaaacatttcactacctattctctcatggacttctcatcctttcttttttcatctccaacagttaaatggtaaggagagcaaagttaattataaaaattagacattttgccaagttagttttcttaccacaataccctcttggcttttttttttttttttttgagatggagtttcactcctgttgcccaggctggagtgcaatggtgcaatttcggctcaccgcaacctacgcctcccgggttcaagtgattctcctgcctcagcctcccaagtagctgggattacaggcatgcgccaccacgccctgctaattctgtctttttagtagagacggggtttctccatgttggtcagggtggtctctcttggctttttatctttatttttgtaccagtggaccttcctgctccctgagactgttttgattgacatcttttgtgtttctatattttccgaggcagtattttctttgtatgttaatcatagttatagtaaagtcagactcattaacttttcttcctagtaattttgacttggattattttctagcctgggggatggggttcatatgtgttgttgtaactttagattactaaacaaaacaaactgtttttttgtttgaaggtatcctttacatacctgtctgtaggtaagcaagtgttagtaaaaacaattttgtcaaacagtactcctgacagcttggtaaagtctaggtagagtttctgattttgtattatgtcctaagacttgaaagtgcatttgtctagttgccaaaagttctaaaaatgagatggtgggctttctcagcatctttttgcttcctagaattgagttgctcttgaagtctgtactcctgtgtcagaaagatggcagactgcaaatgggcagtacaggctttgccccatgctttcaaagtaggattctggattgcagtttcaaaaaaatatgatagattattgttatagaatcaaagtgtcctgaagggagaagaatagctatagttgctgggcaaagagtgtaagaaagaaactttagagcatttatcaatacttgagtgctttattatgttccaggctagaaatgtgatcattgcatggcctaagtgtagtcattcatatatatatgaatatctatatctatatctatacatatatatgtatcgccattatcgagtgttttctagccctggataaagttaatttttttgaagtttgattgccaagcaatccagtgaatctaaagtaatttttctcactttaaagaccagtgatgaggagtctggtccttcctgtactgatactgtagaactccagtcaaacttcagtgcactgctttcttacaggaagacaactcagaacacacagccataatctgctttggtgtcagtcacatcacagtggttatacatttgtcctgaatggtgattcattcctttccatctaacttccttgtgacaaatagcatttactattgaaatagtcttaaaatagggaaaagagtgaaagttactcttatgcatgggagtgggcttaaagggttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgactttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagactataagtgaatctacttcaagggattctgttcatggtggtatacagttcttggtgctcttttggaaattgtcaaacatttactgatagcagaaaaggaaccccaaaacacctgtagtgttcaccttgttataagaacagaaacatttggaacaggtttcattctgtttctagatttatgttgttgtagttgaacagcaactgtttttttccctcagtgttaacgaaaggataaagactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttaccaccttagcctggttttctgctactgttatttatcatcgtaggttctgagttgctcattgtggttgctctttggaccaataaaaatggcaagtatgagatgaacatgataaaagtatgtttatataacaggaagaagctgggcgcggtgctcatacctgtaatcccagcactttgggaggctgagttgggtggatcacgaggtcaggagttcgagaccagcctgaccaacatggtgaaactaaaaattcaaaaattagctgggcgtggtggtgcgtgtctgtagtcccagctacttgggaggctgaggcaggagaatctcttgaccccgggaggcagaggtcgcagtgagctgagatcacaccactgcactccagcctgggtgaacagagcaagactctgtctggaaaaaacaaaaaacaaccaaaaaaaaaaaaaaaaaacccccaggaagaaatattgtcgagagtctctgcaaaaatgaaaatacctcaaacaattaagtttgttgctttaaagcaagattatagtgtagggcttgagatgtgaattcattagatatttaaaatccagcaattcttaagtttgtgctagaatcaggttttgcaataggaatacttaactttggatctcaagggggaaagaaatacattcttttccattagagacctcagctatatgatagtaacttttattttaaattctcaaaaggagagtgactaaggtgttatacttactgtcaaagttactttgcttccatagtgaaaacttgagaacattgtaatctttctctaacagatgtgttgcaaagctgcttgccatcttgttgtcctatatgacttccttgcatttccagtccttgattacattccattttaatgatctttctttaagaggggaaaagactctcttcaatagataacttcctatttatgccaaattttaaaaagccaactaaaaatgggctataaatgagggttctttggccattttgatctaataatagtcttacttctagacccctgctttgactagggctcttgatttcatgtaagcatcatggatttgatatttgcctgcatgtatatcacagttctacagaaggatagccttaccctttaaataacacagttaaggtacactgtggaattagaaatatttattcagaatataagaatgtttgtaaaatattataaatgtctctgtataaataaatggagtttttaaaaaacaattctatatcaaataacgcaaagtagctattttacagcagctaaaactaaaggcatctggaaacatttaaagaatacaagtggagaatctaaaaaattacaaggtatagtacagtgttaagtagcaattttaaaatgagactttcagtacaaacagtagaacaatactgacaaatgcaaacttagtcacatgtgct

SEQ ID NO: 116982 - DNA, 1050 bp, Homo sapiens
aagaaaactaacttggcaaaatgtctaatttttataattaactttgctctccttaccatttaactgttggagatgaaaaaagaaaggatgagaagtccatgagagaataggtagtgaaatgtttttaatgcacacatgcactcagaccttaacttttctataggatacaatatggtgacttttatagaagaatctaattcctatagtaggaggctgttatttactcagatttgaattccttttatttgacattacatacaaattactaaagccttaataaggaaaagtaccaattcaatcttacagcataaaattactttcattatatgtcttcattagctatacttactaattgatatttaatagaaaaataacgatattcaaagctcagaacagcaagtagtaaccacaattcctttgacagcactgggagactttcctttatacatgaatacaaaaatccaacttcattttccaacatctttaatcaaatttcactcacactatatgagttctattaggttctcaggcctctccaaatgctcatgtctcaggagggtatcactatttgaaatcctaaaccattcatttgctacttcttaacaaaaatttttgaaaagcatgtaaaccacacccttatcttttggattacaatggttaggtacaaaaacaattcatttagcatcttataaatcattaaagttatacataaaagcacctacaaatttttttaaaaataaaagattcacagtgcactgcaccttggaacatataaggttggaacgtaacatttaaaaagtgaattccaagacctgtatctctctcaaagacataaaacataatgaagcaaaaccaactactcttctcatctagcatcttaaaatgcagcactcagtagaagtaaatgattgcatattcagcatactcctttatcacttgatttcctcaaaccatactaaaatttctcaaaggagaaatccagttcgctaagcatggcctttctcaaggtaacctgaacactgagaaactattacccaggtttgagagaat

SEQ ID NO: 116983 - DNA, 1068 bp, Homo sapiens
tcaggactcttctctataaaaaacggaggacctcagagagcttttgttcctgtaagttgtatttattgatacttctcatgttagaactaaaaccaagataaattatttaaagtttttattatttcatttacaaaaaaaaaaatggcatttttatgaaaaactattttccaagaaataattagaaaagtggcactggtcttacaattctgcaaatctttaatgtctggcttaatagaagacagctaggttctcacatttgcttctgtagtcaacattatgtggatgtatattgagaacacctggcatcatccagctctatagttggaaataaaagctcaagacctcacagacctcctgaatgggttttacaaatctctggggtgagtcctcagactatctgggagaactgcagctgtaagggtaatgactgtacatggaatggacctacctgggctcactgtataccctaccaccaggctctggtgggaacagttcaaaggcctgtatattccatgtttggctttgcagcattggcttatggcctaatttaatattccgagtcccaccagcccaaagcataaagggaaggtggaacaagaacaacctctctgctctcgtcccaggtatggtcactttgattgcagtgccttaggagtactctcctgtaagatacacttgactatgttgcaagcaaccatggagcaacaaatagacccactatttgtatttatccgttttggactgggccaatttggattgctggtttgactcttagaaccccttctaatatgtgagagtgaccagcctctagcaatccggctggattcatcagggttaagccagtaggtgactggccgttgagtgttgacatcctggtgctgtccctcctctgaccactagatttcagattcttaccgaagaggatgagtgatctttcttcagagcagtgctcactagatctggttatccagtggacaggatggtgtcacgatgctacttaggatgaatcttaataccaatttcccttcattcccacctagcaacctggtggctgcctatgagaaagca

SEQ ID NO: 116984 - DNA, 1042 bp, Homo sapiens
ctggaaaacgcagtgcttatgcaggagctcatggccatgaaggtatgtggtgggtgggtcccatgtgctaggctgccaccaggaggaaatctaaacaacctctgaaagcaggtccagcagataaggaggaatcaacccctcctgcccagagaagagctagacccttgtttatagacagagctggtttcactatgtctgggggtcacttgggctgcgtgtttctggacaggggagttgaatttctaagggatttctcagggtgtcccagcccaactttggagcccttcatcctctaagagaagccaggtcagacctctgcagggtggagcctctgtccatctaaattgacccctaatctcaagaatgcttggaaatatgtcttgggttgctgatgctgatgttaactccggcagggggagaacagggtgaggccagttgtagagtttggccgagagccctagtttcctgacaccctgtacctttggtgcaatgtcgagcctgctcagaccatagtgccctccagtgaaggtgtacagtgctgttgaggtcagtgtttcagtggatctgaaacactgggcccttcagctgctagtggagatacctacctgctggtatttctacagaagggagctttcttggaaagctggtgtcccctactgggaagtagttaaaccgccatacctacaacaagacatcactttgcctgtttctggtgtggaatgccaggcaccagcccttcacctggtacctgctcttacaaggcagctgtggtataaataagaccatatctgatatttgtccttggttttgggacagagtttgagaaacccttggagtttcttgctgagctaggggtgtctttgtgatgctgatgaggtgacttatggtgggccctagacagcttcagaatgtgggctggtcaccagaaggaccaggcgtgtgttggaggattgggactttcagccacctgacctccggggaggggaagagagccagagattgagtttaggaccggtcaggaactggagtctagcaagccaga

SEQ ID NO: 116985 - DNA, 1049 bp, Homo sapiens
cggtaaatggcccatccgtcagcagccctgtggtgaggcaagacaagccagggcctgcctgggccttccctgaaacggagcatgccgtggcatcaagcattttaaaactgattttctttaaatgaaataatgcatattaaagtatcttttaaaagatgggaatgcatttaaaaatgattgtattgaatatctaaatagctgacatcttggataactcttacactttaattagaagtctggaagcatgtgccttgagttttatatatactctgtatgtgtatatgttggtaattgcatgtctgtgtgtatgggtatgtgtagacacacacacacacacacacacacacacacacacacacacacacacacacataaatctaaacctccatttgctttcccaaacaaaaagtattgtccttaatccattaaaatctagggtctcttcaaagcacttcaaccattgctgtaaaaatactttggcctttcctgatctgtggagtttattgactgtttcaccactaaaggtacttggtttctctagaatggggaattcaatacctgctaaattggatcaatataaaaatttatgaacaattcagaccttgtcagagaacccttttattcatgttcatagaattctctgtgggagtttccgcctggggaatcacatcagtatttagcgtgcactgaaatattcatgtcccctgattagctggatttaattgttacatcttcatctcctccatgatgtgtcattaggatgcagcccccttgaaatttaagttggtgcagccagcttagtgcagtgtctttattttgtctgtgtttctttccaaaaacccttgtataaccacataattttcgtttcccttgaaaataaatattactacaagttaggattttttagtggaaaataataacttatttttaatagctactattgtcttacaatatttgtataggaaatttttacaaaatatataaaatattcttctgtttagatttttaatttttaaagatcacatcagttgaaggtaataacctttcct

SEQ ID NO: 116986 - DNA, 1053 bp, Homo sapiens
gagaaatggtgcccagtccagaaatcttctttacaccttaagtgaaggaatactttccaagtactgaatctccttgtgtagttttatcataaagggacatgggccaggagagagttgcgaagcactgtgccctcaaatggcaggattgttaaatccacattcaccattttatttgtgtttccccactcagttcctgtatgcatgatagagttggatctttttcattcccaagtgctaaattccacttaaattgatgttttcctctgaggattatttacctctctcttgtttagtggaatgaagaaactaatgcactaacatagtctaatcagatataaaaattatttggagattcctttggggaagtaatatggaatgtatgtgtgtttgataattggaatctaagttaacaaagaggctagtgtttttatttagagaaaaattcctctttgattcatttctcaagtgcattgaagtcagacttttgaagaacccagaatatgaagtgaaaaaggatgaggagagttttgtggtgttctctcaattgattttttaaaaagcccatttttattgtggagcagtttaaagttttatatggcacctttcacctcgggcagctttaggaacagaatcagctcactcaaacaattccagaaaatctgctgggcacagcctaggaaaagcagaacttacaaggaacattttaggagcatcactggtaatcgcatgctcttggaagtttgccagaagactgaggttaccacctgaatttctggcagcgaactcaagaatcctaattggatcaagccttggttttatctcctttcataagatatttttgtctctttcatctacctttggactgaattgctagaacccaagagttcataatttaacaaggaacctgccactgcttttagtagcttgtgttctatttgtcatctgcatatctggggcctgtgaagaagtatagtattatgcacaaggctgggtggagcactgagtttccttgaggaaatgggcaggaagaagagtcctgttttaactctagtt

SEQ ID NO: 116987 - DNA, 1063 bp, Homo sapiens
ggtttatcaaattctctgctagtaagccatcttttataactaaatctaaatgtctctcttttctaccaagagtttattcttttttgttccccatcttcccctcgggaaatatttttggcagggaccttatctcaaaagcctttataacaagatctttttctgaaacctctgaagtaatactgttctccttggcctcagtgtcatgagaagcccagacttccatacactttctgatcccattagatgttgattacattgttggcccctactcctggtgacttttttcctttcaaagtggcagttgctgtgattgaatgggttttaaattgtcacagtatgagttctttatggctaggattcctttggattttccatcatttgtggggaagggatgaaaaacggagaaaataaaagtatgaggctttgtcagacatttattactgaaactgagaagctgaaactgagaagccttatattctctaggaaggttacagggtggtagcacagtttcaaaattaatcaccaggagttttgtttctcacagtggattccaaacctgctattatcctggtggcatacctcttcttggccttatgtccttggttgcttcaaggacataaggcttggttgtggcaaggactaaattctactttgcttacctttttccctgaccagttaggttgtttatggcttgtggagatatttaaaatatttcattgggttaaaaaaaaacagatgacttggagaacacaagagagaggacataagatatttctttggtttgtccctcaaggttgggttgaaccttagtgggaaaaaagtattacttttttttttttttttttgagatggagtttctctcgttgcctaggctggaatgcagtggtgcgatcttggcttactgcaacttctgcctccctggttcaagccgttctcctgcctcggcctcctggtgaatagctgggattacaggcacatgccaccacgcccggctaattttatttttagcagagacggggtttcatcatattggtcgggctggtctcaaactcctgacctcagg

SEQ ID NO: 116988 - DNA, 1005 bp, Homo sapiens
ttcctggatttactcttaaattgtcctaccaaacttttttgttttcctccttccactcacccagttttctggggatttcatcattcttttatcatttcatcctttctaatgaatttttaacttcaatatgcaatcttttctatatggatgtttttgttttatatatgtattttgtgttttctaatatctttgaccacactcagatgtttttccccctaaaattctcttctgctttagctccatgagttatgatctctgtcttctctgggatcggtttcattttttccgtatttatcttttttccccagctttcttcatatgtagtcatccttgcttacctatccatatggatgcctgaaggatgtgtagcagctgacttagcttccctcctccttgtgctcatctgctgcccctgttggccttttctttcactaggagtatgggttgtgagctctgaaattgagggcatagtatgtcaaagagcaggtttcactttagggtgtgtcaaggtgaagcaagcaggatggggagaggttcccacaatgccagaggagagatccccaccagggtctgcaagtccctcctggcagatcacttgctccctttggagagtaggtagatgtttgacttcagactaggggccaaccgtgccaccaccctgataggctggtgaaaaggaggccatgctaagctaccatcctgcaggcagttttgcagatgtaccctcctttcagtttctgtacgtctaatctcagatgctgccaacttccacctccattcttgccttccacctgcatgtgtcccaagctctgctgtggtttacttctcagtatgctctcatctgacctatacgaatctttagtccatttatgtgccccagtgggttggggtagggagatgtcttgcttcttaatctagaagccctggggtattacatattttaaaattacatttttgagaaattaattctcacataataaaaattcaagaagtacagaagggcat

SEQ ID NO: 116989 - DNA, 1010 bp, Homo sapiens
aggaaggagaaaaagagagtcatgataaagtgccatatgttaacttcctgtcattcttcttgcttcctttttcctcagttgggagaaagaatgaccagtgctaaggctaatgtagtagccctgtgcaaatcacagatgtgactctgatctggattccctttacttggctctccagtgctttttttgctaagcatttctgtttagggagcacatattcatgggacagttgtttttgaatgctttgcctgaaattgcttttatctccaggctccccatgtgtcagtttgaaagagaaagcgcttagcatgcagcctgggcatcacatgtgttctgagatgctggcacatggaaggcttaggaggttccaaatcattgcctattggccacccacaggctaatgaaggaaatgtcttttcattttctctgcttctctcggacttaggtgccttatcagcagccagggagagctgggaatacgactctggtgccagggacctccagagcccggatgtgcagagccagtcagccctccagaagctgctcgagtatggcggaagctctttgcatcagcaggctgctctccacaaactgctcacacagtccccgcacattggcaactctgtaggaggaagctatctagagctggccaacacagtgagtactttttggttcatggaatacatatttcggcctgtctgtattccaatacaaatattttaattttgtgctccaggggacatatcgggtattgtcttctttattgcggtaaatattgtaccatttccagcattgccagtaatgtttagtgttccaaagttgccagcacttagggacttcactctcatggagaccagagtagactcctaaaaggtgttttgattaaggctgtaacttgcacaggtttaattactagaagatgcacaacagctcttccataactagactacttctatggttctagacattacaaattaataggatatacttgcttctgtttcctaatttggact

SEQ ID NO: 116990 - DNA, 1053 bp, Homo sapiens
tactgatgtgaaaactcacagaagaagatgtattaatccaaatattagttgaataaaagagcaaagtcacatccaaacagagagctgctggacctcttcctgagagaaatccccaccgaaaaggtgcctcagatgatgtgtcacatgcctcaggcttcaccctttttcttgtgtccacaaattgtcaaaatttcccatggaaagaggattcccttcatgtatgatattccccaaagctacccatgacagtcatgaaaagctggaaatgacttcagctgcaaacacttgggaggttttgggttttttatagtttaggtattaacactttatatgtttaggtataaacatctgttttcatacaagggactcttcttaggcaacctctttacttcatgttgcttcagtttattttccctttttctcagctttcactgaatgtcatgtggatgaagcaagtttccagcttgattccttgccctaggatgtttacttgtcctttctttaagtatctattaaatatctatctaaatatccacagaatacaactaaggtgtgcacatatgtatgcatgcctgtgtgtgtgtgtgtgtgtgtgtgtgtgtgtgttttccatagcgattctaggactcctttttgcaagggatatctgttatctagttttatttgaagcatttgtctgccctttgacttttaagtcagtgatcacattggagagctaaaggtagaatgggcgagcagcgacagaggtttctgaggtggcacatgaatatggctccttctggtcctgtaggtccttccatcaggattgccactccaccaccagtcagggaataacagtgttcagaggcaaaataagattctgtgaacacagaattctggctttttcttttttttgagatggagtctcactctgttgcccaagctggagtgcagtggtgggatctcggctcactgcaagctctacctcctgggttcatgccattgtcctgtctcagcctctcgagtagctgggactacaggcacccacaaccacgcccggccaatttttttgta

SEQ ID NO: 116991 - DNA, 1037 bp, Homo sapiens
ttattattgtctattggaatagatcagcagaatatagaaaatatgtggtcctagatatcaaagaactttcactttaaatataggcacacaaacatattttgagctacatgaatataaaacatttcatacctcttctttattcctatctgtttagttaaatgtggatgttggctaaaatacgccattaggaaatttgttaacattaggacctttatatttaacacataattattctatttgatcacttaatcttacatgtatagcattaaacatatatgggatattttcttttttttgtaatatgttttcgtaatgtacgtgacagatcttataagtataatgtacattatttcctactacaaaaatttaattttccatgaaattattgatagaaatttataacaagcctaaaaatcatctagattatcaagattgttttatttttaatggttattgaatgatttatttttatcaatttttaaacattatgtaccagaaatatgtctgaggttcactttctaattgatattgaaattttgtaacatgttcaatgagaatattatgtgtaagagtacaattgagatattgcttgacaactttatgtagactgagtagagaagaaaacatttgaaaggaattatgttagaaattatgtcttttggcatgtttttctaggtttggcaaaaaaaattacttatttttaacacttctttttccgtgttgatcatacattttttgttcttttattcattttcaaagaaaaccgggaaatgagcaagacaagtgggcgactcaacaatggcatacctcagattccagtgaaaagaggagaatccgaatttgattcttttaggcagtctttaccagtgtttgagaaacaggaagaaattgttaaaataattaaggaaaataaagtagttttgattgtaggagaaactgggtctggaaagaccacacaggtttgtttcttttttgttgtttatagaaaaaaaaaaaaaaaatatatatatatatatatatatagtcccatattataa

SEQ ID NO: 116992 - DNA, 1094 bp, Homo sapiens
taactccttgtaataatcttgggtgatcagggacatcagatctgtacatatgctaatcgaaagctcatttttcattttacatgcctaaaaccaaaccccatttcccaccagcaaacctgttcttttcaggtttctttgttacctcagagaatgacattatcattcagatttgcaagccagacatcaaaggactatatttgacactttattttttttccatatccaatataatgctgagttctacggattttacctcccgcctagctctagaatttgtctgcttcttttttggttttcactattattaatctcattcaggttaacctgaactattgcagtagctgctacttggcttgacgtagcattctgctgtctttaaatccattctccatattgcagtcagagtggtcttctttgaagtagaattctgatgatgtcaagcactttactgagcttaaatctttgaatgacttttacctcaggataaagacataaacccttagtaagacttatcttttcctcttacctcatcttgaacgatatccctctccattcccacactcccaccatttttcaagtaagttagccttttagttccttgaaacacctttaggtccttgaaactcctttctagcacagggactttgcacatgctgtttttcatcatcattatacactttttattcttttcatatggctttgttattttgtttatcttcttgtttctcattttcttagtgaggatactttcttgatgttgtcaaatcccccgttacatactgtcatggtgtcttgtacttgtatctcaggactcttcacaactctatatttaccttcatattctggatttttggattgatttctgtctcttccactagcttgcctccagggaacaggaaatagctctgtttcctcttacaatttctacttataatacaaatgatattgatgccagacacatgataagtaggtagtaaacactagaggaaaaaacccaagcacacaaacagttgtctaatagttgtttgtaagtcaaagttatagttaaaggacaatattataagagtcacttgaactatgaaattgcttttgga

SEQ ID NO: 116993 - DNA, 1012 bp, Homo sapiens
ctgaacaaagatttgtgttctgttcctttttgatagcacactttttattgcatgaatgcaatatcttttattatagttttgtattctaagttttctctttgataactaactctttttttactgcttcactcaaaggccactgaacaagcctctaaggagtttcaaagctaaaatgagtgtttctcattggcactgtgagttttcttagttctgctaagtcaatcaatcagctatctatcatcccaaaattaacatcttctatcagttgccctgtcctcttccattctctttgactttggtttacaccttttaaatttctttatattgcttcattgtcattttagtgaggttttgagaaatgtaaaaggtttgagaaaatgcagagatacttatgttgtacctaccatgtttaattggaaatccctctactgatttcttaaaataagacaaatattataccatggtagatcagacagaaaatttccttagaatcacaaaaaaaaatctctggataaaagactataaatggtctacatttgaatagcccataatttatatggtgaagctcttttttaagagacggtagaattaatttaaaatagtacaaagttttacctgtaagattctagaagatccacaatttcagtctgcccaaagtgtttagcccaatccaatgccatcctgccaaaattcaaaggatatataagatgtcatcaaaattgtaaaactagttcatgatgagcctgggcaacatcaagaccctgtcttttcaaaaaaatttttaaataaaaaataagataaattatagttaaaaaacaagtcattcaaaattattaacccattaaaacagaaattcaccagcaattattacacaatagtttttaatataaagacaaacataagaaaacaaaaaaagatatgtgtagctatacaaagatatatgaagaatcaacgtagtttaaaattaccagccatttgatgctttactatggacattggctcccatactgat

SEQ ID NO: 116994 - DNA, 1548 bp, Homo sapiens
tgtgatatgtggtttttgtgattggcttttttcagttagcataaaatatccatgttgtagcactatttttatgactaatacatattctatggatataccaaggtttgtttgtatatttgtcaattgatgaacacttaggttgtttccactttctgactatgaataatactggtatgaatatttgtgtacagatttttatgtggatatatttttttcatttctcttatatatacacctaggagtggaattgctggggcatatggtaactctatgtttaaccttttgaagaactgccacattgttttccaaagcagctttaccattttacatttccaccagcaatgcatgagggtttaaatttctccacaccctctccaacacttgttattgtctgtctttttgattgtagtcatcctagttggtgtgaagtggtatttcattgtggttttgatttgcatttccctgatagctaatgatgttgaacatcttttcatgtgcttataggccatttgtatatttactttggagaaatgccttcagattgtgcttttctaaaagcattcattgccaaattttactttgaataatgtgcttgaaatcaaaacatgaatcatattatagctaggacattaagtgtcacttaccttaccttccttagggaatattggaaatttgaaggacataaggattacttttgttaatggaaattgactttgtcttttttttttttttttttttcagtgctacactggaatttggaaatctagatgaaagttctctggttcaaacaaatggaagtgacctcagtgctgaagacagagagctcctgaaagcttatcatcatagtttcgatgatgaaaaagtagacttggatttgatcatgcatcttctatacaatatctgccatagttgtgatgctggtaaatacgtgttgtctaaaagaactggagcaaaatatatactttaagaattaatattttaagtgtacaaatttttatataattgcactgatagtagtaagtgaataatctcctgtcatcttatgatagtttaccagtacttgaaaacatgtgatacagatttttataattctgttgattgcctctgattcacaatgagatttaatattaaaaagtcattcttctccaaggtgcagtactaatttttctgcctggatatgacgaaattgttggactgagagatcgcatcctgtttgatgacaagcggtttgctgacagtacacataggtaagggctaaagccttatatctgttgcttaaaataacggacaggtcttatagtatgttttctctttcaattgtctgcagataccaagtctttatgcttcattcaaatatgcaaacatccgatcaaaagaaagtattaaaaaacccacctgcaggtgttcgaaaaatagtaagcttcataaaatcttctttttaacactttcattagttattttttctgtttttttattaactttaaagtaatatcttgttgcagattctttccaccaatattgctgaaaccagcatcacagtcaatgatg

SEQ ID NO: 116995 - DNA, 1030 bp, Homo sapiens
attatataattaattatttaaagtctgcttattcatattacagtgtaaactcaatgagaatggacacttccttctgtccccttctttttctccaatttgcacagggccttgcacttagaaagcacttaaatatttgctgagtagataaaatattctagaatgtagtaagtataaaggggggaaaagatttttttttttttggacagtgactatgaatgttatgtatacgaacagtgtgaggagatgttgccaatgggagcaatggcaatcttggtataagttgattgaagagggtatttattaaggttctggcatctagggcaaagtatgagctcatcttttacagaaagacattgttccttctactgttcattctaatcagagactctactagtctgtgtttgggaactgtagttcccatgatttctttaaatgtgtaggttagtattctttttaattttaaaaaattatttactgttttggtttataggaactttgcttacataccaagctgttagccccagttaattgtcccattgctgattttcttatgaaagctcctgaacctccaccagctttaattgtaagaaatgctgtacaaatgcttaaggttggtgtcttcatagttttattttacatgacatttttacttgaaattttaaactaaaaggaaatatgtcttaactaattttgtataattattttttatttttgtcctcctgcatgtgtccagataaactaattttgtacttttaaacaattatcttaaatgatcatgtactttaaataatattgtcatgtatgaaacagtagatatagttcttttatatagtataatagaaacgaaatatatttttatgagatgtagtagcaaaagaaaatctatattcttatttctcatttaggggtttttaattatgtgttttgattaaacagtttgctcacatcaaagtctgttctgtctccttttacttagacaatagatgcaatggatacatgggaagatctgactgaacttgggtatcatttg

SEQ ID NO: 116996 - DNA, 1053 bp, Homo sapiens
tatttatacatactgtatgttttagcctatatcaatttcatattttataatgcattctgtatttttataatctcattttcacctaattttgtagatagatttttgctttcttcttcctttattaaatttacagagggttatctattaatattttcaaagaactgggttatagttttaattaccattttgtctttctaattcatctttttataattttctattttcttctacttttctttgggttttatgttatttttcttagatatatttagctgtatactttttctttttaaaactgacctgtgactttataagagtattgctttgggcacctttcatagtttttgatatgtagtatagtcattccttccttgaattatgttatttgtttctttttcatccagttattaaagattgtgcttcaaattttatattcttgtcttttttattttgttgcattgtgatgagacattatagtcttcaaatggtcccttttttttccttttaaataaatactgagatttaacatgtgatcttttgagtttgaaggacttcccacacaaattgttgtatgtcaggagggtttgtgtatatgaagcgtatttattcttcttagttttttgccataacgtaagaaggtaaaagtgatttttttttcattatgtacttggacagtggatggcattcccaatgacagtagtgatagtgaaatggaggacaaaactacagctaatttggcagccttgaaacttgatgagtggctccatttcacactggagccagaggtaagttgctttcaagtagtgtaataaatttctttcattcagttagtgtgaattgatatataatatgataaaatttttttctttactattgagcccttagtatcagagaatataacttgtttttcagttttcttggggacctcattcattctcttctgtattggggtttattccaacagaggacttggaaaacctagttgtggctcattatttaagcaaggtaattgtcttagtttgttgttgctgctatagtaatttataaagaaca

SEQ ID NO: 116997 - DNA, 1430 bp, Homo sapiens
cccaaattctttgtcactagttactgtaacattaatctttcttaattctttctctgtagtcagtccttcttagttgtttcacagaccctgctgtgtgtgtttgtgccttaaattttaagttctctagcactttgtgtcttactcttatcttcttactccctctatacattccctggggactttatctctatgtgtatattttgcaatcatttaggaactggtgactttcaagtttagagctctgtcttagacctttctgtgaatccagctgccttcaggacatgatcatttggatgttctacaggcactaaaataacactatgagctacatatatttttatttaccctgctgctacttttccagtattaatcacactctgccacaactattgtttactgtctttcttattagactatttaatttgattttgtgtcttagtgcctaaaatattataaataaattttatttcattcatgcattaaaaataatgaaattagtagtaaattatatgaaatgtgaaataagtttgttggaaacagttgcaaactaatggaaactaatcaacacataggtgttttgcatatgtgatattcatttgcttgtatctatttgaactattacaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatctgggattggccaaaggccaaggcctatgtcttcagaagagcttcctttggcctcatcttggaggtcaaataatagtaggaaaagttcagcagatactgaattttctgatgagtgtactactgcagaaaggtaaatttatgacattttaccaaaatgggtcactttttattcaggaaaatgaattatttatcttagaatcatgtgcttttataatatttaaaaattacttttttataatctaagatccatgaaaagatagcaataaagtggaaagagttttctacttgttcaacttaattcttctaagtattaaggtaatatgaattttaaactattgatatctgtgagttatttaataaggcaactctttgtcaggaaaaggtcaaaatatctaatttctagaattgggtctctcaaaaatatatagacattttaaaattatgtattttacttgatatatgtgaagtaacattttacctagataccctgggccatactggctatggccatttaaaagaacaacctccttataagccttatctagatatcaatactgctgattagcattcctatagaaaagtacttcactcagtgacacattgaatgccagttcttggtgtgagggatctagaagtgtacaaa

SEQ ID NO: 116998 - DNA, 1048 bp, Homo sapiens
gtgttaaaaagcccattcgtaacacacaccccacctcagtttttgaaagtcagtgcattcagtggttataaataggcatgatgttcttccacagctaagagttctagaagaaaggggaaaaaaaaagataaataatctgaaaggttcctaatgatcacaaatactgccaatactcaaagtcaagatggtataacctgagtgtcaatcagttgtgtttttttctcccaagggaagacgttcccataactggagcaactgttcaccaaccagaggttctagttcctagataaatcagaagtcaaaataaacataaaaagaactggagtgaaaatttttaatgaccaaaacctacactgataaaaatgtaagaaaatcactttaaatttcattttcctaccagcgtatgctaaaatcatctggtatgaattgttctaattctttgctttaaggtttatggagttgacttccagatttaagattacagttaatctgcaaaatctctcaacttttgtgacaaaatggcaacagattcccatggagtcctggaactgtttctacctaaaaataatggattttgtttttcatagagattcagcaaaagcactcagctggaacttccaaaggtttactgtgaaacctagcatattcgatgttgggtttttttccaaggaactctcttaagcaactatatcttcttatcttgaaaattattaaaatattttttcttctaagatttctagctaacatatttcttcaaaatcattattatagaataaaaatgaaattattctcacacaattgaaaagaatcccacttcatagtactcctgtggaatgataacctatgataagcacttaagaagaacccaaacactttttacatggtgatttgaaacgagtcatactggttcagataaattattagctgtgtgaccttaggcaaaactaatctttgagtctattttctcctatataaaattggactaataatttaatcataagaaataaattatatcttctaaagcagctagcatagtatttggtcaata

SEQ ID NO: 116999 - DNA, 1026 bp, Homo sapiens
aacaagttcatacaagtttttaaaaattctcaactggtagcttgcttgctgtgcgtcttccaaactaaagcctgcaagcgccacaattctaagtgccgccttccattttttttcagtatgttttcactggcttatgttttcagatatgattttcctttttcgcatatatggtttaataaatgggggataattttttttttgtaaatccgtgcttgtgccaagtctcatatttctttgccatctcagaattatctttttaccaccactgtttataaaatttccttagagactttttgaagggaaaatagagcaacagggaaaaatgaaagaaatgtcttggttactgagctctaaatagacaggtttgatggcacttctcatgatacattttagttattcttataaaagcaaacaggcaaacatgagtgtaaattaaagacaaaaagaaaactctggttttatatttgagaacacgtgaaaaatcatgggtcaacataaaatcttgagaaccttctactttctctgggaaagcattatatagtggtgcattagtttagaaagtcagctatgattttgcctatagttctagttattagctttggggttttcttgtactttaagacatacctgtaaattgaacctatttgaattatattccactgtatgtgtattatggctcttttcctattagagcaacttgtgtttccctgataatgtgtacattttttaggcatgtacttaatagttcacaatgttctaaatttggaaggacttaaaaaaaaaacttgtttaaatttccatctgttttgtaatatctagctctatatgtaaatgatgggtttgttggtatttaaaatgaatacaacttgaatgtaattaaagtgctgttttttggaagcgataaactttaaatatacttattaaaatgaaattctattaagtttttcagatcttatttcttatactttataataagactaagttaacaatgatcaacaatatcccctgagataataatgaatttca

SEQ ID NO: 117000 - DNA, 1050 bp, Homo sapiens
cttagtagagaaaaaggtatgaataaatatacattagggatctaccatacttgagtgcccactctgtgctggacactattaggcagataatactgtttatatttgtatagcattcatacctttccaagcactctcatttgacacttctaattgtcttctaagatagataaatactattttcacttttcaaacatggaaattagaagtcagaaaagttaagtgatttgctattttcacatctagtgttggaggctggcctcaaatgcaggtattgtaaccttaaatctaaagctatttcttgatataacacattgtatcttgcaacaaggtaaatcctttattatatatctctacttttggtactccaatcaccttttattgcataaaatacaaaatgtgaatattttgtgttgatgccacatgaactttaaaacacagtttctttatcaatctgtttcagtattgtccatttgaattgacagtagttgatgtactaaacatgaagattcttgaggcctattacaaaactaatgacctattgatcagaccctgtgcctaggccaaggaagtatttttaacagccaccccatctgcatattaaagctcaagttccacttgattcaattatcacttcttagcttttcttaaacactctatatttcacattgtaaaactcttacacaaaaccttaccaggtagctactgtgaattatatattcccaaatacaccttgtccttttccagctcttcactagttttaactttgtcccaatccatttaaaaattctcttctgaaaggcatgctcaaatgcagctctaccatgaagacctcaatgattatcctcctcttaaataccttaacccttgtctataacaattgtactataaaagtgaaaattgttacaattttaaataaaattgttactcacaactttaaataaaattattactcaaaagaagctcctcctggacagcaagaaatgtacctgttatatcttagtatgtcactgtgatattaaatatttattataaataaaggacaatgtggcc

SEQ ID NO: 117001 - DNA, 1050 bp, Homo sapiens
cattctctgtgctaataccatgttttactttaataagacaagttccctgtctttaattaaatacttcaaaatagagctatttttgcctaaaagacgctactttatctcctcaatttataaatctccggttggttaagcatttcttccaatgactaagccaactttgtccttgacaaatcataagcctgtttctcaaggctaatattcttcatgaagaataggcattagttatgtcagcttgctagtattagagtcatttgcagtaaattttgttgagaacaagctaaaaatatttatagtttttatttatattttctttctattttattatatggtcaggatattttactggctaagctctccgttctcagtgtcagtggattggcacaatgacatgttgtggtctgttctgcagcgtgtagcaaaaccatttcttgtcctaacacttgctgaaattatgccaaatattttatcttaattattaatgatatatggctagtggatccaagaattctggccttctagacctccattatctctcctcattcacaaaaagattcccaaggaaggtgtttctctatgtataatatggtttggctctgtgtccccacccaaatctcatgttgaattgtgatcccacgtattggaggtagggcctggtgggaggtgactggatcatggggacagattctgcccttgctgttctaatgatagtgagtgagttctcacaagatctggttgtttgaaagtgtgtagcatttccccctttactctctctccttctctgtcatggtaagatatgcttgcttctccttcaccttctgccatgattttaagtttcctgaggccttccagccctgcttcctgtacagcctgcagaactgtgagtcaattaaacctcttttcttcataaattacccagtcttagatagttctttagagtagtgttggaatggactagtaaaagatacaaggaacaatgtcaatgtcaaatgggagcttctcattgtaacctagttcacttggcttggaagacaaggccaacccaaa

SEQ ID NO: 117002 - DNA, 1049 bp, Homo sapiens
agcattcttgcttgtagcagccatagagatgaggagaagtgggctgattggaggtagaacagacttaccagtggatagaatgtggcaggtaagggcaagggccaatacaaagatgattgatggggttctggttggagcaactgagtgtgttgtactgagaagggaagactcaaattgaggagcagggtgtagaatcaggaatttcttttagcataatatatttgaaattatgctgattgtatatgagagtctggagtacagaggaagtctgtaccggatatttaaatttgggagttatcagcacagagactatttaaacccacaggaattgatgaaatcactgagagagaatagaaaaatgagaaggttgagagttgatcattctctgacatctagaggttgagtaaagtaagaagtagaaaaaagagacaagaatgaattgtccctgaggtgaaggagtctaagagataggagtgttttaaggagggcatagcactctatattgaatgctaccaaggtctcttaacatggggtagggaagtgctttttgcatttggaaaattgaaggtcattgctgaccttgatgagccgtttctgtggagtggttgagacagaaacagactgtaagttttagcataaaagaataagttcatttcccttttcacaggatcacagaacaaacattttaacattagatccatttaaatgccctcctagttaaatagtccaatttctttgaatattccttctcagacattgaatgtccctgatcacatccttctggacttactcagttatgttgaatttcctcttcaaatgagaaagtcagaaacatacccagcactttcagataggatcttccagtggggctgttacctctcttcatcaaaaatgctatattatgccgactcttattagtctaaaatggtcattgcttcacagaaatttgcccagtgacacgtaaaattgttattgaactaaatgctcagctttacgtttactaacccttttaaatagcatcttgatttcagaccagcatatcagcctgt

SEQ ID NO: 117003 - DNA, 1042 bp, Homo sapiens
aagaggatatttgatggaaacgagtttgagcaggcttctacaatttaagcatgggtgatacaaagagaaatctccaatatgcttattattattattttgcaaaaagaaagcaacaacacaattcagggatgaaaactattttttaaaactatttttgattttgtattcactggctcttgtggagtttttaaatcatttaaaaaaagactcacagtgtatatatatatatatatatatatatgtatttttttcctttagcatatctatttcacacaatctcttttaacctttttgacaactatacctatttttcagttgttaagttttgaccacgttctgcgtctcatctcccaatgtgtcctttggatgtttcttacactggggaatgaagatccagcccactcactgtcatgttcactgtctcagtctgatgctgtgtgtacagattgcttcagtggcagctatttaggaataatgtatccatcaaatgtgtcttatacaagtagccacagaaggaaaggggacatgtgtttaggacttagtccctcaagcccatgtcagaacatccttcctgcacagagaccacacggaacactcagtgggcctgcatctgctctgcagcatttacccagcagcaagaggtctcctctgcactagtgtgcaagaacacaggtggctgcagcaaggtgatcagtgtgatggagggtgagcagaagcctcaccttcaaaactctaattatgacatgctgccatatgggaacacaattcagcaaatgaaaagcaataggatagggaggctgatggtgagaaacgataggctcagatgcccttgtgacatatgctgtagctgcatttgcaggctgaatgtaaattttcattaatttgctcacatttcctctctcctcttttgtgtgaatgatgacctgtacattcagtggggtccaagctattgatgatttttaatctttttcttaaacacaatgggggaaattacaatgaagtgttacaagtgtacttttccttaccgaggagataaagtgaa

SEQ ID NO: 117004 - DNA, 1077 bp, Homo sapiens
agttagagaagtggatggtcagcaaaggcaagaagaaacatggctgaaagtgtttgttctatctttgcatcaaaagctgttttattcgctctgatttttactaaggaaagtgtgtggtgggcagagattcaggtagatgccgattgggaagtgcagatttttgtaggtgcaaggctttctgctatggcccctatctcgggcttctgtgtaggagtttgtacccctgggattgatgtggaattgtgtgttgaattaggtttacatcatcacatgcaagtgaaatggctgtagttgaaacttctggtgcctcggggttgggagtcatttttgggaggggcagtatgggcagtatgtttgacccatggtgctgcataacttagtgtcagcatctcattgagctaggcatctcattgtggcttataatgttctgtgacactgtcggtgtggcttgcctcaatcatgaagtgagactcatttgttttatgttgtgaagaaagtattttatagctgactgttctctaactctgtattttgccctaagaaagccacaaattaaggtgggaagcagtaaagagtgtttgttattttcttttggtctgaagttctggcagcatgtataatttattaatttgcttattgctgtttctagtgattaaagttatatttcatgcaaataatcttctccattctgagctgcctactggcaactccccttagaagcccctcagggccgcagctcagcacctcccagccttgtcattcctcttagacctcctagtgcttgtcattcctcttagacctcctagtggtagctgacatttgctgtcttagagaagggcaccactgtccacctggggccccagggaagaccctcgccatccgttttcttctgcccatctccccacacacttgcaagagtcctcaggaaactatggccactccctccttagtgtccttggcattacctttgctctctgctgacattcttgtgccttcattctgatttccaaacttattgactcttcccgggtcctcctacaatctcatttatgaatatacttactgaatatttgataa

SEQ ID NO: 117005 - DNA, 1035 bp, Homo sapiens
ttgagagaaccaaaaagggtaaaatggttaccttaacagagaagttcaaaagtgatttttagaggcaacttgcataaattccaaagtaatgtgaatgtgaacataattgcatgataatctatcaacatgcatgcattgccttttttgggaccacagaaggtgcgggcctggtggtaagaaacatgtgaaaggggagtaagattctaattaagtcttaagagcagcataacatggatttattatacgtaaccttaactatcactgcatcctggtggataattctaggatttttgacctgtagataaagctcttgcctaagtcaggagaagacaatttcagaaactcattattttaggaaatgacgagaatacttctttcaaaaataggtatagctggagtttctagagcttttcccaatactgacattgctctagatctgtctttccttaccaatttcccttcctcctcttccatggctaattttcccatctttatatcgcaagttattatttaattcatctacttgtccctctctgaaggtccatggaatgctaatacttattcatttggtcacttttactagggacagcagagtgggtgttaatgcatactaatcatgtaaggttgatattatttttatttttttttgtagctgaagaaactgaagtttacatagattaaatatattgccccaaaccactcagctagtaagtggtcaagccagaaattaaatccaagcttttccggctccaaaatgttgtgtgtgtgtgtttcctgtgagtcacactaccagatattcagagcagttggttgatatttaaaaggcatgaacaaaagccacccaccccagaaataactctaccactcaatggttattgtactttaaatttcaatatttgagatgcatttcttctgcattgttggctgctctctccataaagtgttttaagttaataaatgttatttttcttttataaatctttacatagcacattaatgaatattaaattaaatgcaggcatactttcagctgct

SEQ ID NO: 117006 - DNA, 1799 bp, Homo sapiens
agaacgctcatgtgttgttgcattatagggtataactgattgcagaggcaccctaaatagatttcactgagaatatagttagaattgtgtaaggctttaaatccagactgaaagaggaaaacaacttgttataaggcgagtccatttcgacttcatctgagggggttttcatgactgataggctcaagcccctgttttaaaatgatgatgtttacgtgattgtccaggaactttgaacttcaaaacagttttagctcctgagtaccaagtttttaatttaatttgtacaaaatgaataccaataccctttactaaaaatagtatacctggctagcatttaaaagttataacctttagcttgccatgattgctaaaagtcatctgttgtgtgtttttaaaatctgcactaacacttgtggaccattcatgccatactgaagctgattttctactttattttttcagttgttcatggtggacaatggagcagatgactggagaatagccatgacttatgagcgtattttcttcatctgcttggaaatactggtgtgtgctattcatcccatacctgggaattatacattcacatggacggcccggcttgccttctcctatgccccatccacaaccaccgctgatgtggatattattttatctataccaatgttcttaagactctatctgattgccagagtcatgcttttacatagcaaacttttcactgatgcctcctctagaagcattggagcacttaataagataaacttcaatacacgttttgttatgaagactttaatgactatatgcccaggaactgtactcttggtttttagtatctcattatggataattgccgcatggactgtccgagcttgtgaaaggtaagtttgtttcttttcctgagaacataatttaccatgtggtatcttcacaagtaagaaaaaaaaaattttagacttgagacgtgtagtgtctcactcttaaaaattttggattttctgacaggcttctttgaaatgactgtgacaaagcttttctgaagattttttcgtagagcaaatgccttcatgcttgtgtgttttctttctaatttgatcagttttcagtagagggctgcctttataattttgtgccaaaatttggagacctagaaattgtacaggacacttttattggaaatgtgagtttaatggtaatattgagtcatttctgtgcctgattgcttatgagcgttgtttgttgttgagacagaaatcctgtcaaacagtgttgatgcaaaatgcctgggctttagggaatatcttaaagcggtttgttggttttagtgcctgtatataatagttttcaaatgattacttgataaggaggttatgggtatgcgtattagtttgtactgaactttcaacaattagtaagaacaggcaatgtgtatttgttttaatgtctgcagcgctctggtggtctagacctaggcatatattctcagatttcaggagtggctcagtgatcttaatcagttatacgttaataatgttaactttgccatttaagaaaaatagacttatgacataagcaggaatagttgtctcatagtgggctacagagtaccctcacatgaccttggttaagaaaattcaagttgaaattaacagtagagacataggaatgatttagacatttctaggagtgttgaaagttcagatgttagtctttgtagttttttttgttttgttttgttttgttttttttttttgagacggagtctcgctctgtcgcccaggctagaatgcagtggc

SEQ ID NO: 117007 - DNA, 1070 bp, Homo sapiens
atgaactttaagattcaatatgtgatcaactctgtatcttaaatgatctgggttctaattttcaagttttccatttcaaaacagtttcagtgttttttatctgtttatataacataagccagttgtcatggaggaagggatgaatggcatctgaaagtttcacttgttctatttgtgtttttttattatttacataagatgaatgtgaaatagggagccacatattagagtgctagctcattttcctggtctgccagccatgattttattttgtattttcaggagagtcacccagaggcctagcctactcctttcccagcactagccattagaggtgcctatttcctgatgatttacttaaatttgaaacatgttacttgggatcaagtttctttaatagttgtaaaagtagtcataaaatatgcattgcagtgctgggaaaacatatccaccttgatttattacagaatactggatagttattggataatgagattatttcctaccacttgaagattcagctgttgccaagtaaactctaagtatttcatcaatggatttgtaatttgtggttgatggcaatgtaatactttgtaaacttgtacttccaagttggtctgattcatacatacagatatagcattttcaggctcataaatgagtcacaactttaaaatgggccctttcaagttataaaagtcggcagtttgaaagcattcatcctgcatctgtgacttgcaaaacatcaatgctaagtataatgtttgccaaataaattggtcattaaagtcttttatggaaagaaaaaccagtactccctcaaattcaattttctcttctttcttatgtagatatgcttcttgttttgttttgttttgttttttgtagttttattttttgagttggagtcttgctcttgtcactcaggctggagtgcagtggcacaatcttggctcactgcaacctctgcctcctgcgttcaagcgattctcctgcctcagcctcccaagtagctgggactacaggtgcccgccaccatgcctggctaattttttatgtatttttagtag

SEQ ID NO: 117008 - DNA, 1037 bp, Homo sapiens
gacaaaaatcagtaattttaatctggtttaaatattaatctgtttttgtcccagaggacataatgttatcaaatgaaatacccaatataaaaagatcagctttagtcattagtttttatctaatttaatggtgaccagcccttagaatttctggcttactacatgtctggaagggaatgagtattcttatatttattgttgttatgataatctgcctactgtgctttctactatttagtaaggtgtttttattgttttattttgttttgcttttaagatgggttctgagaagtttggaggtgtcggtgtgaagtgagaagccactctgctaggttttttatccctgtttaaagattccatttttgaaatatcacactgataccttttgttcctcctcttaaccatcattcaccgactatatcatctagatctctgttctttcagccctaccaaggtcactggcatttattgtgacgtaggtgcctgatagatagttgggtggtaaaagggatgaaggtgccacattaggcaggtttgatgtggtcaggaaaagaaccagggggactgttgtagtcagtaatcagtggtgtagttgcctaaaacttttgtctggctctgattaggttaggagatgagttccctctgcaggttaaaggtgttcattaagtgcttatggtattctataccatgtaaaaatgggggtacaaaagccttatctgaatcaagctcctcaatggtaaaaggtgtatttgataccatctgaatagccacagagcccagagccctttaatatctgggtcagataaaaccttacaagtcatctaatcctatcaggccaagaggaacaccaactgctgtcattacatgaggacttgtggggtaaatgtttctgcacagatgtgtacctatcagttataacaatagaagaatgataattaacacttaatgagtgacttaaagtgttgaaatttaaccctacaaagggtcgttatgaagaagattactaatgggaatattatacattaagtgtgaaaaaa

SEQ ID NO: 117009 - DNA, 1121 bp, Homo sapiens
gacagagctccaaagtttttgtgactattttgagtaaccctaaagcagcatttcaactttcctttcatgaaactgtccatgtgctaagatcactgccactcaacttaggtcctgctgtgcatttaatttcttgggtatttcctgaaagccccactaataggaacagcgatctagaattgctccttttggaaatgcactctgcagatgctgctcactaaggtctgcagaacttctgctaattcccaccaactgcctctggggaaaaaaaggatcatgagttttaaacccccacgtttcacttcctcatacaagcatatcttcaagtaatcacataactgaatgtgcctgagtagactaaatttgaaagagaacgtaataatttttttcgtagctctttatccagttttagtttgtattagagattttacctggtttagactttgtcttaatttgtgcttcttattgataatgttttgaagggaaaaatagcagcaaggattaagaaaatgaaaatattctttattagtgtggtacactagttaaagcaggggttggtaaaccatggcccttgggccaaatctggcccaccacttgtttttgtaaagcctatgagctaagaatagttttcacattttttaattgtttggcgaaaaagagattatgtgatagagactatatgtagtctacaaagcctaaaatatttattacctagccttatgctgaacaagtttgccaacctcttatctaaagtagcatcattttgtcaaatttgttttaagcacaatgtgatattttcaattacaaagcatttaaaaatttttactttggggtcagacaatggatttctatttgttatagcttaaatctggaggcaccaccccctaccaaataatcactataatatctttaggactaaatataaactacttttggtaccaatgatcaaacattgacattagttccagtgatgataggtgcaagtaccatactcagtaacctaagtctttctgactagtactagctagatgcataagtaatttatttttacatatactaaataaaaactaccttattggcctgtgcagtggctcatgcctgttatcccagcaattgggaggcca

SEQ ID NO: 117010 - DNA, 1042 bp, Homo sapiens
attctctaacggaagcatataaaattaactttctgaattgttccatgggatgaagcattacacactcacagcggaaaggaaagtttcacattttgtagactacaagaaaagtttgcttattgtggaatggggaactttttaatgatgccatctaaattgaaccaagtgggaacatgaccaccagccacccacctgcacctggagtcatctccatcctgccacagcactcaccatgtttcctttacttgttctcttctccccctgcaccttctcctctttcaagagcaaacttgtcctgggacttccctgacttctagctcaccaagttcccaattttctactcacctggtactttaagaatcttgccatttctttgaaatattttccaattaacaataataaaaaaattttgacatgtgggtttgatgggagtattcagactgcaggggagaaagaagacaagggaggaacattcactaggaccttggaccaactgaggggagtgggactggcccctgtggggacaatcccataggtggagctaaagggtgatagatgacgcagacagcccaagtggctgtttgggtatttggctggcttctaaattcccatcaaaccaatcccactcttgtttattagagtcctattatgttaatattggtcccagtgtttatagaatttgtactctggagcagtttacaccatttggtgataaaagcactatacaagaatattcttcatgtatgtgctcatttctcctggaacatttccttgcagctgtcagtaaatggggccttccccagataaaggaaatctctttcttggaaaatctttgaaaataagtatggaatgctaagggatagccttattaataaggtggggaataaattaaatgacccatagacctttggaagctaagtgttttattctgcttaatattttaatgatggctttgggccttcttagcactgcattataacagagtcattccattatacataaattggtactattaatctaaaagtgctaattcagacttata

SEQ ID NO: 117011 - DNA, 1109 bp, Homo sapiens
atttttctttgataggtctttacatctggtgttcacatttattacagcttgcatattaccttactccttgcaaccagttttctgccttaccacattttaagcttctcatgaatgcttactatttttactcatctacatattctcagtgcctccaaaagtttctttacatgtagatgttcaccatgttattgaatgagaaactcctgaaataaagctaattgatggttctcagactagatagcacattaaaatcatctggggagcttttaaaaaatccctgtgccatggcttcacccccggagacctcagcttcattgtttacggatggggctttgcacaggattccttttaacacttcccaggtggctccaatatgcagctacaggtgaatatgccgctacagtgaatagctacgtgtgaatatcagcaacaagtaagagacacgttagctctttcttctgagccattggcagtaagctcttttccttttgaacttagatatgtaccttctttgaatttctttttatgcttatatgttctaattaattgaagcagttattttatttgcctttacttcaaatgaaaactacatgcacatagttgcaatttggaaggagaccatttatcagactccttgcatctctctgagcctgcagctggtggacacggcaatatcagctttgttactgaaattaaacggatttggacaccaccacttgccctacagccacatgggctttctaatgttctgctgatttaccactgaatttgaaaaaagtcgtaggtgtaccctcacactgagggagtcactctgtgtcccaggtgagcttaccacatagaaaaccccatacacctgctttgtgggcaagccaaggaaagagagggcctgatctatgcctgctcagttcctactgccagatttttcatccctcccctgtacaaaacaagagatgcattgcctacctcttttcctcccaacacacatacacactacttaaaacaaataatgttagaggcaagcatttgaatatttagctcggtctatttttctcctcttagaaactttttaagatcttttctttattcctggtatttaaaaatttacagtc

SEQ ID NO: 117012 - DNA, 1136 bp, Homo sapiens
ctgggattacaaacatgagccacagcacccagccagtagtagtatatattttagagcctttgctgtttcaaattattataaaaattattgatatgtcttctaacatttttctgacagactttgattacggttgattactagtgaggcagagcaaatgttcttatttttcaactgtgtgtgtgtgtgtgtgtgtgtgtgtgtgtaaagatgttcctgttaacaaagatccttccccccactttacttattttttgataaacagaaaatgacttttatttcataggtcttttggcctgtttattggccatagaattattatacctactaaatgtttgatggacatcggtaaatcctctcataccacttatcacagtatctagcatgtagtagagattcagtacgtaggttgaatttgtaagtggaaatgcattgatccatttagagcttagatgaagcaataattcatccattatatgaatctgtatacccttgttatcaagagggtcctttggttgataaatacgtgttagtgtggttcatgagaagaagtttttatgtataaattatatgtgctgtggtgcccagttaacaccatagacatttatttagtacgagctgtgcctaaagcactgaggtagagagacacaaagattagtgatatgacccctgagagtttctgaaagccctggaaaggggacaaaagggcattcaagtgttacataactagatggttatatggcagggttcttgactgaggatacaaaggaaactttccctccaaagatgggagggaggttagggataggaaattacttaacgggtacaatgtatactatttgggtgattattacactaaaagcccaggcttcattactacacaatgtattcatgcagcaaaattgcacttacactgcctaaatttatataaataaaaaaaatgaatgcatagacctatttctccccatttttcctggaagtttacatatcactttcttttgccaactccccattgttcaaatgtggaaaacaatgaggtgcctttgaccctgtcttctcactgtcctctgttccttttcaaccctagatggaaaggaagaccctactattagaaacacatctcagtaataggcagagag

SEQ ID NO: 117013 - DNA, 1065 bp, Homo sapiens
gtgttgttcccaggcaggtacaagtacttctaaaaaggcatagattaaagaaaaatggtatttggagtcatggttactaaatgaagctacagctcaccatgatccttgggatgaagactatgacccccagcaaagttacaaaggattctgctctggaatttatcaactgctttgtttgttctcttaacaggtaaaaaatgcagctgccaatgtactcagggaaacatggctaatttacaaaaatacaaagctagtgaaaaagatagatcatgcaaaagtaagaaaacatcaacgaaaattcctgcaagctattcatcagtaagtatcatttttcatttttatcctgttgttgtgtccttggctttcaatttttgcacttgtttattcttgtttcataaggaaggaaaaaagaaaacattgtcatgtttattcccagaagatgttatctggcaatctaatcattccacaataagatcctgagaataacctcagttcctttaatgattaaaaatcacttattagtactagaatatttattaaaatatcttctcagtttctttttagaataacttctgctgaaattgtatttcttaatttgacctatttattcagatagtttgctctaggattttttcagctttattttctaaacatagcttcaaacatatttatatgaaagtagtgcatataactgatttagtacttgaattttaagttagtttttaatcagaattttggctgtgttcattttaaattttccagtttgtgtagaccttttactctcttatcattattttaactttatccagaccactattatggtttaagtccttcgttctgttccattgttatataattagcatacgcttttaaagtaacaatctatatctagtaagatgcactgataatttgaaagcacaggatctttctcctccgggctggcataatccttactgtaagtattattcatgtgggtatcgattgtgatgccatgcagacttgctcttaattctatatggagaagagcagatatggtcacatctgtggctcagaaaagtagctttc

SEQ ID NO: 117014 - DNA, 1048 bp, Homo sapiens
gtttggatagagtgacagaggaagctacttgtgatttttctgcttctgtcagatatttcttattctgtttcttctgtagcaatgtgtacttctaaagtagataagcttcaggcaactcagaaatgctctgaattgctttataaattcatctaggggttaccgggtttccattacagtgggggacatttatacttctaaaagtgtaactgagtacgtttattcatgcaagctttgtttggctagatcattctaatcatgcatacttacctttcattttagcttagtgttggaagttagggagtgaagtcataggggaagcacacagggctcgattcctaagggcaaggcttccattgcccactgtgcagatccagtgagaccctcggccttatctgtcggcactgggtacaatcagaccttactagctgaagaaaaatgttaaaattcattcgatagatcactcctggcctctcctactctctgatttatcctgagcactttttcagcagctctctgcttctaccagtccatgctatctcaactctgtttctcttttccaaacttcatagcctctctactctgttggatgctgaactgtccaggcctgtgccctcttttcagtaattgtctttttagattgtcacttagtgtcgtgaagtgttctctttctctaacttttaacgctttttctggtagcaactttccctttaaagtttatcattcttttatctcaactatggaccaacatgaatttgtttcagaaccaagaaatccaatctacttgatttgtatatcatgagagttggattacctgcctttcagaaaccccaggcttctgagttgtcctaatttggaaaagatgtacccccccaaaaaaattacaatgcctttgtttcaaatattgttcttttaaccatatcacattcatattaggcaaaaatatttcttgttgtttacttgaacatcaaatatcaagaggccatgatgactttatgcatgctcttccttctgaactcttattcaggaggaagctgagtgcttacagatg

SEQ ID NO: 117015 - DNA, 1031 bp, Homo sapiens
gatatttaacagtagctaaacataatcttacaagtagagattccatctgccagatactataattgtcctctgacttttatctacactgaaaatgggaatttttcctaggaaatggtctggcctccctacaaatttaatggcagttcaagataaaagttaaatgaaatacaatgaagaataagataataattatgtgttttgtgttatattgctgctggttgaataaaagtttttttttttgttaataagaatctcacttatcactgtgttttcatcaggttcaaatacctaacccaatccatttcggactaaacagggctaatacctgtatctaatcatgtaggcataggaaggtgctcattgctccaacatcaatgaaattccagttgctttgcatatttcttcctatgtctatgtgtcatgatactggggctttaaggaatgttttggctttttctcatatggttaaatccttatgagtctttctgaattcaactttacctggtaaatagttgtcctaaggacatctcatctcttgctctcactctctcctttcttttttgcggtgttggggaagcatgcttctcattgtaccagacacataaccagtttggacttaccccaaatgttcaaggcattatccatgcagttatttgctcttgtcaattttgtgcatgctctttggaaggcataagattgccataggaagaagggaacctttctgataccagattctatcttttagattaagaagtgtaaaaatggaacagaggaaactgaatgaccaagcaaacactttggtggacttggcaaaggtaagcctgaggtgcttagccctcctagttgcatctgttgaaatcaaccacttcacagtcactaatcatgaatgtttcaagaggatcccaacccaaatctaattaataaatcaaaccagcaaagcaccctaaaatgatggtccaacttaaaagaatgtttctgtaactctcatttaatgtactctttccctattacgttattcagccccattctga

SEQ ID NO: 117016 - DNA, 1023 bp, Homo sapiens
agtctcataaattgttatggtacttcattaaaaatattgactttgatcattaagaattgcttcatcagtgtggtcagatggcctttctaacttggttaagtgttcattccatttgaatctgataggaatgaaactctaacttaacaagttttggagaaataacatctatatattatgacgagatcaggcatgttcagaggggtatggccgtagacaacatctacgtattaatcatttgaaccctcaaattgaaaaatagtaattccgatatagagaattttcatgtgatgtatcaaccatttttctttttacattcatattcacttaaatggctttatttagtgattttataaggcaaatctttgtattttggtaatttgttagattacttgaaacctagatccttaatcacacttttattctttactcaatagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggtaggacttatttttggaacagaattttgattcttcgtaactttactttatgcctttaacttttcatttataaaatcatggtgtgttatatggtctcttttgtactaaaatgagttaaagtgttacttagcgatctactaatattaggttgttagtatttctgatcaacaattatttgtggtactgataaggcccggcatatattgacacctatgttgtattagctctgaattctgagggaagagaaggatgaaggacacttcatcatgatacccaaatgagcccaatgtctatgataatggatgtatacataggattgacatactttaaagggttgtggctgttttaagacacttgattcttatttcttgcctgtagaattactattttgttcattctggtggcacacttaccatttaaaactgaattacttccgtggctc

SEQ ID NO: 117017 - DNA, 1065 bp, Homo sapiens
ggttttgaaatgtgaggacatgagatttgggaggggccagggccacaatgatatggttaggttcaaatcttatcttgaattgtaatcccaaggtgttgagggagagacctggtgggaggccattgaatcacaggggtagattttccccatgctgttcttgtgatagcgaattctcataagatctgatggttttgtaaggcagtatccctgctcttgctctctctcacctgccaccacgtaacacagatctgcttccccttctgccatgattgtaagtttcttgaggactccctagccatgtggaactgtgagtcacttaaatctcttttctttataaattacccagcctcaggtaattttctttatagcagtgtgaaaatggactaatacatactcataaagtgcttttaagataattgctttgatatacagcatgagaacctcaggcattaatgaagaatggtcgcatttaatgtagaaaattgctgataattcagcttgtaaatagataccaactaggtttccatgaacatactgactcagctagtgtttaatagctcctgttatttgtcagtcacagtgttaattcactaaataagaatatagtcttactcttagtgctgtattcaaaatttttattgacatgatctacttttaggatttcaccgaagtcctaaatcagtgcactggtgatggagattcgaatgatggctttataatttttgataaaatatcatggtcccctaatattttacataatttttctcttcatttttgccttttactatctcatgttccttcagttctgggttatgggtgttgagggcagttgatggtatcaaattttattggggaaaagaaatttaaaatttagaaaatcattttcttaattctttttggaaaaataaacacatgtacttattcaggaggtataagaatgttaatatatttacccactaagagcctttaacttggactattttactctcaaggttaccattaagaatatcgaaagggagctcatttgcccagcatgcaaggagctgtttacccacccattgattc

SEQ ID NO: 117018 - DNA, 1078 bp, Homo sapiens
gtattgatcagaggcagatttctctcttaaccctactttccttgtacctatagaagttgtcatcgcccaaagaatttttgacctaatgtgaaagtgtgggggttgatggagagagaagtggggggagggagtgggtgaatagctagtcaggaccttagttaagagaacactggttatccaatatggttctaccatatctaatgacaaactaactgatgatctccacatatctcatttcctaggaaagaaatggtgtatcatttcactgtgtaccctgcagggaaataaaggttctgccctacctaccaagatcatattgccgtagcatcaaaaagccccatacaaaataaaagctttcaaaacacagcatggtattaaaaggacatctgtattttaaaagtctcgtttattttgtttactgctgaatctccattgccagacactgccaggcacacagtaggtggtgacttatatttaatggactatttaatgaatgaataatattggcacattgcgattccgtagatctagttgagattcaggcacagagggacatgaaggccatgtgctcaacagcatgtcttaggaggccactggctcctgtgatagcctgggctggccatcctaggcttgttcctgggcaaagtcttgcttgctagagaaatatcatcccctgagaatgaggatagctttaggatatgtgcacactgttctaattctaccatttgagcaactctaagacaaggagtgatcctttgttgtgacacaaacaatcccaaggaattttgttgctctctttaggccaaagattgtgtgtaataaatttctggagaaaacacactgttaaggctgggcatggaggctcatgcctgtgatcccagcactttgggaggccaaggctggaggattgcttgagcccaggagttcaagaccagcctaagcaatatagtgagaccccctatgtctacaaaaaaaaaaaaaaaaaaaaaaagaaagaaaaactagctggatgtagtggcatgcacctgtagtcccagctactcaggaagctgaggtgggaggatggcttgagcccagg

SEQ ID NO: 117019 - DNA, 1031 bp, Homo sapiens
ctttttaaatcctcgtctggacactagggccttttcattgtgttagggagactcagaaaaggaaaatgttataaaagaccagttttccctgatggctaaacaattagtggcataatttaccaaagaattgtagcctgtgagacacaagatgctgaatacagccaagcaaatactttctctactcttcttagcttaggaaagtggatatgaaaggaaggatgttaactgtctcaggctatgtcatgggcatttgcctttgacagaaggacctcctaggatgaggggaggtggtgctgacagcaagcagaaggagaagaggacccaacagctggctgctcttcatccctcagagaatggcatggaaagagagcaaataatttcaaaatacatggaaaaacatttagatagcacaggcaatttatttggaacctccatatcaggaaattgcttctctaatgcagtgacttactactgaaaagaaaaaagtctctcatgtttgcaaaatgggctttgtacagtgcctcacactgagacctagagatctaatgagaatgtggattattaaatttctcacagggaggaaaggggcccaggaagtgtctcccagatctggttcacagcctaaggaaaaaaatgcttatgccttactatcaaagggtagaagaaaatagcattaatctccattgtcctgattaatcactcctaaaggtataaacagaaagttcaggtcggttaccaccctcctaggagtgccagcatattttacagtccacaaaatccggcgcaaatctcccttccccattcatacctcagagacagaagagtaagccaagttatttgaactatgattttgctattcgtatatatcaaagcgctttcatgttctcacaaaacttgagttcccgaaagtaagattgatgccctgccaggaaaattggctttaaagtagtcccactactgctattgagtaaacctttcagaagagccctcaaggcttaagaaatcagacatagcagagcccctacagaact

SEQ ID NO: 117020 - DNA, 1060 bp, Homo sapiens
accacaataggttcaaggtgccacacattaaaaaggtcagagaagatcaggctttccaggagggcaaggagaaatagaccatatttttcacattcaaatatataaaggtctgttctctggaagaaggtttacattcagtggcaactttagaattcctgtttaggaggggcttaggggtggccatcagtaagaaagtgaagcttagagggcttgccatgaaggtgatttgcatataactgtacttcttatttattgtgtatttgaggtggcttttgagagagcaggtgaagattacaggttaatcttaattgtacatccttccatggccacactttggcttcatcagtaactggacttctcaaaacgtttagcatgcacaactaatagtatttgttgaataaaggaattaataaatgaactcatatttaagaactataaagaactttccaactagagttgcatgaggccggaatgggtagccacagcaagttctccattgctactgctgctgctgctggagaaggtgaggctcattctggaaatcaggaaaagagcatgaagactgcaggattgactcacttttggttttggcagggcaatgttttacacacacacacacacacacacacacacacacacacacacgatacagcatcaactcatttctcttaaaaaaaaaattatattgctcgttttaaagaaactgcatctgcagggaaaacaaatcatcctaatgataagggaagtttcctttttcaaaaagtctcagttcataaatggagaagcaataatggggttagaaaataactatctcacaaatgctaatagatttttaggctacaacaatcaatggatactgaaaccatcaggagaaaggttgatggagaacttaaaagtggaaggctcaagctgccaccacctgaatccactgatcaatgctgccatctctaaaagtgactcaagacattgcatgcctcctgctataatgcaatgtgaggtacacaaggtcatctataaaatatccttatcagaaagttgagactgaatctagtcagtctga

SEQ ID NO: 117021 - DNA, 1548 bp, Homo sapiens
acaatgaaagcacaccggaaggacatgaccacaagacagataaaaacctaatatttgccaaaaaataaaatgcaaatatgacaggaaatttatattaattagtacagttatcaataaaagtaggaaaaggggaaaattaaccaagtaccaaacacttggagtaaaaagcaaaataaagcagaaggaaggaattaataaaagcaaaaaagaattactagtagaaaaccaaaacaatagaggcaataataaatccaagttggtgatgggtagtgcggggagttgagtcagataaactaccagctaacctatttaagaaaaaaaggaggaagcacaaatacaaaaatttaaatgacaagggggaaatagtaaaacaggaaatttgtttaaattgactattttgagcaattttacacaataaattcaaaaactattttgagaaaaatgcaaattgccaaaatttactctaggtagataaagtcacaacaaaccaattaccgtagaagaaacaaatagttaaaagtaccccttaccaaaagaagcatcaagcccagattgtttcaaggggatttctaccaaaccttttaagattaaataatcccattcttgcttaaacaattgcagagactaggaaaagaatcttgaacctcaaagtgccaaaaaaagaaaaaaaacaaataaagaaaaactcctgaattcattttataaaatgaatgtaatagcattgattcaaaaacctgacaaagatggtaccaaaaagaaaatatagagcaatctcatgaatattaataaaaagttttaatgataacattagcaaacaatccaacagcactttcaaaaggtaatcatgactaagttgggtttattgtaagaatgcaagggtagttcaatactagataatctgttactattcatattaagagttaaaaaatatcttcatctttgcagaaaagacatgatagaattgagcactcacttatgttaactatactaagtagaaattgatgaataatctattaacattgtacctctacctaaaagccagcatcttaaatttcaaagcaaaggagactttccagctgaagtcaggaacaagacatgcccactaactcctctgctacttaacaatgtgttgagagttatagccaatgaagttagacaaaataaagacgtgaattggaaaggaagaggtaaaactatttgcagatatgaatatgtatctagaaagcccaaaggaacttgttgaaaaactaaacaataaaagaacttagtaaagtagctattaaatacaatttacataaaaatatcagtaggcttcaccagacacaagtgcatactttgattccatttcggtgaagttcaaaacagacagcatctatgtatggtgtcagaaatcagcaccctctttcagtcactacctctcttcccaaaggtaagtgctgtcaaaattaccatcaattagttttgtctgtttttgaattttatatgagtggaaccatatagtatacattatttttcaactggctttaactcagtaggactgaaagaggg

SEQ ID NO: 117022 - DNA, 2195 bp, Homo sapiens
gaactagctaattataaaggaggtagtataaaaactcttcattagtaattaatttatcaataactcatatccgttacttgctcagtgacattcagaactattgcgtctagtactgaaatggggaaagaaatctcttcactaaaggagttggctttaagttagtcttggtgataataaatgttgaaatacaagtatcagtataaaaactggattactggtatcactgtttaggcattgtaatactttaaatgttatctttttttctaaatcagagggaaaaaaatgttgtgaaataacagtccttcccaagggaaacactgtgtacttggagaaatgattgatttattattggcatgcttagttttaaacctgagtttgccaactgtatgttttttaattagaaataaaataaatcttctgatggtgggggaaaaagtaagcttaataacagatgttatccgtctatgggttattccagttgctactatttaaatcctggcagattaagacatccatatctcaaactaagtcatctcttagacattggaagttaaagtagcatatatataatggctttaggactatataaaaagcccaaattgttttttctgtatcaccaagaaaggttagaaggcaataaaggtagtaacagtgattttattcataaatgttagagaaaaattccaatctaaaagtatttcataaggctaaatattttctaactcctgataatttaataccataagattataaattttagtatgcttctaattgatacacttgtgggagactttcttgtgaaactttatggactagtaaatgttcacattccacagcaactgaattgaccagaaaatagcagcccagtgtgaattgtggagaaactatttctaacttttctaaatagttatttacaagaaaagcatttatcgattaaataaattataagcaatatttcacatatacactttattccttaacaggagcgatgtaatgagggaaaatacgaagtccgaaatctcaaaaagctctgttacctactctatacttgtctccttcccgccccctaattttgtggcattttttttttagaaggtaggaggaggagctttattttgagcatctgtgtacaaatgagattaatcagatcatatggcctaatttaacctgtttatcatttcagtgtttttagatttgatctataatatatatgtgttattagatctttagttatttatatttaatctaaattcatatagaaatcttgctgacagtggtatataatttgaaaactgttggacctgatcatttttgagagacagttaatgaggaggtgctctggaatcagatgacctgggtttaaatcccagatttgccagttcagcagcatgatcttggaccctaactctgccgtggataaaataagggtaaaacctaacacacagggtttaggattaaatgagataatacagataaagcacttaggatagtacctggaatacagcaaatttcaaattataggttctttataatgatcataaaattatttttgtaattaaaacctctcttctacaacagaaagaggtcttaacagtttaacctcagggaaaatgatgacaacagtgttgttttctaatctccccataagaatacagagcaactaggatagccacagacactattacaacgctagatgacaaggtatctctatgaacttcaaaatacaactaagtgaggacaaaccactgaaccacatagtttcagtatctgtgggaggaagtagaaggaaggcagctggtttctgacagctctgcaaattggagaactacaacactgcccacagtttctcaactacaaagtgcagcgggccaatctaagaacagacactgaaactgggaagtgactacagaatctcatttgcagatgaatgttaaagcaatatgataaggtctgctgattgcattagagctgtctgggttttacgctgtgtacctcttgaagcttatgagacaaagcccagcactgaggacaaacttctagaattagaatccaaatgggcaggatgggtaaaataggacaaaggaaagaagatctagataagtattgggaagaaaggccaagacacagagacattatatatgtgtattttcatatatatatatattcttttaaatcactgtgaaaatgggagctct

SEQ ID NO: 117023 - DNA, 1382 bp, Homo sapiens
acgtggagcgagggatattgcaacttagattcagagttttgttttcgttttaaagaaaaaaaaacttaatgatatagcattgaagctactcgttttcatgttctctagtaagcaagaggggaaactccccaaagtgagaagtcttacatatgactgctgctactcctgtcttttaatcacagaggttatggacagtatcagctcttcagctggaaactgttttcctttgttaatgatattttcatgaataaaatattttattttgatcatctgagttttttttttaattggtgtttgaggctttgagaaagcaaatatttttaaaactatattagcatttctctaaacttacttttaatggagtgatgggctggtaaatatgtggctaaaatattctgtagaatgtacaagtaagaatgcctattatgatgttttaaatgccttcttttcagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtacatatctccacatgactgattttagattgggagggtggggggatttgtagcataactgtagctcaagtttaaaagccatgtataaccaagtgtgctctttttttaaaaggtagagtcttacaatcaaatctcctgctgatttcactttgggatatggtcttgagccagtaatctttatactgggtttcaagaaaatctttgttgaagtttgaaccacaactttgtcgtggttcttaaatgtttatactgtatttctaagaagttgtttgaggcaaattaactgtatgtgtgtaggttatctttttaaaaactcttcagtgcaaattgtatcttattataaaatggacacaaattttcaagtttacacttcatatagcattgataatcttcaggtgaacacttagtgatcatttaaaaagctcactgctgatcgtagaaaatttgctttaattaattaagtatctgggattattctttgaaaacagatgaccataattttttttaaagaagagtgacttattttgtcttattcttaagtaaagtgtgccaattaaacctgtgtggcctatataaatgaagttaataacttcatagtaagaataaataggtttaactaatgtgatagttttctaaaaggagattgtttgaagacaactattatgtaactgagggaaaagcaacttaactgtatgtgattgtgaatgagaaagttttgtgctatgtgggtcatttatctagacattgctgtggtgaataccagtta

SEQ ID NO: 117024 - DNA, 1026 bp, Homo sapiens
tgggatcgctgggtcaaatggtatttctagttctagatccttgaaaaatcaccacactgtcttccacaatggttgaactagtaaataggaacacctttacactgttggtgggactgtaaactacttccttaaaattcttaagctgactagttgtagtatctgtatatcagcttctaacttgtttatcttatttgtgaaaacttgtttgtagcttagggttgatggagcctcaattcataagcaatatactgtctttaagagagttaaaaatcagtctcaggtgattgggtcctgggcagggagttagcagtcccggactttagttccaaatctgctgttaaccatgtaattttaaacaagttccttaatcttgttccaagtcttactttttttcataagtaaaatgtttcttatagctttatattctctgttttaacaaatattgaagacttgtgtttagtggttattttaaaatctcatcttttaaatttaaattttatttcactattttctagaattatataaccactttttccccttgaacattttgtactattttcataagcatctaatttgaagtttaaaacgttgtgtggttttgattaacaggaggatcaactttttgtggcattgcctcactatgtctgatgggtaaactagaagaagttttttcagaaaaagaattgaacaggataaagaggtggtgtataatgaggcaacaaaatggttatcatggaagacctaataagcctgtagacacctgttattctttttgggtgggagcaactctgaaggtaagagaaataataaaaaatgagaaacctatattctgtgttcatatagattgtgctaaaaaggtttgatctttgtaatgtgtattaaatattgttaggtttaggctactggattttctcttttgctctgccaaagctagtctctgtatggtttttccatagaaatcagtgatctcttgtgctgcttgaaaattttcattcttggaaaactcaagtaacccagaacttgagt

SEQ ID NO: 117025 - DNA, 1065 bp, Homo sapiens
aatcacttgagcccaggagttggagactgcagtgagctatgattgcaccactacagtccagcctgggtgacagataagaccctgttactaaaaaaaaaaaaaaaaaaaaaaaaaaaaaatccaaaaaaataagtaatacataatttgctttacctgaatatcataactacttccataatgcctgaggtatcaaagaatttaaagattaagtagcctgtgcaatcatattcatattgagacatacataaaatggagatttgtttttctcaataagatgtctatacaaatcagtataagccatatttaattttactatttactaaaaccttatgtcagatttcttaatgaaataagttttcatttcacttcattaattagtactatattaattttgtatttaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggaggtatgagtgattctttgttactttttttgtaataaacaaaaatatattggaactaaaaaatggatacagtactatactagatctttagaggatcatactctattagaaccccacctaaagcttacgaggtacataattaagtgcatagtcaaaaaagtgacctcagatttcctctgtgagtgaaaataatagtaattacaatagccaaacacctttatcttccttcttaataacaatgggtacataaataaatggttgaataatttcaggattggaatctaatttacattctagatgaaaaattgatattttgaagtacgcatacatttagtctggacctcagttccttgctttatggtgattagggaagaaaggggtgaacactgaatattgtattccagagtaggtagtttccatgacatttttaaaggatagaaaaaggagttcgtatgttcattgatatttggtgattcacatagtgtgtctaaagatgaatcttcctggagctttaa

SEQ ID NO: 117026 - DNA, 1141 bp, Homo sapiens
acaaagtacatattttctcttcagctttaaacctttagtttgctcccatgtaaagaagcaatgagttaaagtaaaaacacactaaatgagttaaagtaaaaagacagtagaccctattgtgttattaaccgttaccttgaacaatcacttaacctctgggcttctgttttctgttctgtagaaagggggattgaacatgttgatcacataaaaattgatctgacaggagaagtatgaaaggactgtataggcagtgaggtgggctattaaaaaaaggtacatgatagaaataattatgttttttgtgactcatatggaaattaaatgaggaaattcccataagcacctagaatggacctggcacatggtaagcattcagcattagccagtatgaaaatggagactaaaatagtctgtttctgaaagattgtgtaattaaactgctttagaatctgtgcaaaaataaagtgtactttaaataagcacatgcttttattttctaggatcaaatctaaatcgctgtggtttccgaggctcttcatacctgggtattccgttcaatccatcaaaggttggttctatttggttcagaaggaagtagaagggatgtagggatattttaataaaagagaaaactaagaagttacacagaaaaaaacaggcttccagatttcaatgtggctaaatgttgtctaataatatatatatattataaactgaaatcctttaaaggaaacctatacctactttacttcctcaaagaagtgcactttcttccgggaagaatacatgcagtacataaacacacacaaatttctattaattgttacaaaaaattgtctcagtatcatacatctgtgtgtaaaagttattggtgatttcctgagtaaaggaaaacagagcactgaagtgttttgatacctgctgtgtaagaagccagtaaactttgttgtgtttatagaaagactctacatttagctcacatttcttaggaataaaagaaaaagcccttctaaaggcagtgattgaagacctaggtagtgattattttaatgacttttattagaatatgcagaacttcttcatggttatatccaaaggccttgataccagcacatgccaatataaaaacagtgagtcc

SEQ ID NO: 117027 - DNA, 1129 bp, Homo sapiens
agagtctcgctctgttgcccaggctggagtgcagtggcccgatcttagctcactgcaagctccgcctcccgggttcatgccattttcctgcctcagcctcccgagtagctgggactacaggcgcccgccaccgcgcccagctaattttttgtatttttagtagagacggggtttcactgtgttagccaggatggtcttgatctcctgacctcgtgatccgcccgtctcggcctcccaaagtgctgggattacaggcatgagccaccgcgcccaacctgtgttaggtagaattctaaagatgttgccccaggatttctgttccctgttaattcagtcaaatactaatctgggtactgctgtgaagggactgtgtagatgggagttaaagttatactaatcaactgaccttaaaatgtggagcttatccataggtgacatgtgtacaggtgggctcagtataatcacatgaacagcagacgaacacagaaacgttcgtcatggaattgcagagaaagggagcagaagagagaagagaaggtagagagggtctaatggaaaagatttgagtgccgttgccactctgagatatggggcccatatatgagaaatggcaagagaggatctaggagcaaaaagggatacctaccagcaaagaaatggagaactcagtcacacaactgcaaggaagttgattctgccagcatcctgaatgagcttggaggcagattgttcccccaaagcctccaagtaaggaaggtagccctgcctacaccttaactttagcctgatgatgcctgtgttagacttctgaccttacaaacagtaaggcagtaggtgttttaagttgccaagtttgtggtaatatgttatggcaacagtgactaatacagagaacaaatttcagccttattcatatcatctcacaccattcatattattttgtttattcccttccagtctttgttgatatgtgccatttgcttaattataaacataaaaatgcacatttatttttggatcctacttttttgcttaacttgatcaaatacatttctctgtgttgctacatagttctactgattattatttttaataggaatatagcgtttctttcagtacatgaggcatg

SEQ ID NO: 117028 - DNA, 1015 bp, Homo sapiens
ttaaatacaagctataattgatcctgacaaattagtgaaaattgacattttcacatatttctaagtcctgtactatttgtactgattagttgtagagaatccttttttaaatctactttagccttcagtttggtgatattctggcttcagtgggtcttgtttgtgtcaatggggtaggattggtttcttaacccccaaatgtccccttttgaaaaattgaaacaaaaggcttgactgatagtattaagttacaagaatatgtatatatatattttttgcttttgcaaggtggaagtattgtttaaattattggaaaattagaatgattttattatttttctagaccaggaagacttcagacttaagtggtatgatagttaagatggaattttacatttttttcttttaggttgacaattgcattttttgcactctccgggctggatatgttggattccttagatgtggtgaacaaagatgatataatagagtggatttattccctgcaggtccttcccacagaagacagtgagtgagtttttagcattttatttttagtgtgactggttgtacctgacataacatgtgttggactagaaaatcttagtacttgtatactgttaacatattttatttatctgtgattttgttgtaatgcagcattgccattctgttgaaatacagtacttaacaaatctgatcataatctcaagaaaacaatttagagttatctggaatttaatagagattcacagttgtggcaccatactatgttgtatacttccactttgatgactacttgttgattatttatagtcagtatttatgtttgattagttctgtagcattaactctgtttttcattcccaacaattcttgtcttttcagtgaaaaactctttgccatcgaaaagttttctttcagtttcctgattattttccctccagtgtttcattagcatttttaatggtttcttaaagctcttatgtatgcttcagtcatttttacacttaac

SEQ ID NO: 117029 - DNA, 1102 bp, Homo sapiens
gagcaggacataggggtgagatagaagggtttgtgaaagtggaggtgccatttactgaagtagggcatgttggaggaggaaagggaagtttggaggaaaatatcaggagttcagttttaaatctacggagttttaagatgttgagtagtaaatttaccatttttatctcccacttcctttaatatgtcttgtgtttttaataagtgaagatattattctgacattttcagacatgctctgaactttctggcctgaatgcctttgcttatcttgttctcactttctggaacctccattctttctttccccctccaatcccagcttatcaaaattggcccagatcagatgttgcctcctccttgcccacccaaacataagtagcttccctcaggatttcactgacacttaacaccttttatatgatgtgttgtggtatgcccatgttgaatttcacctagaacagtgctgctcagacttggtccatggactaaatatgggtttgcaaactgttactggtttacagtgggataaaatagttgcaccagaattaactatgcagtgagcactgtttagttcaattgacttttttttttccatagaaaattttcacattgaaagaagcagtgcattgatttgcgttttaacacaaattcccaatatttttgcagactggtattttgagtagcactgtactaggtggcatttggtatagttttaatattgtttcattgttcctatcacattgccttgtttatagtatatatacataccataaagatttattgagtggaatgaatgatacaccataaagaaagatgaggaaatagtttcttgacttggagggaaggtaattcagtgaatatgccctaaatggcatggagaagcctgctagaatttgaaataatttttacatacccatatgtaaagacagctctgtagctattgagctgttttatttatttatttatacatacttcggaagcactatgtgccagacgctaactcatttaatcttcataacaacactgtgcaagaaatcctacctaccattttatagatgagcaaaatgaggacagagaagtttagtggctcatccaatgcc

SEQ ID NO: 117030 - DNA, 1135 bp, Homo sapiens
cttagcacgggttatagtaagacttaacccattatgcttttaaatattgaaagatattgaaggatgctttatttagaacaaaggtacttaaagtattaatgttttgacataaatatcttttgttctttatttaattgctcttggcttttactaacagtgatcagtcttacatgtagattcctgaattgtaaccacatttgtcacagaattattttaaagtgcatacttctttcttataggagcaaaaatccagcaacaattggccaaaatacataataatgtaaagaaacttcagcatcaattaaaagatgtgaagcctacacctgattgtaagtaaatttagatattataatctttcttatgtgttagtattttctgtttggcattaatggagctaaactctactttattggttaggacttaagtttattaatggagctaaactctactttattggttaggacttaataagtttattaatggagctaaactctatcagttaggatttagtaagtttacaccggagaactataatcgggcatttctgtgtgtatccgttaaagtattatcaaatccttagaaattataaggtaggcagaacacatactagtgacatttacaggattgggaatctatgttatagaaaggtttaaaaaaacagctaattaaggggaaaaaagattgatttccttaatcctgtcccagtgttttcccttcatttgctttttgaaataattgtctttgagaggcatttctaatacataaggaaaggttaaactgatttaggacaaatgctagtttttggaaaaaaatcccacaaattatatccctacctccttgcttactgtaatattcattcctgagaatcaaagcaacaaattaaaggtctcagggtgtatggacttaggaatcagacaggtgttgggtcaaacctttgatctttcacttgttggctatgtaattttaggcaagttacttgatatatctgagctttcatttcctcagctctaaaatggagataattatgatatgagtatatagggaaaatgtctgtaatcagaaaaaatagcaatcataaaaattcacttttgagcacaactttcttatgccttaggctaagaaatattttaaaatt

SEQ ID NO: 117031 - DNA, 1039 bp, Homo sapiens
taggagacaccaggaaagacctaagaagctctcagtcctcatccttgtttgtctttgaaacactgtgctggcagaaagtaaatactaagatagggttgtaaactgcctgcctgcatgtaggaggtatgcttcagcatgcatacagaccccctttcccaaaggtagcaaaggctaggacacatagtggttcaatgcatctaaggaaatctctgaccaattattggctgacaactgagctaaccaatcagagatttcactgccacacctgaccaagactacagattttacagaattagtttaaagtgaccaaacaaacagcaacaaaacaaaccctgctaaggggagagaatctcatttttggagttgtccattatattattttatatgtccagtctttaacaaagttatgagacacggcaagaaagtatggttcacacatggggaaaacagtaaaaaggaactgtctctgaggaatactggctattggacatactaggcaaagacttcaaaacagttatttaaatatgttcaaagaactaaaggaaaccatatctaaagaactaagagaaagtgtgggaatgaaatagaaatctttaaagaaattaaacatttaaaaaagaatcaagtagaaattctggagttaaaaaatgcaagaactcaaatgaaaacatcactagagagactcaacaccagatctgagctggcagaagaaagtatcaacaaacctgaagataggtcaattcacattatccagactgaagaacagaggcaagaaaagaatgaagaaaaatgaacagagtctgagatctgtgagataccgttaggcatactaccatgtgcataatgagagtcccagaaagaaaggaaaggagaaaaaaggaggaaaaccgatatttgaagaataatagaagacgtcccaaatttgatgaaaaacattaacctacatatggatggagctcaatgaactctaagtagaataaactcacagaaattcatatctagacacatcgtaataaacctgccaataaatatggacaaa

SEQ ID NO: 117032 - DNA, 1001 bp, Homo sapiens
aagttgacaaataaaattaaccatcatagcaatacagtgaagtaggaaagttggcttcttgatacgattttaacactttctcctttgcatgtgagctgaacaaaggcagcaaaaaaaaaaaaaaaaagaaaaaaaaaggcacatttaagcccacattttaactagaagcacagctgcctggaagggacattaagtctggctaggccaactttccattcaatgaagatttttcagtctctgtttaaatacttccagtgctggggaggtaactatatttattataaggcaaaaagttctgttaatgtgagtctctattaaacaattatattgaggaaaaaatcgtgctcatgaagcctgaatatccctcagcttctctagcatgtagtaagggcacagcccattaacattaacatctgaatgtgttaactctgaagcaccactactgcagaggactttgccagttctggagcattgcagagtttggggacagctctatcagtcctggactacaaatatattttttcccagggcacaaacatgcccccacatagttgggtcaggatggattcaaatattgtttatctgaaaccacttgtctctgacatgcaagtcttgctgccgactctgccaggctgcctcaaagtggtaaattcactcttacaggcctctctgatcccataagctggcttctgtcaaagtcctaaaggctgtcagccttgtctgtatatgtctggacccaactgtagacacatttttttttccagcttacatttagatcagtagacataaatagatatgaggagaaaggggtgtggtccaactccaaatacatatttaagtattagctccattctggctaaaatgctttagttggaatgaccacacattggtcccagttttgtcccctggcgacacatctcctttttactctgtagtcagaacacaactttgttctaatactaactctatttttatgaaaatgtgattaaattgcaacctag

SEQ ID NO: 117033 - DNA, 1081 bp, Homo sapiens
tcccatgaaagagaaacatgcaaaaagaatgtcagattatgtgtgctgcagaaaatcccaacgtagagggatgaagagtgagtgagaatgggactggagggcaatatagaggtgactgattacggaggcctctccagggatcggctgtttgaactgagatctaagaggtagaaaggagcaagctgtgcagccttctggagatacagtgtggaaggcagagagaagagcaagcataagggtctgagatgggctctcacttgctcattcaaggaatggcaaggacatagcacaggtgtggaagaggttgacaggtgcattatatcaggtcttgttggccatgtggaggagctagggttttattctgggtgtaatggaaagctgagagatggttctgacctggaactgacatactccatgttattaaaacataactggctgctgcctagagaatcagttgttgcaagtagaagcttagaaacctttaaagggctcttgctgtgggcaagaagaaggagactgggactagggtgttagctgtggaaatgggaagaagtggaaaaacaggctaacacttggaggtagttcctaaaggattgctggtggattaaatgaggagtgtgaggggaagaagaggaatcaggggctctagacaaatacttggcaacttgtcactttcttaacagttatagaacaaaacctgtcctgcttttgataatccagtcattttcattcttctttgaaccacagcagccagcagtcactggcagtatatatttatacatgagtcctaatggaatttttatagtcaaatatttataaattttaaagattaatttaattttgttactgaaaggaaagagcaaatattcctttagctatcagaatcttaaaaattaaagaaaatccaaagacataaataaaggaactctgcatatgattgttggttcacatgtgatattgtttcgatgttacattaccagcccttccctccaaatctcatgttgaaacgtaattcccaaaattagaggtggggcctggtgagacgtgtttgggtcatgaggcagatccctcataaatgttt

SEQ ID NO: 117034 - DNA, 1894 bp, Homo sapiens
cgttagttacagtcatatcaccatccttatccaccatcatcttatcaagcccatttggcccaagtgatgttctcatcatatttgctacagccttttctgccactatatgagacttaagggcctcagtcccataagacaggacttgaggtcctgatccttgatgatgaggaaagggtgcccatattcatcaaaggcgagggttcccatggatgccatggtgcagccccaggagctacttttccctcagatactaatctgaagatactaatctattgttttttgccctctgatgctagtgagttcagtcattctttgctccgttgtgagtaatctttttttttctcatgttcttttagatattctctctctgtctttggcatttttcagtttatgatgaaacctgtttttgatttatttatttattccgcttgtgaccacagtatgattctttgatctgtggactcatgtctttctttttagttctggaaaattattactcattatatctttctatggactctcattctctttattctttctttctgaaacttctattaggcatattgttagacttttccaatccgttctttgtgtcttaatttttcacatatcttctatctctctgtacttggttctaattttcttaaatcttctattcacaaatgatattacttcctatcttgtctgctaacatttattacttttttaatttctatgcctgtatttttatttttagaagttctatttcttctttacaagtttacccattttttttgtttgtttgtcttcagtttctacatatcatttaaaacttccctactttctggtctcctttgattatgctacctcaaattcttagagtgctgatcctcctgttgtagtgctgctcactgcttgatggatacttgtctcatgtagattgtcactgtatttttgtaggtatgctcagcagttagcatttctccaagtgaaaatctgtaagcccagggctttgggagaattccatcacagtaatcagggccccagcaattccagaatcagcttcttatgttaaatttccatcttgggcattttatatgaagatgatggagttaatttggattcagtgtaccaagtgcagggttaaagttccagtttttaatgggagcatttggtttttaacccaacccagagtaatgggcagacaatggaagtttcttgctgtgtccctggacttgaaaactaaagttttcttggctccctttatgcaaggaatagtcttttcagagttcctgcaattatgtgaaattcagtttcagataagtttcagcttctgtttaactgagtctcaaggagatgccttctgtaggtgctaaaacctcagtccctagccattagatggtctcacccccattaaagttggtattttctcatacacttactattctgactttgaataaccctcttcatttttgaaatttatggattttcctttcaagcttagccgtttacttaaataatttttttttgtgcatgtatctagcttttccacgtgtttggaatgggagaattgtctgtactaagctaatccaccaccgtcatttcaaactatgctggatcataagtaccaagtattaagggagttgctgttttataaatcacagttgatttaagaacattcttatattgacattctccccaaagtttaattacactttgttaatagatcagaaaagtatagaattataattgtgctgagaatcatatgtgaccctgggtatgcccatagaattcagttctgaatgtgaacagtgtcattcctctgccacaagagaaaacaaagttgcttagagcaacctgtaatgaggccaagatttgggactgagaaccttttgagccattgagcctgtcttca

SEQ ID NO: 117035 - DNA, 5687 bp, Homo sapiens
tttttcagattccatggatttgtttttcttacgagagctttttggggaaagtcctttgttaccaagaattttggctaagacagttgaaattcaacttggcaatcagaaataaatattgaaaaaataatttctgactactattagagtcaaaatgaagaatcttagatatattaaagagcagtctggccaggcattgtggctcacacctgcaatcccagcactttgggagactaaggcaggagcattgcttgagcccaggagtttaaaaccagcctgggcaacatagcaagacctggtctctaaagaaaaaaaaaaagaccaattccttgtttataaatgtggaaactgacctggaagttaagtgacttgtcagtaaaatggtgaatagctggttatttgtattctaccgatttttagataataaaatatgcactttaaaacattaatgaaaaatacgaagagaccatggattagtttgaatttcttctggtgactttggatgtctttttacacctaatttggtcatgtcatttattcaataagtttaatatcagatactagttttaggtactgggggaatttttttttctcgtttgtaaaccaagtatgtcctacttaggaacttaaagcttcctgcttttctttaggttctaaagtgcatatatatattacattatattttggtccctcaatgtatgttatttctttttttctctctctctttaaggtaatactgcattgcatgattgtgcagaatctggaagtttggacatcatgaagatgcttcttatgtattgtgccaagatggaaaaggatggttatggaatgactccccttctctcagcaagtgtgactggtcacacaaatattgtggattttctgacacaccatgcacagaccagcaagacagaacgtattaatgctctagagcttctgggagctacatttgtagacaaaaaaagagatctgcttggggctttgaaatactggaaaaaggcaatgaacatgaggtacagtgataggactaatattattagtaaaccagtgccacagacactaataatggcttatgattatgccaaggaagtgaacagtgcagaagagctagaaggtcttattgctgatcctgatgagatgagaatgcaggcactattaatcagagaacgtattcttggtccttctcatcctgatacctcttactatattagatatagaggcgctgtctatgcagactctggaaatttcaaacgatgcatcaacctatggaagtatgctttggatatgcagcagagcaatttggatcctttaagcccaatgaccgccagcagcttattatcttttgcagaactattctcctttatgctacaggatagggctaaaggcctgctgggtactactgttacatttgatgatcttatgggcatactttgcaaaagcgtccttgaaatagagcgagctatcaaacaaactcagtgtccagctgacccattacagttaaataaggccctttctattattttgcacttaatttgcttgttagagaaagttccttgtactctagaacaagaccatttcaaaaagcagactatatacaggtttcttaagctgcatccaaggggaaagaataacttcagccctcttcatctggctgtggacaagaatactacatgtgtagggcggtaccctgtttgtaaatttccatctctacaagttactgcaatactgatagaatgtggtgctgatgtgaacgtcagagactcggatgacaacagtcccctgcatatcgctgctcttaacaaccatccagacatcatgaatctccttattaaatcaggtgcacattttgatgccacaaacttgcacaaacaaactgctagtgacttgctggatgagaaggaaatagctaaaaatttaatccagcctataaatcataccacattgcagtgtcttgctgctcgtgtcatagtgaatcatagaatatattataaagggcatatcccagaaaagctagagacttttgtttcccttcatagatgataacttgactgtattttagcactgttaaagcacgaattggtaacagttgtttcataaatgagcactgttgtgataacaccagcattcatttagcttgattgatatcattgtgctctcattggctaaagcattataagcatcaaatttacaacattggtttcccaatatttaatataaatataccatataatatattgtttgtgaattattgagaaatgtaacattcaaatttctaaaattgtctgccaaaggcttattcattctggttttgtttgctgttgggtgtttggggcagagttaaccatttctccatggtgtctttatactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcagttaccataagtgctttatcttctctatgcacaggcttaaacttgactgttgtatgttagcatattttctatgcagcagttggtcaacttcaactcaaaacactgttttcttatgtttgttacaaacttaattttttgaaagtactctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgagaaaaactcagtttacctgtgagttcaatgagctggatcactcacttggatttttgtgttgacattttattctgagggttgatgttacactatttaaggagtcatcaatgcaaacagtcacattaggtatgtcatcatctttagtcagtaaaaaccttgtaatgaggagtagtaaataaacaagagaacattagactttttggttaaataattgagatttaatttttaaaagatattcttactcatttgctaggttgtaaatttgatttcaccattaagaaaaggtaaattggatataaatgaacgatctccaactttttgatgaagaggttttactatctctcactgtgggaaaatttgatgaaatatttgaactgtcacatatattaagaatactttatgatttagaccaatattctagaaatatcaaatgtcagtatcttgaaatcatctgcctctaactttgtggtataagaattatatatgaataagctattatttttataaaggaaaactttgccattatagtaaattacattagttgatctcgataatttgaggataacagatgacaattgaatttttaattgatttagtatttcctcctcctctttgggggctgggtgggagggcttacatgctcttatagtgaggcacatctcactgttttgcagcagaatttgaattgtgcaactcctgtgtaaagtaaggatttctttaaatagcatttttgcaccagtaaaaatagataacttagaactcagtcttgataactgaaatgacttatttcacttagaatacatttctcccttctctgccatctccacaaatgccattgggaggttttgaaaaaccagttaatttaatagctcaaaattgtccctgattttattttcttttagggaaaattgtttcataaatgtgacactgataaagcctttgtcagaaagtattctcacaattatgagatggattataataaaatacttaaatttgtgttattttttgaaccacagatgagtaaatttaataatgaaccaattacactcttgagtctaactaaactgtacactgtagcacggtgttattgactggagttaatgtgtaagttattaacatttctatgaaaatgcccttttggggcctcctgaattttagatgttccactgttttgatcatttctataaaagaaatggtcattttacttagatgccagtctactttataaagacaaatggattatagacttaaaaatagtcatttttcttattcataaatctgacaggcataaacccaaatcaaagataatttggtgcccattatgaatttgaagttaagtgatagctcacttgtaaagtgactaccttaatgtgtatagagaccccagtctactattatttgggaaaattgtttaggttatatgggaaaagtagctctttaaaaatcatattgcccaacagaaaccttaggctgaatttacaggtatgataatttttgtaattaattttcttagaattgtgcaggctggatgagataatgacatactcttttacactgtaacagcagcattattgcctagaactttaaccattttagagttagatactaaggaaacaaactaattggtcatcatcattttctttttttctttttcttttttttttttttgcccttatgtgtcactaaacaactagtttctctcccttttgtcagttcccattgtgtattttttcaaaagaagtactgtattcggatgccagctaataaattgtcacacaatggaaaatcatatgccacaacattcattgtaaggtttaataaaattaaatttgcaccaaatttaagtgtattcttattaactcaatacttgattggtattatcctaatgcaaatgatagtaaactcctgtttcagaaaaacctaattgataatttgtggccagttaaaacttaaaagatagcatttattgttaatacttctatgtaagtatgatttatgtacagtttattctaaattttttttctagtagagatcacagaagctaaagatatggggagacttttgttgtcaactgcatgagagaagggat

SEQ ID NO: 117036 - DNA, 1056 bp, Homo sapiens
ctatttcattgtagaccattgaaatcttgggtcagaataattatatagtccttgtagatatcatagaagacgaaacaggataaacttgtggaaagattcaatatttcttataataacttgtttttttctaactttagttacaaagtagatttatttgaagtattcaggtttaaaatactttctggtacacatgctatgttgagcatccccaaagccacccccaaatttggaagtaactcaccatataactgtactcataggtaagatttattactgtaatgtcataaggacatgcagctgaattatgaggggtaaagccgcaggtgaagtgtagagaaatctttgtgtagatgtttttatgctttgttcctcttgtgaggggtcacatagagcatattcttccccagtaatgtaaatacatatgtgtcatgtttctaccaaggaaaacccatgacagacccagtgctcaaggtttttactgggggctggtcatgtaggtaccctgtgcctagctcatacccaaaattctagactcccagaaggaaaccagacattcagcataaactgcattgtttctacatacagtttaggtacagtgagatacccttatcatttagggaaagttttagatcagtatagagaactatttaccagccaagttcccagctaccagccaaaggtccaaccttgcaagaaggtctttctaaggatagcagtctcagcctgccatgctacctcttttctacagacatgcctaaaatgactgactgttgaaattttatgtaaacattgtatgtaaataccagaggtcggcatgataattcctattttgacgattagtaaaatgtttatcattaaacttagctaaaatacctggtgtttccgatgtcttaatgtgtttcatacaggcttttactaatgtgccagtgcctgttgtcagttttaatctgtgtgtgggaagaaaaggacagtgttagaacatttagtacagctataaagaatgtttaaaaagttaaattataataggaaataatccattatgaaaggacacttcag

SEQ ID NO: 117037 - DNA, 1095 bp, Homo sapiens
taccttttcatggtatctgttaatttccatagtgattcttcatgaatgttgggggcagattaaagtacatgttcatcctcctccactctgatcctgaagcttcactgctcattctctcattggttctggatttttttctatgggttaatggtaacaaaagcaggaaccaattgaaactaaggcagggacactggagaaggatgtgatttagcagcaagagaggatttttccccacttttttagccccattcaaaaagtagaaaagattaataagactagagttaaattagaataattccttaggacattttgtgtgtcattcactggaaatggttctgaggaaagaaaatgtcagtacattgtgcttggtctgcttaaagataaaatgcatgtgacttctacattccattacttttaaacaggcggttgatatttgaacatgttatttaacctcttttcattactttttaacaggctattggcattttgaacatgttttaacctaaggtggaattcactaattgagagagcagttgttgagtcccgcagtgtgccaggctgttagacttaggatatacaaagagcaataagacaagatagccagtccttgattccctgctcttgaggagctcatggtttgattggagagacaggttcataagcagatacttaaaccacagtatggtaagtgcaacagtagtactttcttctattagatatttggaaatgctttatccccaacaacttataacctgaggggacaatggttttcttcttttcccatggcattccaaaaggggagaaaatctttgatatatttaggaatacctcttcagtttaacagtcatagcaattgagttttgagacgggagttggttcctatttaagaatctagactgtaaatctgtagtgattaggtgagtccttctcagagctatcacagtgatctcagcgcttcatggttatagtcatctttggcctcctttggttcttttgtttgtgttttggggttgtttttgtttggacttagaactttgcagatccaaagttaagtcctcttcaattccacttttacaccctaattctaacagaaat

SEQ ID NO: 117038 - DNA, 1142 bp, Homo sapiens
cacctttgtccagaagaagggctccggtttttgattgtgtataatttttgttgattgtaataaactaaaagcagcaaaaagtagtttagaatttttttaacccttaaaagcaactgccttgatagcataattttgatacttgaaaaccttaacttcccttacacgaatctatttatacgacagcaaaataattcactacctaatttttaaaagccattaaaatttaaaagtagcatatagacatgttaaaaaaaatcaaacagtgtaaattggtttacattgttggtttacatttgaataaaaagtcttattcctgatttctagatctctaatgcgctgacaaccactatttacagttttttatgtgtccttttagagttggtctatgcaaatacaagcatacttgtctatgtacaagcatgcttgtttgtgtagccctccgtctagtggttgattacatacttttttatctttatttatttttctaaccttggatgtcattcaactccaacacacatagctacctcattctgttttgtggctatacagtatttcattgtatgaatgtacataatttatctagtctctattggttgatatttaggtcacatccagtactttgctaatataaacaatgctgctgtgaacattcttgaacaaaaatgtgtcttttcacgcttgtgtgagaataactgtagtataaatacctgtgttcagaattgctaaatcaaagtgaatgtacatttgcagttgtgatagtgtctgcctttcagaaaggttaaaccacacaattatggggcactatatagttactgagcatatttgctgtagattgtgtgatcttttataaaaatgatacaagtgtgatcttttataaaaatgatacaagatcattgtgatttttctgaatttttttttccagaggaagtgtaaaaatcccacaaaatcccagtactcagggataatacttccaaagatatttctgaattttgcatactgatatatgtatgcagttttatatgctgttctataacctgttttttagcttaataaatgttatctttaatattaccaattatagctctttaatttcaatagctgcatactcttctactgatggagttttatgttgcttccagttt

SEQ ID NO: 117039 - DNA, 1076 bp, Homo sapiens
taacattggactttggttcctgtgactcttgcctgtgtcgatagagttaaactggagctctgctttgaaagataaataaagcacagcctctcaactggacataaatggatctaaagacagcagtatttaacgcagctcgggatggcaaactccggcttctcaccaaattgttggcaagcaaatccaaagaggaggtttcctccttgatctctgaaaaaacaaatggggccacgccactcttgatggccgccaggtatgggcaccttgacatggtggaattcctcctagagcaatgcagtgcctccatagaagttgggggctccgtcaattttgatggcgaaaccattgagggggctccccctttatgggccgcttctgcagcaggacatctgaaggtggtccagtccttgttaaatcatggagcatctgtcaacaacacgactttaaccaattcaactcctcttcgagctgcgtgtttcgatggccatttggaaatagtgaagtaccttgtagaacacaaagctgatttggaagtgtcaaaccgacatgggcatacgtgcttgatgatttcatgttacaaaggacataaagagattgctcagtatttacttgaaaagggggcagatgttaatagaaaaagtgtcaaaggtgagttcagcttctttgtttttctaaatgtctaccacttattttcaggaagtttgatacatcattataagcactggtgttgagtaaaccagcattgacagacctgttttgattaggtaagtcttccagtatgactttgttgagtgtttctatgatgtttggtaatagattgaaaaagtgtgataaaagacttctgttactctgttaagcagtattttctctcttatttggagtaacttaaaattcttgggaaatgggttccccagagttacagagcatgttagtggtagctgatctgagcctttaggcttatgcttaatctacttgggaatatggttaaatgtaatacatttttcttagctttttgttttgttttttttttttttagaacaaccttggagtagaaattactatatttattgagtcat

SEQ ID NO: 117040 - DNA, 1034 bp, Homo sapiens
ggggcccaagtattcaaagggtgtagagtggctcaatattagtatctaattcaggagaatcatttcagtgcaggcaaaggatttcaggtcctttatctgtacattttgcaggtaaaaaacctcagtgcaggtaaagaaaccacatgccatgctgtggagtcaggctattcccaactgtagagaaagtccattgatccatgagtgtggtggggctggccccagggctagtgagaagctgttgccatggctgcattgctggtaaggtgggattccgtgtgtttgccctgagcaatctgcgctgcctctgtgactttcctcctcttctcagtcttacaccgcctggtcttaggtcatctgctaagctgtcacagaaagtgacgtaccctccacacctgtggatggtctgaagggcaaggaggaaatttcagaaagctgtcaggcacttgatgaaatgaaaccacagcatctggaagttgatgtccttaagccaatgaccagaaggaatgaaccagagaactgatgttgttgtccatggacctgatgtttcttatgagattccaagtagaaaaatttattagattttgaacacttaacggctggataaggacaactttcttatatatatatatatatatatatatatatatatatatatatatatatatatatatgtcatatgtggcaatactcttgtcaattaacatattaagtttggattgaggtaagtaatacttgaaagtgccattaattaataactcagagcatgaaaattatttgattaaaagctcaatgaggctgggtgtggtggctcatgcctgtaatcccagcactttgggaggccaaggtgggtggatcacgaggtcagtagttcaagaccagcctggccaagacggtgaaaccccatctctactgaaaatacaaaaattagtcaggcgtggtggcaggtgcttgtaatcccagctactcaggagactgaggcaggagaattgcttgaacctgggcagcaggggtcgcagtgagcctagatctggcca

SEQ ID NO: 117041 - DNA, 1034 bp, Homo sapiens; identical to SEQ ID NO: 117040

SEQ ID NO: 117042 - DNA, 1034 bp, Homo sapiens; identical to SEQ ID NO: 117040

SEQ ID NO: 117043 - DNA, 1069 bp, Homo sapiens
gggaccaattaggaggcagtgcagaagaccaggatagagacattgatctagaatgaaaatgtggtagagaggaaacttgaaacaatttgagattatctgttagagttagatacacaggacttggtgatcacttggaagtgcaggaataggagagtaagaggaaggtatcaaggataccccaggttttgggtaataacaggacaaatgataatgccttttaccatgatggagaagtctgggaaaatgaggtgcaagctaccttccaggtcagcaagtaagacaaattaagagtgctgggcaatacatattataagagatgtgaaccagatattatggatatacagaggatgagtacttaattcaacttggagataaaaggaaatgcaatccttgagtagtgtcttgaatcataaagaggagctattcatgtagatggttgggcaagggtacattctaagatggagcatggaggcaacaacatgacatttgggaaaaccgtaaataggtggatattagaactctcaagagtaacatggtaggagcaaattttatggataaaaggagagattggatcataaagggcctagaatgttattctaataagatagagtttttcttgaaggcattagggtattatcaaagggatctttaagcaagagaaaaacaggatcagttttccattgcagaaagatctatctagaaatgatgtaaagggaaagagactggaggcaatgaaactagttggatattatgggaatttgtaatcctctaaggaggaataatataggtcttgaactaaagcataggcagggaatggagagaatgggaaaagagacagatatgtttaggaggcagactaaacatatctattagcaggacttaaagtttagtgggtggagttgtggggagggtttgtttgaatgggtgaaagaatatgagaataatttgtaggtttccgtcgtaatcggtagagaggatattagtatcattgaccaaggcagagaagattgaggaggaaagattgattgactgattgattgattgattgatccatctgtctgtccatctg

SEQ ID NO: 117044 - DNA, 3751 bp, Homo sapiens
aaagaactttgactaattcagcttttttttgtactgtgctttgtttatttttatagatatttgggctttgacttatattctcattggtgagctcactgccattttcttcctaattcttctttaaagaacttgggctggaaattctgtagtcaccaaccttagctgataagtatttctgctattgttagcttagtgttccatctgcccccttactgatgccatggctgtgacatctcagttggggaaaacagctgcttcatgagatctctagccttaacagttgtcccagtgaaaatgagcaggggggtttcattgcaaagacaactggcataaatgtatgaatgaatgccagattagtagcatgttagtcaaaagaggaattgagatcaaattgaaagaaaagctgaatatgatagatgaagtctacagaaagtatcacacatactgactgaaaatatttctctgcagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacacgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttcaacaaactgactttacttgtttctgtcaggatttaaatctttctaaagctccttataaacttaaagcctagagtacagttctgtaatgagagtgattatttatttggtattttattaaaatatctgagggactgtccaagaaagaaggtgaaagagaaataccacgtctgtactgcctaatttgtaaccttctctttgcattccttactgaaagtttgtgtaggtgaaaagcagttaaatcatcagttgctctaaagaggtcttaatttttaagtaaattacctttagtttgtatattacccagttgtatcagtgtttttcttaataatgtagtcagaggggacag

SEQ ID NO: 117045 - DNA, 1069 bp, Homo sapiens
gtgtgtgcttggatgatgctaataggaaagtgggttagaaaattttcagaaggaaaatattgcaggcagtaagcttagaggttaagaatatgactttggagttcaagttctgcctttcccacttaatttagatgaacagtcttgaatagttcgcttatttaacatcagtttttcagtctgtcaaatggaaggaaaaaagtatattgtagggttgctgggagaattaagtgatctaatagatctccattaattagcacagttgtctggctagttcaaagtgaataaaagttggagaatacttgttcagtttctgtaaagtttagttgaagtaaaatctcccaagttccatccactggtgaaaatttaaaaagatagtaaaagtcctttgcccatcaccttattgccattttaataggaaatctgattaaatctgattaatttttcacacttttcacagtgatttttcttttttaatctcttacaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccaggtaaataaaaaaatcagcaatataatgttggtatatttaaaaggaggaaaaaagcataatttaatatcatgcactaactgatgagcatggaattttgagactgacagtctttaaaatctatcttaattcttacatgtaggcatttcacagagaacttcagacttttgtagtgaaaaataatgttgaaagattttatgaacttttaattgtaaagagaaagaagcattaaaataaggaggaagatcactaaggtagaaacatcagtggtaaaagaaggttgggaaggctgagcagtgttccaatcttctgaagcattttctttaatccctgaaggaatgt

SEQ ID NO: 117046 - DNA, 1018 bp, Homo sapiens
gtgaattcccaaatctatgagtacttctacagcatatgatttttctttttttttctttctttttttgagatgcagtcttgctctgtcgcccaggctggagtacagtagtgtgatctcggctcactgcaacctctgcctcccagattcaagctattctcctgcctcagtctcctgagtagctgggattacaggcatgtgccactacacctggctaatttttgtatttttagtaaagatggggtttcaccatgttggtcaggctggtcttgaactcctgacctcatgatccgcccacctcggcctcccaaagttagcaattttgggaattacaggcatgagccactgtgcccagcctatccctgatatttaagagaaagccaaatagacacatcaatgcattatatttcacagttccttaatctgtttgaagagatggacacaaaaatatacacaaaggacacattttcagacctttgtgaattcccaaatctatgagtacttctgcagcatatgatttttctacagcaggcaatgcatttgaagtttaaaaattaatgtgaaattttcagagccttactaagagtgattgccaacttgatagtgtattgaatagaaagcaaaaccacaaggaaaccctgatgttggccagtaacgcaaatcatatttgtgtctcaagaaaagaacaaattcagaagccactagtcctcaaaagccacttaccacttaccagtttcagtttcagctgaaactgaaaacgcgaaatctctggaaaccaggaatccaggctactagattgtcagctcctcagaaacctctgtagttggaccatgttgctcaccttcctgcagaaattcctcaacattataaagatttcagattataaacataatattacggggcaatattttaaatcctcatttaaaatggaagttgaagacagtaacaaacacaccaccttccttaagaaaaccagttttgcattctccaaaatgtagggagcaacagagaaagaagtttc

SEQ ID NO: 117047 - DNA, 1378 bp, Homo sapiens
agctcagcttaggggaggggagtttgcagcgtgcacaggagcagtgtcttctcaaacttgagtgtgcctcagaatcacctggaaggtttgtgaaaacacaggttgcagtgttttagcaattccaggaggtctgggttaagtaaatccaggaggcctgagaatttgaatttctattaacttattggggctgccaatgcttctggtctgggggccatactctgagaactactgttctagtgagtgacccagtagctatgagcattcagcaggtcatggcaacagtttgaatgcttttcagagtgactggagagtgccacgcaatcctgcaggctgattacataaagtttgttaggagagtttgccctgtgattcttctctgttattctctcatattgcttatccaggtgacccgtgtttagctgctgaggttcagtcaccctgggctctggttccatctgcaatggatgaccatgtaaatgaccatgtgctctcggctagctatttaattttaatgaaccccagtttacttatctgtagaaaacgggatgataacttttttaagggacaaaggaccttgttactcattgcacagcaggcaacatgagcatcaacttgtttgtgttgatttcccttgccaccaagtcccatagggtgacacaatatgggctatatggatgctaggcacacagtgggtttgtgttgtagctaaggaacactgagctttgggaatccattgctttatagcaagcactaaataagcctactcttggtgtggaggaagattgtatcttatctctcaaatttaccagcacataaaataaccttgagaaattgccccataacagagcaatcagtcttacagtcttgccacacccagaagaagagtgccaggggcccaaggaggactggctgttcccgcactgtgcacttatgcaaagtgcagaattgctgtatccaagcatattcccattttacaacttgacatccattgccaaattgcccttcaaaaaacttttaccaagttacattcccagcaaggacccattttcttatgttcttactacactgagtattatcctccttttgatctttgcaattttataggtcaaagacaaattcttgtttcacttgtgtctctgtgatcaatagtgagattggacacctttttacactcattagtcatttgtattttttctgttgtgaatgtaatgtgctgattttctcagaactggttggcttggctcttctccttggacccatgaagaatgcagcctggacctggtcttatgtgctgagtatctattatgagcaaggctctggtctctgtccttgagcttctccacagtagttgggaaaatgaaccacactcaagtacagg

SEQ ID NO: 117048 - DNA, 1063 bp, Homo sapiens
actggtgatgacacaggaggtcaaggttttgggaaatcaagtagcggtaaaacttgattgctacgagttctacagatcttaggaactatagtgtcatctgggttgttctaaaggccctagggagaataagtagggacaaagagaaatgaaattgccagatgagaatttatgtggaaaatcagagagccctgaatgcaactttaaaagcacatcttatttccaataactgcaggaggaggtagttgagaactaagcttaggatctgattataagggttgcagcattaattaaatgctcaagttcatgaggcttattatattaaaatatagacacttagggggaatgaatgcaaccctgtcccctgagtcatggaatgattcatactactgcaaagaaagtatgacaatgcgttcacaccactggaattcactagtcttgcccatctccaaaaaggagctggatcaccagaagagcagaatagcctgctgacctcacaattttggcaccagctaaaagaaagcaccttcaaggttagggggctatcctgcaagatacggcaaatgccttaaatgagcaacatctctctatatctttctctacaggtagaatgaatgggtctggagaccaagcaaacatgtgacatttgcaaaaatgtatagtgtacaaggctacaaaacaaggcttaataaattcctaagaatggatgctatacagcttgttctccgaaaagagtgcagcaaaattagaaaccaacgttaaaaggagattagaaaccctcatatgttttgaaattttaaaaaacactacaaaaacattcatgggtacaatatggcaagagaaaaaataaaaggtatagcgtttggaatggaagtaataaaatcgtcattatttgcagatgacatgaattggaaaagaaaatgaatcttgatacttttgtcatgcaatataaaaaatcagtataaaatggatcacaaacaaatgtaaaggtaaaagagtgaagcttttaaaaaatacataagagaatcttcatggccttgaggagggtaaacctttcttaaacagg

SEQ ID NO: 117049 - DNA, 1008 bp, Homo sapiens
gggaggccaaggtgggcagatcacaaggtcaggagttcgaaaccaggctgaccaacatggtgaaaccttgtctctactaaaaatacaaaaattagctgggcgtggtggcaggcacctgtagtcccagctactcaggaggctgaagcagaagaatcgcttgaacccgggaggcggaggttgcagtgagccaagattgcaccactgcactccagccagggtgacagagcaagactccatctcaaaaaaaaataaaaaataaaaaaaatctggacccaccttttgatcaggctttagcattatgtcttgatctttttgaagcatcagagtagcacactgtggtagtgatcatttttcctctgctactatgtcaggagctccacattttctctcatctattctcactcaaggacaaacttgattcctataccaaaaaaaaaaaaaaaaaatgcatgagttttcgtatttattccatgtaaatgatgacttcattttttgaaataaagttactttgatgaactattaaactgttttctccttctcttccacaacttcatcactgccttattccaacctcctgttcactctctcatgaggtcttccacctcacccctcgatggccaccatcctgaaatacccacctacttggggatcaccaatcaaagagcctagcttcagagttcgttgacctcctcagtgccagtgatttccatctacaattccacaaaagtagttcacatgggtcatactctggatcatgtcatttaaagctttttttccaactgatatctttaccattaatagcataccttctgtcagcaacctcttattcttctatctcagcctttcactcacaatatatctaatcttacccaggttcatttatttgaacccctcaattttttttccagtttaccaacttagatgatgcttttgttctatcactgtatttgcttacttgtcttcacgctcttctattttactggactcaaaaccacagcccagattcca

SEQ ID NO: 117050 - DNA, 1739 bp, Homo sapiens
ggggaggtgttgaccattggctgtcttccagatgagggtgcttccctgtcttcctggatgtcaccagctttctggtattatctgcagcccaagagtcatcactctcttctctcacctaggaacagatacctctcttgtttgcttctggtccatgggaatgagatggaatggaaaaaagaagctgatcagcatggctcctcctcccaccatccctgagcaattacccttttggttgcctcagggtccagctgctccactgcctgccacctctgagactggggcatctcaggatccctggcaccttttgccacaatgtcattgcaaaggtttggggtatggctctttctgccttctatcttccaggactttttcagcttctgattcactacggcaactctaactgttttgttccaacacaggtatagagttttaaaaaattattttctcttgtcatgtctaaaaatttgaaatacaagacagagactcctttgctttacacatttgcttcactatttccttccctcgatcacctgatagttttattctaatctactggtaacatcctttaggcattggcttaggtgctgagatggtctgtggctctctgaaattataaagcaaaattttatatatctgtaaacacttgcattttcctagagcgtaggctggtaattcttgttttcaaagaaagccatgaatcaaagaggctaatgattgcacaaaaacaaaagacggtaagacaatgatttcacaattgtataagtcttgcctggaattttagatttcctttcaaattctattttaggatctgattacttttgatccagggagtaaaaagtgagaatctgctacggcctcagctgattttccacataggtttggaactgctttatgggaataatctgtgtaatcacttttagtcaaaccagaagagagaggaaagataagaagttaagaatccagtcaaggtaagcctgagccagcagcaccctagaatcccacagcatgcactcagcccctacagtggccagcagccaggtgctagttgctttgccttctcaactctttgtttcccttggcaatgacttcttagagaggtccccctgcagaagtgattgcaattgcaaattaagaaaatggatgagagaaaataattattttcttccattctccgaataaggcatgaggttaagcatatgagagaacaaaataaaccaattccagcatgtaaatgatcagcatctattttaataactacacttgggattctgtaaatataatgaatagtagtatatggcttttggaaaccatttaatggatccttatcagcagcctacagacaggatctgaatggtcacagctttggataatgggacacaatttaggaattgagggaaaaaccaactttgctaatctctagaacaatcaagaaaatgtgtggaatttataaataacagtggagggaaagcatgagctgccagaaagctgctattcctctgcttggcttttagcagaggctgaggaatttgcttgggttgtttgggaaattcttgtgatacttataatataatcaggcagaggttttctttttttaatatatttctgcttgcctgccaaatgctaatgattgctggatgctaattgtctacagcagttgttaaatgagtttcccttcacatctcctctgggggtatttataaaagggtaaggaatctatcaagaagtatgctgtagaaagc

SEQ ID NO: 117051 - DNA, 1064 bp, Homo sapiens
aatatctcacttttattattattttcgcattgctctagcacatccactttggaaacaaaggacatcattctatttatagaattctgtttttagtaatggtatttccatttacaaaatatagtaattctcaatggctgaaaatatcaaatcctggaaaacatagcattctaatgtgtgatgttaagactgttctcgaacagtggttggctgaagattcatttgataaatttgattgttctaaaatagacaattttgatgattcagacaattctgatgttagttctgtttagaaataactccaagaacagtttttatgtttcactttcaccctgaaaattaggcagatttgcttcatcctcaaagagcatgtttatataaaattgaatgagcgctggcagcgagctgcacttttttttctaaacaggaaaagggttaaccattacaccatctatattctgtgatagaccctactccccacccctgtggagaattgggtggcaatatgttgaagctggcagtgcactgagaaagctttgtgtccaatttcgcagttttactgaggataaaatgggagttctgatagacaaagagttacacaattagccacagcagcactaggagaggaaactgagtctcttgacactatatgagaggtgaaatactcttgcttttgtggtttattaaggccttctggaaactttcaccaatgaagaaaatctgtaagacaaggtgtgacaaggtagactcaaaagaaaaaggcagaccacttacaaaagagggtactagcaaaagggcccaaagttccaaagttcctgccatcctaagcttacaaagtatttacttgtagaagagcatggggaaagtgggataaactggtataatcgagacaaaaatgtcaaatagcccaagactaagagctgggcactctgggatttcgcctcagccctgtaccttttctatctaacatattgtcctttggtgatttgataactgcagcttcctttatgggttgatctgatcttgagtgagaacatttggtttcagtgatataattagaacaaacc

SEQ ID NO: 117052 - DNA, 1035 bp, Homo sapiens
aaggagaaaagacaaaagccttggggaaaaaacattaaatgttaagtggatcttctcagtgtggtacaattactatggatgattgtcttaatcctttctaaaatttctctaatgtactttcataatcaaattctagcccagtttaagtgagttatatgtatttgggggaagataaagtgttgctggttttgtgtttctgttatcaaagtagtataacaaagttaaaaaaactgttcattagtaggggtatgcatcaaaattgtaccttttatatgaattgatatagatgatatattattactttaccctgaacattgttgaactgtaagttgataacattttaaaaattcagctgaaatggattttggctggggagatagcttattgacagtatgcaggtgtcagttctgggaagactgttactgcaggtctggatactagaccatctactgagttcagttgtcattttgtgtacatatagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatggtaacatcttattctttttctaagggcaagtgggaagaaccatgaccttttgtctgaaatattggttacttacactttttatgcagtagaacctggatcatgagtcatgatttaaaatacttgggaaatgacttaaacatagcaggttttgttttttaagcctttgtatcttggttggaatcacttattgaaaacatatgcatgcagatcagtatccactgaaaagtcatttacttgccaagacttaagacagttaaaataaaatatgaatttacttcagtggagtctttcaacaaaagagatcaagttggaaacattagccttgtgttagaaaatagaacaaaatgttctgtaactaattaagaatgctagctagtctctgtttttctaaaatacata

SEQ ID NO: 117053 - DNA, 1062 bp, Homo sapiens
ctcccaaagtcagagaacagaatccttcacagcgctaggcacctatttaatgcaaaaaatactgtagaattgacttctctcccatctcctgtcttcccccaactgccccctcgggactacatccattatgttaatgagctgtacctcagatatctgtgaaaagaccgatcaacccagctggttgcacttcaaaagctttagagtttgtcaatcgagactagttcaaggtccttgaaaatacacttgttctaaagattaaagattaaaaactgttacaacctgtcctggtttaacagtggtttagagtgtaggctctggaacaacaatgctaaccccgggagcctggagccgctatcgatagaagacctagtgcaagtcattcaacttcttcattgcctgccattcctcatatgtgtcaagtgtctggaagagtacctgtcccataacaagtcttcaattacctggagcaaatgcaagaaaatttaaaagctagactctctgctagctttcacggctacagaagggctctaccatgaactaagctgataggagccaaaggaatttcctcaagtcacttgtatatgaaaaatgggatccttagtggtcttcactttttctatttcaaatcctaaaatacagttgaaaccgcccatgccaacaaaactttacgaaacatcccacatgttgaagagtgactaaaagaacctgctcccaagaaaaacaaacttacttctttccttattcttttctttcacttacccctttctcctaaccctaaacccaaaaaaccacaaagactgacgcactaactgctcagaaaaagtagaacctctcacacttcggggtgattaaattttacctctggccccggaggattggtagagagattcgacttaatcaccaagccggggctgcaaaaaagccagcttaccagggcacctcactcaagtacatctgggaagtaggggtctttaatttacattacagatcgtcagaagcaaggataagataaatcagatcatttgggggctgaaaaaaacgacggtcgaatatttaatctgc

SEQ ID NO: 117054 - DNA, 1034 bp, Homo sapiens
atttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgaca

SEQ ID NO: 117055 - DNA, 1910 bp, Homo sapiens
agaaaagttaggagttcagagaagctttcttcaattgtgaaaacaatacaaaatagctagctgattggaatgcagaaaaatgcagattaatcaggataccattaaacatctctgtttttccttcctttcttgtagtttatttatgtgaatcagtcctttgctccttccccagaccaagaagttggaactctctatgaggtaaaaaaaaaaaaaaaaaaaaaaaaaaaagaaagaaattactgcttttttttcttaatcgagtatgcacatctgtataatatgtatattgtgtagtattgttaattcacatttttatttcaagagatggcatgccattcttaattttctggggtagaaaagatgactttcttgttctgttatctaacatcttgatcatagaaagatattaataaattatacaatgattgaagaaccaaggaataaattacatttcaaagtcatcttcatgattctcataaagtaaggctttttctttatctacatttgatttcttctacattgttcttataatctgttatccaaatctgcctacaagaaattgagaaaacagcataagaatgactgtttaacatcttacagagtcattgtaatagttattagagtacacatactagcaccactactagaaaacagctaaaattacatatattgtggttggacatgtagagaaaggacaagattaaaatacataagctcattcatgcctaagatgcttaaaggacagattttattaaacacttaggattattaatatgtgtctgatagaaacaggcatcctttgaaagagatagcctgtaacataggtaacttaatatacgtgtgtggatatttatgatacatgtggcatttatcttcttagtttcatctaagaataataaaagattgagtttgatttattgccttttttttttgtagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataattt

SEQ ID NO: 117056 - DNA, 1065 bp, Homo sapiens
cccgtatttattcatgtgtgtctctgcctctcctacagattataagctcattgagggaagagatcacattaatcttcatagttccatgtacaattctcagcacatcatagacactgataaactaagctgttattgagagcccttcccctcatttataatgtacaagagtaaaatctggatttgctcataaattgtcaggcactgaacacaaattatatctgtattacaaaaaattcacattataatgcacattgttttctgttacagttctgaaatttttgtgccagaactctactcagccataaccacaaattgatatttcagcatgaactatttaaagataatttaacaataacgtctattgagtacatataccaggcactgaaagttagtgtattatctcattttgtctttcctaacagacccaagaggtataggtcctattattttccatatcttacaaataaagaggatgagagattatttgtaaagccaggattcaaacccaggtgtgtctcagagcctatacacttaatcaccacactatattggctaagagagatgcaagcaatattgatggttcatggttggtgatcaaaatagtatctgtcaaccaactattctgatacttttttttttaaatactaagtttaatccaggacattttagtcccaaatttggatattaaaggaaaactaaatatgttacctgcaaataaagttttgttttccaaaaagaaaattattaaagggcacttcaacactgtgactttaagtactagaaatattttagtaaaaacagactaaactgaaacattgagcagtgaatcctttaaagagcaaggttataaggttttaattgttactttttttcctgcttcatttgcctgtaagtgactttattaaaaaacctaagtatatatgtcatacatttacccaaggaaagtgtacaaactaccttgaatattagacatattgatttttggctgtgtgcctgtgtaattatcttaggagaaattctttgtgggtaagtggggacatttttacgataatgtaatttcttgaa

SEQ ID NO: 117057 - DNA, 1027 bp, Homo sapiens
ttcacacatctcatattttcttacactggattcctagaagtattattgaatcaaagtatacctttattaggatctgtattaccatactgcattccacaaagggtataccattttacattctcaaaagtagtatcatctacactggtaattactctaattttaactagtttggtgggtgaaaagggacatgacattattttactttgctttttgtgaacttaaatattgtttgtgtattgatcatttgtatttcctctctttggaactgcctgttaagataaaaggcattttaaaaattagtcctgttgggagaactttgtaggatcaagaaaaaaatgatggaaaagaatctaacatttttacatctctcacatatcttcagtatcataaatacgtaagatggatgtagattaaatatttctgatttctaagtcttttatattccattctctttagatgtttcagtgtaattgtcagtaaattttattcttcttttacagttgacattttgctaaaggctgtgggagacactcctattatgaaaacaaagaagtgggcagtagagcgaacacgaaccatccaaggactcattgacttcatcaaaaagtttcttaaacttgtggcctcagaacagttggtatgaaaccaatggtgatgttttcctacaaaaatttgcagtagttcctaggcaacagtgaattaactgttgtttatagaaatgcatatggagccacatatgtcgcttttgttatgcccttttatccctttatttttatttattcattttttttttttgagacagtctcgctctgttgcccaggctggagtgcagtgacacactgcaaccttctcctcctggttcaagcgattctcctgcctcagccaccctagtagccaggattattacaggagtgcaccaccaagcctggctaatttttgtgtttttagtagagacggggccgcctcagaagtgctagaattacatgagtgtgccactgtgccctgccttatctcttgttagtggagt

SEQ ID NO: 117058 - DNA, 1012 bp, Homo sapiens
gcggggcccaaggggcggggcctgggcggggcaggcactaaggaaagcggaaacatttctaggtccgagccagcggcctaactggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaagtaactgaatttatttccgggcagagaggcgggaggttcagattgcatccgagtaggggtggcggccagtaaagaagcaaaatttagaggagcgcctgtcctagacctgcattttgaccagtcatcagaagaaaagaagtgtactttttgatttttaaggcctttaagttgagtgttaaaataccatctctgtctatcggtgtagggcctgatacttggctgccacacttatttttatactgtatttttttgagttggccagactgcgagctctttgaaggagggagggagctgagtggggcggggggaggggggtctcggtaattccaggtacttaacacaggagctaattatttgagtaatgttttatggtggtaggggtggtcattggcaaagcctggattagaattcatgccttccaacttaactcgcttttgcttttttccccctcccagttggttgtgaattcactccttaaaccaaaaaccaaattcttatgcag

SEQ ID NO: 117059 - DNA, 1071 bp, Homo sapiens
agatattgctacctttgattttaaaaattcttaaaatgctattaaacctatacactccatcctaatatatatgaattattcttcctcagagtgaagatacacaacagcaaatcatcagggagactttccatttggtatctaagagagatgaaaatgtttgtaatttcctagaaggaggattgtaagtaaagcatttcatagacatttctaagttttgactatgtgattaaaatatatactgtttaatcagtttatggtaaaagttttctacttttgattaattggattaggtgaattaattgccacctatgttagctataaatctaacttaaagaattatttttaaaagatatgcaatcttttttcctcttaaaaattttggaagggaattttatataaaggtaatatattaaatcgtaaaaattccaacattacagggaagtataaaatgtaaaataagaatctctcaaccttagtccttctacccaatttcttgtgtatccttctagaaaatagtttgtattgactaacatataaagtatgttatatgtgttgactaacctacaaccttaaaatttttatttatgagatcacactttgtatgctcatttgcatgttgctggttctcagtattttcaaaagctttgcatagaaacacatctaggacaagcttattctttttaatgactacagagtattcctttttgtgaatgttcataaaaattagattacattctttattttactgttacaagactgaagtctgtttttcaaatatacctaattcagctaatcaatttttctatttttaaaatgaataagaatattgccaaatattacaaacaaatacttttaaactaataacttccatgaaaatggtttgttctcaaacataaatcagtcagagaaacttagaattttctgtattttactgtgtatgatggatgagaaatactctggataacagggaatccatggtcataaggtactttttatcatgtggaacacttaacttgggtttcctgaaagattatatcatgctgtccttaaatgtccaatacatacttacaa

SEQ ID NO: 117060 - DNA, 1987 bp, Homo sapiens
ggcagaggctgcagtgagctgagatagcaccattgcactccagcctgggtgacagagtgaaactctgtctcaaaaagaaagagagagagagagacagagaaagagaggatgaagggagggagggagggaaggaaggaaggaagggagggagggagggagggagggagggagggagagatgccattttcccatattctgttgggatggatgttagtttaattttggttacatatagccttgattgtaaattatgtaagtgtttaggggtcttttaagaaggtgaattcattattgtaaacttaactatgaaatagctaaactatatttagaaaaatatgtttggaatgattcctaaattattatttctaaaatactaaaattccagtcattataaataaaagtatttcatgaaagagtttagtatcttagctcagttttcttgcatttatgtcaaaacaatgtaattttggaagagatcttgacggtaaatctatccaaaacttaagaagtgtcattcttcttttttttctggttgataatcagtcttaagctgtgtaacttactgtgacgtatggagttaaatctagtaagcacttacaaatgccccatgatctaatttccgcctacttctctgactttatcatttactaatcttttcttatctactggccttttttctcttccctgaacatacatactttgttcttgatgaaatgtccttttagtacttactaccttagcctgaaatgctcttctctaaattttttccaagccaactccttatcattagatctcagcttaaatgccactcttgcttaatattcagcctgaagtagggaacccatcaatatatcatcattgtattttgattgtcagtgtaacacttgccactatctgatgatgttctgatgtgtgtgtttgttgcttcttccccactaccagtgcttggcacatagtagttactcagagaatagtttaatgaatgaatgaactgaaattaagcactggcttcttttacttgatgtttctgaagaaaacagccaccttaattcacctagtctctgaataagttcacttaaatactttgccattgaatgtcacctttcatttgacaagtggtttttaaacaaattgtcagtttgcttgagctaatgaaaatgattcgcattttgtttccaataacattacaatttttttgtcatttagattaattggaggatctgacaacaaactgatttatagacattatgcaacgttatattttgtcttctgtgtggattcttcagaaagtgaacttggcattttagatctaattcaagtaagttaacacttgcttcttactatcttaaataacagtttgacatttaaatttttaaaaacttatatattctaaattttctaaaatgatgttagtaagaaataaagcatttcataatagatattgtgttggtaaaagaggtcagaggacatagaaacaagcaaacatttgatctgattaaaactatcataactagtttaatcatgacattttatcttgctcatgtaagttacagcaaggagcttaagactcgtgggtttcttaacacatgtatccaaaactaaccctaaaccctacctctccctgtctcctgaaaatctttcataatgtccctggaactcaaggtcagtcatcagcaaatttctttttatcttcagcctcttctgttaatattactttacattttgctctaaattaaatcttgcttccctgatgatactacgtgcaaccctttgaagtagtggccattttctctcctgcttctttctgcctttgagcctggaggtgtaatcttagcttctcattgcattttccagaccattctttcttctcaaacacctccaaattttatcttatgttatcagactataccaccttctatccatttagttatagtcatcactcatctccatctctccttcattggagattttgttaagaattgtgaag

SEQ ID NO: 117061 - DNA, 1036 bp, Homo sapiens
cagaagtattttatgcttgcgtcctgagattaagtcatcaccattgattattattttgatgctgttgttgatcttcttatgagaaagtagttctatctccaaaggggattagatggggagttttcaaagaacaaacatggtattaatatatcatatccaaagtaaattctgtcatgtactcgtggaaagtagaaactatcttttgtgttttgcaaaattttttatccatgcttcacacgttgatcacttgttttgatattagataacatacagaagaaaggatttcaggaggactttgtcattttccgattactaaagtaggctagagctgtttttacaatacccctgagttaccacatgctgatgtattgtgtcacaaaaaagaagatttctgtaattcaccttataggtactatgtctgtcactatcaggaacatgttggaagttctgtggttgtgatctttccccttcaattaccacagttcattaaatactgaagagggagtgtactgagcacacatgagtcagtcactttaaaaaacatcagttgaataaacaaagatggaagtgcatagcttattatttctgcttctgtttcatcaaatagctattcagagagaactgattttcttaatttgttcatcctctagtttttagaaaggcaattttaatgtaaaaagtaaaagtggaaaattataaaccaagagagtttacatcaaaacctcttggtcttgcatattcttttagagaacagatcaagaaaactcaatatgtaactattaaacctatgcttataattttgatattttaaatatcaaagtgataccattcatataactggaagcatatattttaatgcagagagttagtgtctctaaggtatgcatatgttgtcccaaatatgactttgtatctgtataaaatctgggagaaggcattattaataaattcgttatggaatttacaccgctattccaccagtactgaatttacattggtagtccacagaatttacaccagctacccaaacgaatga

SEQ ID NO: 117062 - DNA, 1645 bp, Homo sapiens
gattgatgaaaagaactggttatcaatatttttaaaaattatttaagtaatatcttaggaacatcatttatatttaaaaatcagtctgggtataattgagacacagctttttaaacataacatgcatttatctaggggcctttgtcagaaatcagagcttttattatgttggtctaaagttagtacatttctggtaatggaaaaaagtgaaccagtttaattcccaatacctagacaggtggaagcaaagctctgccagatcctgaaagagagaagcaaagatatactctgaatgtatttccatctattctattttgatagaaaaatggtttactataacattggaatattgggagaggagggtttaagctgggaggttgatgggattcgggggaagtataagaggcactcaggaacctgcctaagaataaaaggactccctgggggtggaggtagaggggtggggttggggagatctgttagcttttatgtatttcatgttattcttaagatggataaatgggtctgaatttagtcactactttttgaaagtcagtcctcttttttttccgaacatcctgatctttctagctctttccattcttctctcttacagacctttatctttcagtctcccagacaggacaggtagacaaggtattgctgactttgagaaatatgtactataacaaagggaaagcaaaatgatgtcaaaggcaattaattatttaggccagactcaaaaattctttgtgttaataaacccatatagtccctgtagcctattttccattctagtttctccttgtagtttcttcatcttttattggacttagtgtattttactagtatatcattgatgtcatgtttgttctgttttgtctgcctgcattgtaaaaggaaagtttaaattttttttaaacacttgtcatctaactgacaaattgcatttgcagaagtgacaatttactttgtatataaaaacgtaaaatttattttgagcatcatatagcagaaccaatcttaatttaactctcacagatttgttttttttccatctctaaattaggattctaacataaaattgcctgctgggttttggaagctgtgaatttaaaaaccaaaagctgaaccttcagagttttgcatacaaaatgggaagcagtgaaggcttagaatagtgactgttaaatagtactttttcccctcaaatggttttcagttccaaagtcttaacagaattgcttttacagttttgacctgcaggtgcatattaacagtggccaacagaaaataagatcagaaatcttataaaacttgactgtatttcaaactagaatgctcgaaaaatggaattaccaaattaccaaatcaccaaaatacaatgggttttcattgtagcaaaccttctgacatccaaacatgtcataatcagaatcaataaaaatatattaatgttttagtattgaattaaaaaccctgaatatttttgcaaagcgtattggcaaatattggaaatatttttaatagacctctagttttacaaaactaatttttcttctgatatttcctgtacgttttttcacaccataaattaactgtgtgaattacttttttaaaagttccatgtacgtggtgatgagca

SEQ ID NO: 117063 - DNA, 1258 bp, Homo sapiens
tcttctttatggaaattcctaagtaaaaatagtggcaaattggtcttttaactagaaaaattacaaaatcctcctatctaaaaaatgatactacctccaggacgtctgcaattttgtaaatttttcttccttagtagacaacatacttcctggtaaaagaaagccaaaagatggtaaacctctttgaattggattcttctttgatcccaacccactctaaattttggtagctagacctttaacttgaaacgatcaaattaaagaccctttcaaatattatacatgctgccttaattattatttagttgtatctccaacatctttgggggagcaggaaggaagggggggtaacaaaaacttcattgcttcaggtaggtataagtatagaggtcaatcacatttttagttgtacatcaaaaataactaacatccattaaattataaaacttctccagccctattcactatttaattgggtatggagttattcatttgtatcactcttatcattgcctgtgtagaatatacttattattaatactattctactaatttttctattatttccaattctgaattgataatccatggcttttatttcattgcttaacaatgtttgtatcctttatttagcaaatagtttacactggcctattttgtatcagtcaagatttttctcaggtaacagctttattattatttttattttaattaacaaaggtaggattacataagaaaagaaaactaaaattatgaaaagggaccttaaagctagtgtttctaattttatggacattgccatatataatctaatcaaagtggaagattcgtttttgttgtctatttttgtacaaaatgatgccactgaactcagatgtctttgttgactttgctttattatatagcctgaataaaaagtaatgaaatgtaattggtatataaattaaacctcaaatatgaaggctgttaacgtaggtgagaaaaatgatatgtatgcattttcttttatttgtaagcatattttcttttaaaattatttcacaaattacaaatgttcctactaataggaaagccaaatattatgcactagtggtacttactggaaattttagaattcatttatttatatttactacctcttgcatttatgcttttctttctctaaatttgtaaactgtaagctgaatatatgttgctgaatctatgctatatgacaaaacatttttaatcgttatatttttactaatgcatcaaaggg

SEQ ID NO: 117064 - DNA, 1128 bp, Homo sapiens
ggctttacttgaaagcctatttttttaatgttctagaactttattagaaaagtttaaaagagccctcacaatttaaaaaactaattttattgttttaaaatgttttaagggtttatccctaagaaattaaacaagcacaatctattacttgcaatttttatttcacagcacatattgctaataaatgccattttaaaagcaaaagaaaatctatcacaatcgttgcaagagatatttaataaggaaactaatgtaaatcatgcttcatgctatctgtcagttaaatcaagatataggtgaagatttaggttttatcatgtgaatattgtgtggtagtgcacattaatttgtatttaaatctttacattgttatcattgcatgtgttcactgtattttttaatgtgtcactgttttctctttatagattagtatttcaaagtaaccattccataccaattcaaactaccatctggtccctaagcttgttatatgaaaatcttttatcattgtcttccattgtaagtgttttatgatgagctacacctgagttgtacattttctttttcttttatttgcttctgtatacaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttattt

SEQ ID NO: 117065 - DNA, 1081 bp, Homo sapiens
gttcaaggggcaactgtaatttcaatctttatgttagtggaagtagctttttacttgaaaataactttaatgtttgatgaaataaaattgaggtaagagggaggctcttcctttcagaaatttgtattttaagacagctaggcttatagaatgtcaggataaacatgaaccagatgttgtagcttttagaagttcttttaagcatatgtagaatgcccaaaaagagcgagctttatcttgctgtagtatatggcaaggtttaagatattttttgttggcccgcatactaattagtataatttgaaatagaaggttgatatttcggatataccaagagctcacaaattagaaaaagacaatctaataatatgctaaggatagaaatagacaagtcatagaaaactaaatctcagtggcccataaatatgtagagatacttaacctcactagtagtcaaggaatgcaaatgaacaattagattttattttcacctatcatattgacaaaaactagaagagatgacaacatccagtactcgaaaagataatgggataatgtgaactctcatattttgatagtgggaatgtaatgtactactacttttttaaaaaaagtcgagttctgcggaaatttaaaaaaattaaaaatacacgtatcacacataccccatgacttcatttgggaactctatatagcacttcttggttcatttgtatagaaaggtatttattatatcaaatatttttgtaaattaaaaaaaaacctggagatgtattaaatgcccaccagtatggtaatagttgaataaattgtagtaactgccgcacttgcaatagcaaacaactggaatgacttgaatgtctgtcagaaggagactgatggaaaagctagattacatccgtattacggagtcctatggagctaccaaaaggaacgagaaatatctcttcatattgctacgaagttattcctagaatatagggttagcttaaaaaagcaaagaggaaggagagtacatatggaatgcatattagggctgtccagagaagagatatatgtagaaatatatatacttctttat

SEQ ID NO: 117066 - DNA, 1034 bp, Homo sapiens
acctgtaatcacagcacattgggaggccaaggtgggaggattgcctgcacccagacattcgagaccagcctagacaacatggtgagaccccctgtctttacaaaaaataaaaaaattagccgagcatagtggctcatgcctgtaatcccagctactcaggaggccaaggcaggaggattgcttgagcctgggaagttgaggctgcagtgagccgtgattgagtcagtgcattccagcttgcatgacagagtgaaaccctgtctcaaaaaaaaatttgttttaaaaaagactgactagaaaaggtgccaattagtgaatcctgaaaaatgcacggggaaaaactcaggtaaagagggagggagaaggacattctaagtgaatggagctgctgtgagcaagagttgaaggtaggagaagtctacagatttcagagggctctagtgggggtgtcaggggttgtctaggctctgacatggctaaactgcaaagtgcactccagtagcttctgtgtgtgtatatagactctaatgagcatcattcccagtgacaaaaatggagtgactagcaggtaagtgaaataaagtcaacagagaggagagtaagcagagttatgcaatttcaggacctccagcagctccattttggaaaatcattaaagcaatttaaaaaacaaagaaacagaaacaaaacaaaaaaataggataaaactacttcagtgttttcccccaaaacttccttgtagaactggcatgccttatatgccagtaaataaatacatatatttttacatattgaaaaataataataaagcagtgaaagtattctatatgatacttcagcagtggatatatgccattatacgtttgccaaaagccatagaatagaatgtaatagacaaagaactaaccctaaaataaattgtgaactttgtcaatattggctcatgaattataacaaaagtaccatactactgcatgatgttaataatcagggaaactgttgggggataacaagagaatacatgagaactccct

SEQ ID NO: 117067 - DNA, 1050 bp, Homo sapiens
aggataattattttgtatgacttagtttcttacttgaattagaaaaataaaaggaagtaaggttcagtgccgtggtgcactgttatttcttggcactttaattttaaaaaaacctctcagttgggacttttcttggttggttacaaaccttatcttttggaaaattttcctctgtctagttttaagagcattactacctttgccttcggcccttgatgtttttgttgtatttcagtgttgctgtagtacattagcaaaactcccttctccagctaattgtctaaaagcaaggtcaaacattggccaaagaatttactgtgtaggaagtgattgactgtggaaaagtctggtaggatttttacaagctttgcattttatcaatctggaactggcaagatggaacacatttttaattatgcaaaatttgctgtgtaatctcaaaaatatagcagtggcttaatacataaacattcaggtcaaatatatttattctgggaccaccttaggatttttgcatcattgccagatgggttgcaagctcttataattgaagattttgtttcctttccttgttctttgcggtaaaagtaattagtaatgaaatagcagtgtttaccctataattcacgagtgaacagagcaagtattaacctgccagtgaagtgggttttaataactcacaacataatatccaaaccctggtggcagaggacaatgtttagagggtggtaatttagagattagtatacgtcttagacactgtttataaacatgctttagttttctcttgggaaaacagcttttacttaaatggttttaacactgaagaaaaacattatatatatatacgtgcgtgtgtatatatgtgtgtgtatatatatatgtatatatatgtagtgctattagtgctatttacactgaagtacaaaatagcaaaggggacaatttggtattagtattagttaaacttttgaagttgacatataacaatagagtaaaagcttaactctagattaactgattattgtgaatggaagatgagagagaagg

SEQ ID NO: 117068 - DNA, 1139 bp, Homo sapiens
gagcaaattgctacatctctaggccccagtttctctctttgtaaaatggagttaacaatagtatggtgtgataaggattagatgagttaatacatacagttttagagccataacgtgacataataataacaaaataaaggttcattaaataaaaacatttgtagcttttttgtccgacatctttgcaaggctgcggtgtctgctgctactctccgagcttcgcaatgccgcccaaggacgacgagaagaaggacgctggaaagtcagccaagaaaaacaaagacccagtgaacaaatccgggggcaaggccaaaaagaagaagtggtccaaaggcaaagttcgggacaagctcaataacttagtcttgtttgacaaagctacctatgacaaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaaaaataaaaataaaaataaaaacgtttgtatatattctccacaaaaagcagaattttattgtacagaacactgggctaaaaatcagggtacacaggaggtggagaggagatgtgtgaggcgagagcagcccgcagtgagcagtggggaggagggaaagctctatcagcctgggcggcagagctcctccctgtgaggtcctgcctgggcccaccttcccacccacatccatgggcatctcagagatcctcgagggggcactccccagtagcatggaatcatagaatctgtgtgccataccagttgtttctgtccaatttgacagttcttctcaggaaaactatgatctgtgtgtctctcttgaatggaattgtttttctctgattgttcattcatctctgatcacttaaaaagtaattggaaaaagtaaaacatattaatatcatctatctccagtaactatatctggtgattcttttctactctccctac

SEQ ID NO: 117069 - DNA, 1056 bp, Homo sapiens
taactgacagttctaattttaggtaacaaaaatgtggtagttgcattcagcatagtgcttttaagaaaaaaataatctgttagggaaaaatctatcaagaatggtaatattttaaagaaaactttgggggcatttgtaggaggaagctttagttagctattcctcataattttcttaggtagattgctgcatttcccagcaatgctggaaaaatgaagtgttactctagatgacaagcctggctgcactggaagttgtttgatctcatattgactgaatttcccgtgacgtcactgccgtacaatattctggagtgtttctggtaatccctggagttctggtccagagtaccaatgtttctggtaatctctggagttctgggtcagggtaaaatggtcatgtgtatgatgttgattgtacattaatttattctcaatgttgaggatgattgcactgtcatcttaatgtcatgcttttcctttgtagaataatgaggaagtatgacaaaagtggcaggctcatctgtaatgacgctgatctgtgtgattgtctagagaagaactgcctgggctgcttctacccatgcccgaagtgtaactccaacaagtgtgggcccgagtgccgctgcaaccgacggtgggtttacgatgccatcgtcactgagtcaggagaggtcatcagcacgctgccgtttaatgttcctgactaggtgctcttgtatatggactgatttgtttcttcttcttacacatttaagttgacctctttcttttgggtgaattttagggcttgggggaaatatcgaaaaaacatactgaagactcatgttctgtcaagccccagaacaatgtagaatgggcaataattctgtaaccttcttaactgtgtcaacaattttcaagtcccttaacttgcaaccaaagaatgtaacaatggagggatcagcatttctcatcagcaccctcatctctactctgccttcaaattaaaactctcttccctctttgctgatatctgagaaaatgtagctttaagattttcaaaactctgtagttg

SEQ ID NO: 117070 - DNA, 1050 bp, Homo sapiens
cagttctggatttgttgcttgacgtatgttttaggactaaaataagaaaagtcctaaaagtaatggtgtgactacagtacacctgtccacggagcaagagaacttacattcttctgcatcattctccatagaatttactgggttttccagatttcacttacttttactgagcatacactgtgaactaaacattgtgttaacacggtaatgaattgcatttcctttaaccatcacagcccagtaaggaagacgtaaaatcaaattacccaaatcacattctttgaaatgctcaccaggaatgtgcagccgggaaaccagtaaaaacaagcagggcctttttcagtttatatcttgttttatttttgagaataattattattttgtaattggcagaccaaatgcatttattacttcttcattttagaatcatataatcttagagccaaaaagagccttgcagctcatccatatagtgaattagtcgacaaatactaacagagaggctgctctgtgacaggcagcaggctaggtgcaggggaccaggcagtgaacaaaatctgcagggctcctgtcttcatggggcttatggactaaggccaaactcttttttgttgttgttgtttttgtacctttgcaactgaggagatttagacccagtgagattaagtgactcaggtaaggacacacagaagaattggcagccctggtgttttgaacactaagactaggtcagagctctttcaatgatgccacgtatttcctacactacggtcattaagtgcttttaatataataaacattcctaagacccatccccaacctcaggaatcagaacctgtaggaatgagacctgggattccataattttaaacaagcattgcagttaagtcttatgatctgatacatctgagaaacactgccctatatcatcagttgtccaattttcatgctaaaaaataatcctaggcaaattagcattaaagcctccttcctttctgtctcctcttgtcactcagtcttaaggattagataaaggaatctggtttaaaa

SEQ ID NO: 117071 - DNA, 1112 bp, Homo sapiens
ttcttttcctagcacagtttcagcaagttggggaccacctttaggatccagcttagctaaggcagaagttcggtttcttttctcgtcagatcatttttcaagtgtagtattaacttatgcttgtttgtttgtttgctgttaataagttgatttctttttcctgttgtctatttatgatgtttactttttttagttttttttactagctgtggcgtaaaagggagtctgtaatcttgcctcactctgacatgtccaccgattcttttcaaatggtgttcacaggtgaaaattactgaagaaagcactctgtctttcacacatcctatgtgtaaatatcggtcctgttaatggcacagacctctgggaggcaggacgggaaaaactaggtgcaaatgaaaatggacgagtgataatttgagatggtcttcaacttttaagtttgagaatacattaggaggggatctgttcatatattataaagtgtatttttgctacattttaataaatatttccctctcatcctcttccccaccctccatttgtttaagggtgggtgaacataaatattgttttttatgggaaaatgtggcctacaccctggatactattctctgtttcttgcttctgtttttttttttttttttgagacacagtctcactctggcaccaggctggagtgcagtggcacgatctcggctcactgcaacctccacctcccggattcaagtgattctcctgtctcagcctcctgagtagctgggactacaggtgcgcaccaccatacccagctaatttttgtatttttagtagagacagggtttcaccatgttggccaggatggtctcaatctcttgacctcgtgatctgccctcctcggtctcccaaagtgctgagattacaggcgtgagccactgcgcccggccatttcttgcttctttctacagtacagcctgttgtgcaaatattcagagaatagattgtgttcaagcattctttattccctatgtgtatcacattaaacaggaatattcacataagtaactcataaataaaaatatgtaattttaaaactttatccccctaggactctggggaggcaatgtgaaatgaac

SEQ ID NO: 117072 - DNA, 1088 bp, Homo sapiens
taggcaaaatagtgttcggaagtaatttctttgtgcttggattgggtagaaatctttcagaagaaaagagttattttaaagtttttccttctttctggattccttttgttaccagtggagggtgtccaggttcttggcgtcttgaacaaagaactggagaagacgcacaaagaaagcgaggaaagaatgaagaagacatttattgaaaatgaaactaccctccacagtgtgggagctgcttgagcataggggctgaagggcccctacagaatttttgggaatttaaataccctctagaggattccattggttacttggtgtactccctatgtaaatgaagaggatgaagtaaagttacaaagtcattttctccgcctatgccatatggagaggacatttcttgtcatagctgaagtgggaatcagctttatgttcccagcctcctgaccctattttcctgcctcactttggttctgatcgccagtttctttcctcataccagtgtcttggggaacaccgctacatcagtaaactgtatccaatatggtgcagtatagaattgttctcatcacatcatttaaagttgattattacaggaaaggtgctgtggctcatgcctgtaattccagcactttgggaggctgaggcgggctaatctctctctcttttttttccctgagagggcgtttccctcttgttgcgcaggctggagtgcaatggcgccatctcggctcactgcagcctccgcctcctgtgttcaagcgattctcctccctgagcctcctgagtagctgggattacaggcacccgccaccacgcccagctaattttttgtatttttagtaaagatggggtttcaccatgttggctaggctggtctggaactcctggcttcgggtgatctgtcctccctggccttgcaaagtgctgggattataggggtgagccactgcaggactgattgagctcaggagttcaagaccagcctgggcaacagggcaaaactctgtctctacaaaaaatacaaaaattagccagcgctgtggcccgcgcatgtagttctagctacttgggaggctgaggcacaa

SEQ ID NO: 117073 - DNA, 1123 bp, Homo sapiens
tgtttatataaacgctctactaaattaaggctcttccctgcgcagtacaaggtttccctagtagtttggtttgcccaaaagaaagagaaaatttgccaaatggaccttttcagcagaagtaattttgggggcatctttttggaaatgtacccgttgccctgccttttttgctggctgtcatctgtttttatttcactcagatttaccatatagcattcagagttgttggaatgaaaacttatagacaactatagaaagtgcagttcaacttggaaaactcatttcaaaactctgttttataattttgtttagcatgaagaaagcagtgtcactgataaatgcaatagatacaggaagatttccacggttgctcactcggattcttcaaaaacttcacctgaaggtttgtatttgtgtgtttccatgccttgtaatcttccttctgatttaattgaaagtctgattatttggagaactttttgcaaagcatagtgttctccaatatgttcttagagacactggttctgtggaagatttggtaatgtttcatggtcagaagtttgagaaactctgtcttcaataaagttaaatgttttaaattatggaacttttcagagtattttatatgctagtgtttgtggtatgtattcgagggtgattatggcaggtaacattttccaaatgtgtttgaccttggatctgttttattatggtatatattttgggactaaagttctaaaaatatactttagggaaaaattctgatgtcttggttttatttttccgcttaaaaataattctgtggtattttctatcaactggtatttaatctttcacttaattttgtttctctttcacttttattttaaggatatggttgttttggacatgtggatgctttgtaattctctacctggcccaatccaagttaatttagttaatttctttatcaggttataaaaatttgattccatctcatatttatggagcacccactaactgctctgtgcagtgccatgtatcaccatccattgagaaccaagactcttactctgtcatcttgtttttcttggccaagagccagcctcaaaactgtgcctttcccctttgaagtgtctttcaa

SEQ ID NO: 117074 - DNA, 1003 bp, Homo sapiens
tttctggaatctctctttgatttcattgacttatttgtctatgccaatatcacactgccttaattattatagcttaatagtaagtgttaaaatcaggtattgtgaacccactgacttttttcttcttttttataattgttttggcaatcctagtttctttgccttttcatatgtttgaaaatcagcttttgtatttctgtaaaaaatcctgcttggggtattgattggggttgtgtttaatttgtaaataactttattgagaaatgactccttaataagtattgagtatatctatttatttaggtcttctttgatttcttttatcagtgtcttttgttttcagcttatcaatcctgcccttattttgttaggtttgtaccttaagtactttttctttctttttttttttgttgttgaactattggtagtatttttcaaattttgttttccaatggcttattgatagtatatggaaatacagtagacttttctatactgatctctatcctgtaacttggtaaattcactaattagttttagcagctttcttataggttttttgtgatttcctttgaaggcagtcacgttgtctgtgaataaagacagttttatttcttccttttcaatctgtagagcttttatttttcttgctttattttactgacaaggacttccaacgtgatgctgaataggagtggtaagtctgaatatccttgccttgttcccaattttagggtgaaagcattcaggctcttatcattaagtaggatgttagaaaatgcccctttattgttttcacttctctacttccctttttaaaaattctgtattcttactactctcaagtgtcttctatgtcattgcttcattttttatcattttaaagtctactttttcctatatcctctatagattttaagctttccatttgtttccctgcaattctttttttaagccattttcatttttaaaaaaaattcttggctttttaatagtagcctgt

SEQ ID NO: 117075 - DNA, 1066 bp, Homo sapiens
gctctgtggcccaggctggagtgtgcagtggcacgatatcggctcactgcaacctctgcctcctgggttcaagagattcttgtgtctcagcctcccgagtagttgggattacaggcacgcaccaccactcctggctaatttttttgtatttttagtagaggtggggtttcaccatgttggccaggctggtcttgaacccctgaacttaagtgatctgcccgccttggcctcccaaaatactaggattacaggtgtgagccaccacacctggcctgattttagtcattcttaatgcattcaaattgttgttttaaaaaaacgttttgtatagagattatatatttttatattcaaggaggttggtgtgatataggctatttcccaaccattactagactaagaactccaaaagtgattttttaaaaatgtgtcttattttatccaccccactccatttccattttagggtttccatgttactcattgtagaagttggagttcttacaattgtctttaaggaactacatgccctgttgtctcctcagcccacaacctacattgttgaccatctccttttaacatcctctatctggcttattgaatacctctaatctctttacttcaaaagttctgctggatgttcatagggctggcttggttcctttttccagctgattgtttaaatgtcacatttgtcagtgaatctttccctgatagtgccacctcctctgtggcattttattatcttatttttctccataatatttattttttttgtggcccactatatattttacttatttacttttttgtctgtctctaccaccagaatataagctcctcaatggcaataatttttgtctgtttgtttactgctgttattttcactacttttggtctttgggagatagtagagtgtcagtaaatatttgttgaatgaatgcatgtgcaatattccatccttacaaactgtgctatttttaagttcactttattcggtttccttatgaagagggatattttttttattgacagagaaaggacaataaaaggaggaggctatgaa

SEQ ID NO: 117076 - DNA, 1087 bp, Homo sapiens
ttgtccagctagagcctggaacaataaatatgatggtgacctgaattgtgtttttgtgtgtgtagtagtatagtatgcctgcatgtgtttaaatcccagcttttgagaaatacaatttatttattttttttgagacggtgtcttgctgtcgcccaggttggagtgcagtggcgcgatctcggctcactgcaggctccgccccctggggttcacgccattctcctgcctcagcctcccgagtagctgggactacaggcgcctgccaccttgtccggctaattttttgtatttttagtagagatggggtttcaccgtgttagccaggatggtctcgatcccctgaccttgtgatccacccccctcagcctcccaaagtgctgggattacaggcgtgagccaccgcgcccggcctacaattttttttataccacaggattttactttattattaatttcagaacaacttgaacgtgattattaaagatcaaagcattgctatgaaatactttttgttactgcggcatatagggaaatatatctttcagatatgataagagctttttatcatattttatactgtaatggattatcttttaaggtagaaaagggggagtgactttttcctcctaagtagataagactatctcatcttaagacaaaatagaattgagaatgaggtattagagaagatctgaggcaggagattacagtgactgaatgataatagaataatggaagaaatgttattatttataacaggaattgaaggatgggaatattattacttttttgttaaaactttcgctattcattctattatgcaggtttctggcttctttaagaagtatctagcccagattatatgactataaaattctgtggaattgacttgagtcttacatataatgtattagtttattacagtgtttcaaaagtatcattttatttcacacattttcactggaacgtaatatgaacttagtggttagagtcaagctattagagtatgtctggtggtttccctttatgtgcagtttcactttccatagtttcagttacccgcggtcaactgccgtttgaaataggt

SEQ ID NO: 117077 - DNA, 1114 bp, Homo sapiens
gcctccactgggagttttggaatgcatccccccacagtgggcagggggactactgtgtgctctgcagtttagtgtagtgtaacctcaggcaaattacttaatctttgattctcagtttctttatctgtaaaatataggtaatagtatctatctacacaatttttatgaagactaaatacctagtatatgtaaagtgtttagtccagtgcccagtattacagcgtgtgctcaataaatgctggctactaccatcatcatcaataaaacttttttgtttttggctaaaataaagaaatcaatccatttgttttaattcagagctctcactaaatttatttcctgatgaagttattacctcttcccttgttccttgcattccctctcccttttttcttgattatatttttcacatgtatccttactggaaattaggaggggaaaaagagcctgaaaagtcccttttgtttcttctgtgaactgagtaagttattcctttaggtgtaggatgatgatctggaactcactagcatagactggagctattccatgagtgaaaatacatacatacatgcacattccaagtagctatatacttcctttgttttatttttcgtgactacctaatgttaagtctgcgtagctaaaagcattttgtatgttggaagtgtactattttgaccacatacattggatatgctttaagcatcatgagttcagcaatgcttgtctttgggattctcaagtccttctagcttctttgttacatcttcaaagtatgcctatgtgtctgttatatttttaggcagtaggaataaaagagtaatgcttctagtaagacagccatgttaataagacattcagattattcaggaagatgtgaatatctagatgtgaaatctaactcatttgaaatatgagcttgagtacatttatgtttttctgtgtttgtattttgagattttggatagatgcatatatgcacattgattaatcttataacttgcagagctagagcaccattttcattaacaaatatgctgaggaagaagaggagaagcacacatacataaaagatatttctctttcatcttgtatgtagacttaagtgacttct

SEQ ID NO: 117078 - DNA, 1037 bp, Homo sapiens
tggcattgtacacattttgtgcctgtgtcttatatctcctaaacaatagacagacacataatgaggtatagagctaccatcacctaggcagaagcatgccatctccaagtgttatggtgtgccctagctgtaaaggaacagttaactactatacctcttttcctcaatgaactgctgcctggaattactgctctttctcttgtttaccttctccttgattttatgatttggtattctattctttgtactcttcatcttattccttatgttaatttttatgtgactcctgttattaaggaccacaaactacttttctttcaaatatttacaaatatgaaatgagaattcttcacaggttggaatattaagtaaaaaggaatgagggtatagagcatgttttaaaaaacaagtttattaaaggaaaggaaagcttttacaaaaagggagattaaaagttaccactgcttagtttatgatataaagtatcttaaagtacaaaactgtcatacttatgaagttggtgttggtttaaaacaggaagcattgggtacagttctcataaatgtgtattttatagggtagttatcctgaaaatatacatatattaaactactgggaggattagaatcactgtaaattgtgagggattattttggttgtatttacttttgagctgttgtactgaaaacttactgtaattcactgaagagtacggtttataaggagctccttatcttctttttcacttctaacatacaaatgaaaaatgcagcctgcagtgaagttttaattgctatcacactggataacactgtttgactgtggtctcctttcttagaacacttctgtctcgaggctttcctgttttgctattaattttatcacaaaaactaggtgattgtagctttcctgcagtattttgatatgtattctagttgtttttggttaattgtcttagtgtttgtctactgtgtttagcaaagtgagattattttcctgttccacagatacctcaaatcgagttttctgacttaaag

SEQ ID NO: 117079 - DNA, 1665 bp, Homo sapiens
atcatgatttggcttttgaaatttgtatatgatcatttgccaaaatgaaatatattaaaagctttctacattattgacttttttgttacattctgtcacttgtattaatttcttcatgagaaaaaagaataaaatagtccataagataattgaatggctctattaggttatgatgtaactagttctaggcccattgtagtcagctgaaaattctttatttctagagagtaatgtcatttgtaacaaatgttgataattttgactgacaccaacactttaactttgaatatcttaaaatacttaaattttgctattaatcttagtacatttttttccccagtaaatttcctgttaaagacaaacctgttttgttaatacagggattccaaattttatttgtgcatcttttgaggaaggatccttgtgtttcatttttttttcttttacagtaactgtggtaaaatcaccctgacagtagaatttttatttatcttaatgttaaattagattataatcagattgcagaaagtactttatgtagaagtaattatgattttgaatgaatttggggcttctaatactagttttctgacttagagctcttcattcttatttccaaaatatatgacaaattctgtttagtgtgagaaaatgggcaaaagttcttttttaaagtgtttactctgtgctacacatagtatcacttctttttgtggttaaaacctctcttccaggcatgatttcttattattcttattttattgataaatggagacacggaagcacagagaagttaaataatattcccatgttatacagatagtaaacagtagacctaggatttgaatccaggcaattttatttgagttccagtttatcagtaggatgctgtatcaccttgttaatttaataacttagcagttgaaattgtaatatgtgtatatgtttcaaggtgttgaaagctgttgtaaaatgtaaggttgttcataggattatcgttacatggactctagatttaatttttctttcccctttatttgactaagttgaaacaattttacatttttagtcaattagaaacaccatttattcttatgtagtaagtaaagtataaatgatgtcagttcaacagaggctgccttttattaacaaatattattgtaagggctacatgacatcaatgatgttgatgtgagcaaataactgcatcagttaaaaagaaaagatgtcctcagatctatttaggatagatttctcagagaaaaatatgtatgctattcaaatcatgaattcttgttatagaaatttaaatcttttcatcttaaaggtggtgttagtattgactgatttggaatgaccttcacattttttagctacttatgtgagttcgtctgcattttccttttttttttcattgaagtatcacgtatcatatctttattagaataaatcacactaaagcatactttctcacccttaattacacatacaaatgagataattcaactgataggacataattcaaatataaataaaatcattctctcacatatttaacattgttgagtggattttaaattgtatatatttaaggtatacggcatgctgttttgatataaatatacatagtaaaatgattgctactattaagaaaattaacccacc

SEQ ID NO: 117080 - DNA, 1048 bp, Homo sapiens
atttacttagtagctttcagctataggactcaaaagtctacaaatagcctcaaaacaccccattgaggcaagcatagagtaatcattattttttgttaaaagaggaagtgaatggtgttatttaattgtcagttttagaataagagaataaaacatcttttaaaaatatgctgctagttacagcatggtctttttttaaaatgagaaaccagaagtttttctccttcatgttaagggatggtccaattttcatccccattttcctttggttatttttgccacttttttactgattgtaattatgtgttgacctcatttgattctaaagtataagaaaatatgagaattataagcataaactttaagtagtttcattgacctattttaatttgtgaaatctttttttgctataaacagatgagtacaataatttataggtagctttgtgagtgggtattttgtttccagctatacagaagttgcataatagctacccactcaggtattttagattggcatggtagtaactgtttaataataagactgctactacataatagcatatttgtgcatcttttcgacactacacatgaatgacctttatgaataaaatagtgctacctaattctatatattttggctatatgtttcctaaaagtgataatctttggagatggacagatcttacataggttaagatacaggataagtttaaaaatacaaattaaaatggagtctaattaatagtcgttcctgaaaaaatataagcctttcccatgaggacattttctgtcaagaggtaagtgtgggtcaggctcatttggaggctgagggggcatctgatttcttcataatattatataaaatttgtgagtggctaagctacctcattgtttcttctgtggataagggcctgctgccttgaattctagtcagcctggatgggtggggctgatctaagctgagggtcttgatagctgcagagcacacagtaatcatcatacctgataacaccatattgaaatgatcaagacaataatgataatag

SEQ ID NO: 117081 - DNA, 1194 bp, Homo sapiens
catcctgtgtattctggtaagaaaaagagaggatagtatagatgattgctgctaatttttaaattgacaaagtgaggaatgtgactatattggtttaatgagtgcctaatttgaagaattctaacatagttgttttttcccctccatatgtgttgattgtgattctattgctttcagccaaattattttaattagatttagattcaggaatgactgcctcccacagtttctactcttgtaggctttacttacactgctttaaacaataggggtttacctttatattaggagcattaattatctattaattttcctcatttagaaccattaaatttaatatatcacatttattaatataagagaaaattatagaagtcaattatcttaacaaattgaggtcctacaatttttgagaagtgttaagtttattatatttaaaaaagtctagctgaggattactatttgtggtttcttttttcttcatgttaataataatgtagagagtgcttagactttgttactaaatagctgtgtgccctgagaccaaaacatttcacctccctggccttcctgcatttatgtacaaaataaagggttaagctgtcctactatccagttccaaaataactctgtattatatttttgacaaataatagagaataaggtgaaggaccagtggtggcactggtatgtagtaaaaacagtacagggtttgttatcacactgtcttgacacttaggaagttgctagaggatgtcaagcagattacttaactgattgaggctcaaattctgatctgaaaattggaacaatagtaggtgcctcacaaggtttttctggaaattaaatatgacagcaaatataaaagcatctattacagtacagtttcattcattgatatcttcatttccttgaagaggtctttccagattggggctggagaattaaaatgctcaggttcttacaacaccattatttgagctggaaaatatgccctttaagcaacattttcgttctacttcatatctatagaaagttgggggcctgaaggccttttgaattttgaatactttccatctcttttagtctaggtggtatcactttggccagtacaactcttagaatttttgtaggcattctttaatctaattccataaccccctcaagttagaagaagttctttataattctttt

SEQ ID NO: 117082 - DNA, 1029 bp, Homo sapiens
tctcccctctctccgtctcccctctcctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcctctctccccctcccccccctttctccctcaggctgaagtgcaatggcgtgatcatagctaacggcagccttgatctcttaggttcaagcgatcctctggcttaagcctctcaaagtgctgggattataggaatgggccgccatgcttggacagcaaaacttttaaaattttcattttaaattatgttttcttaagtgtttttacttaatccttagtgtgaaagtctcctattactgaaagactaattcattcctgtctttgtagttttgactttcattaatctaatggatttgaggatccacatctaaaactttaagaattaatgtacattatgtaatgtcatttgccttgcaaacagttgtttttttttttccccccctgaggtcagactaatttattgacagttttgttgtgcttgacaagtaacaggtgctaacatctttttcagtcttgtcacagggactagagggtctaggtcaccatgttcattaatgtagtccaggaaattttatttctcctgtggctaatcatttacatttgacatgaatctgtcatctgtgcctctagtctctctgcttccacctttgtcttctatagtgtgttgttctcataatagtcatacttttaaaatataattcagattatttctttgctctgtatattttacaggctttccttataactcaaagtgaaacccaaaggcctgtaagaacccacatgatctaaactcatgctgcctatttgatttcacctcttaccttgtttcccagcccctccactctgttatgaccatagaagttgcct

SEQ ID NO: 117083 - DNA, 1026 bp, Homo sapiens
gggaggggttgattgtattgggtggaccagaaataagctgggacatttggaatgggttttgagaaaggaaagaaagagacagctttctctctcatcttcatatgtttaaaatacatgtaaatgtaaatgctctttgcattaatatcttttcatcttcattgcttcaactgaagcttttattatctccatcctaagggactgcattattctcctaatttatcttcctgccttcagaatcttcctcttccaacctagtgtcatttttctaaaacaaagttctgatatgatactttcctgcttaaaatgtctaagtgaccccccccaccccactgcagaataatgtgactttgtaggatcagatctctgcctactctgttagtttcttttcatcccactttcccatagtcatcctaggaactttctgtattcaatttttcaaagattttcaagcatcattttcttctcctttgcatattttgtcccttctcttctcccttacctttgcgtctggaaaaatctatcaatcctttaaaacttatatgctaccttgtttgcccaaacctttctcagtactaagtggccatttcactttgaacatgctttcatttgtatatgtatctctcatcccacttcatactgagttttgtttccttattcatatttttccttttggaatttacacagcacatagtgggtgcttaataaacgtttattatctgaacaaataaacctgcatacttggctttaatattcttttactcagataatatgagcatgtaccttaacttaaaaagatagggttcagaatggtacacactatacttgagagttatttgggctcttttgtgttttctgcctgtaaaagaaataaatacttcattttcctaatgtttaggtatttagctgtatgatagataaagcaagttagagataaggaaagtaaggtgaaaatgagccaactgcttaaatgaatgatggagttgagatagaaaccacttcattttggattgtcttcttttattctca

SEQ ID NO: 117084 - DNA, 1386 bp, Homo sapiens
atgcttgctgagtttgcaaaaatgtaaaacgtacaatgtgtaacttttatcttcaggaagtttataacctaataaataagattcaatacacataaaacctttaatgtacgattaagtgataaagtattaagactataagtgttgtgggagttaaataattttaaaacagattttaggaataatctaatatctcattttattgacgaggaaacaaaagtctggactagctgtttaactcaaaaatctgcccagagttacactactggataatgtcagaaccagactaagaacgcaggtttcctgactttggcctggtactctttccattcgtaaatacccacgagcctgtgtggaatgggcttgattcaaagcatgtagaagaaatgagacattgaaggttatgggtaggtggtggggagaagagctgttccacaatggaaggaacaagaaggaagcttaaaagacctggcacagagcataaggaatggcctaatgagagtagaaggtatacaataggaattaatttcagttagtaacctgggcctggattgaagcagtccttgcaaaccaggtagtttttatgggataggcaccagaatgcttttatagatttcttgagcaggatgacttgataaaaattatatcagttttatcaactggaaggtcagtgtgatggtaaccatgaaagattgaagtaatattgaggcaggaaaaggtagtagtagtaggaatgaagtagaaaactcaaatctacaagacatttcttgggggaaaatgattggacgagatggcagttttctatagaaaataaaggtaagaagagtgtagcaagcagaatgctatttccatggacagaaataaaataacttggaaggagggctgggatgaattgaggttttttgttgttactcttgatattaaaaagattattactcagtattaaagcttactgtaaaatataggattttaggtttttgagagctttccatatctttggacagtcaatactgaaatttttgaatttagggttaattgattatatctgttgtatacacttagagacgcttgggttacctctgtacattttcagttatatgtataaaacatttttgaatggaataatacgtacattcaggtttatagaaaccttgatggatatgatttaatacaaattagcaatagtatatctaaatttgtaattgtcactgatccattgcttaggatatattttaaaatatgttcactaaattctgttttcagttaagttattcatttatcttttgtttaggtcctaggccactgaaatggagtacaagagaagtgggtattttttctaatttgatttttttcctgtattagtgttgggataatggatttgtatttcat

SEQ ID NO: 117085 - DNA, 1352 bp, Homo sapiens
aatacattaaatcttaattagtatactacctatagtagcatctggtgttactgaatttttaccatcttctgaaagcagtaatcattctttacctggaggaaaagattccagtaatctgttttattaggaaacttttctagccttcctttcagttacgggatttattgaaaactacctcatatacatatgcacatatacccatatatgcatatgtatatatacatgtgtgaatacatatatggctatagatctgtgtgtatgtacacatatagacacgtgtgtatgtttttgtgtgtatatgtttttatgtgtatctgtatgttcctttctaaatagcattctatttcataccttggaaaaatataaaattaaaaaatgaggtcaagatggcgccttttaagaaataagttgttataacagttcctttcagcttcacatcataagtgttaagaacacttgagtatttttaatgtaaacatattttagcatctatttgatttttactttattttcttgatactttcagatatatatttgctttacattattctcagggtttcttatttcccgaaaacactttgaatcatttccactgattctttttcctcccttgttagtttacatgtatcatttgtatgatagtgtctggaagtaaaagggcacttgagaaacaaagttgaataaaatttcatcatacttaattctgaaaattgttttctgaaattattagctcactgctgaaatatcttcagatcaaacgttcagaacatcagctcccaaggagcttcatatttagtttatggtggggtatgattgtgtatttcacaaaattcatgaaggaaatttgtacaaatttattatggattttaggccagcggaactgtttaaacttcctactctatttgttccattgagtagccttagagttgaaacagcagtttccatttttctcatgggtagatcaacccatatgcacatttatcattgatttctagcactggaaaagcatagacattggagacggtggtcgggcacggtggctcatgcttgtaatcccagcactttgggaggccaaggtgggcagatcacctgaggtcaggagttcaagaccagcctggctaacatggtgaaacccagtttccactaaaaatacaaaaaattaactgggtgtggtggtgcacgcctgtaatcccagctacttgggaggctgaggcaggagaattgcttgaatccgggaggcagagattgcagagagccaagatagtgccattgtactccagcttgggcaacaagagtgaaactccatctcaaaaaaagaaaaaaagaaaagaaaaaaattggagacagctgtt

SEQ ID NO: 117086 - DNA, 1017 bp, Homo sapiens
gcgtgtgcctgtagttccagctactcaggaggctgaggcaagagaatcgcttgatcccgggaggcggaggttgcagtgagctgagatcaggccactgcactccagcctgggcgacagagtgggagtccagctaaaaaaagaaatatatatatatatatatatatatatatatatatatgtatatataattcatataaatatagtactttatttaaaaataaatagcattttctcctcttctcatttgtttatacttttaatatgttctgtttacttgtaatcaatgtggagtcttcttttaaaaaaaaattaacattgctgttgtgaagaaaatttgcagatgaatattggaaaatatactgaatacctagaaggaaaataatgttttttgtccttcttaatatagaggtcaaaatagaaaagctatttctaaagttgccattcgtgggaaaggaaaggccttatcatttatagaatttgatatcagggaacagttgttctgaagtaaaacaatccagaccattaccacattgataattttctccaattagacagattagaggtttaatcctaaaagaaccccagtatccaatatttttgcctacatctttaacattaaggaaatcctgtttttaaatttatatttttaaccattacacaagatctttattattggaaaaaggacagacgcaaattaatcagaaaatttctcattgaggaagattgagtttttaaatgtatgttaacaaaaggtagaaaaactcatcacacttagcatgtatacagtacttatatggactagaaagtttgttcttgtgctttcagtagaagcataaaacaaatctgatgttgtcatagagatagtttcataataggttatgtttttgtacaagtcccatattttcactagaactattacaaacattacagtcatcagcagatgttacacatgtctagcatagaaatttctttttttgtttttgttgtttgtttgtttgagacggagtcttgctctgt

SEQ ID NO: 117087 - DNA, 1050 bp, Homo sapiens
tctttgtcaggtttgggtcataaggttatatgttaaattgttttggatacatagtcggagcccaggttattctaaccttgaaagtcagttatcaaagctgaagctttctatgatagacaattgggagataattttggttcttaagtagaagaaaccatattaaagtgtgttttttaagataataagacataacagtacatccaaaaattgtttgtaggtacctagggagcaaaatcaggcataaagtctcagataacaatctaggtactgagtttctcaaacacattctgtctcattcatgttcttcaggagtgaagactacgtgaattgagttttgggggatttaatcaggaagtaaaggaattctaagcccctagagaatgtcacagtagatgactgagaggtgatcatgtttatcttttccctgtaattctttcattccattttttttttctttggaagaggtgaacatcgtagataataaactttgggagtgttaggggatggaagggaacatgtctgtataggtcagagtttctgaggttggtagccttggactttttgtgagagaaagaagagtagagttataaggatccagggatacatatgcaacccaagcattgtataaacactggaaaaataatataactcacacgtctgttattccacattttcaaatgtacttaattactttgtaaatctaaatcatcaactgaaaaattatgtttctaaatttgtggcacctgtagttaatgctttcaaacaacaaataataacagcttatacctattaccctatgggaatctgtagagtgggtttaaaaaattattttaaagggaccatcttttaaatgaaaccctccctataaacttataaaattaatcagggaagaagggatggggagaaacaaaaaccaagcttgcagcacattcagcgttaatcactaggtgaggcttgctctctggtctgcttcttcatagttgtttggtgcctattgtcctacaatcacaaagaccttagattataattctccttaactgctccatagaa

SEQ ID NO: 117088 - DNA, 1060 bp, Homo sapiens
ccagccccttgccctctactatctccttaaaatccccagcccagaactcctctgggagatggatttgagggtctcctcccatctcctttctcagccaccctgtggttattaaattctttctgtgttacaaaccctgctatctcagtatattggtccgttactgtagatcaggcgtacaaatttgttggtcttgaatctaaacaccagtcccttaatcttattactgaggatactcttggctatgtagttactcatggttacattgctagttagttacagaaccctggtgagagcctgtgttttcaagatctcttagaaatgctgtgaagaaaaggtcttaggtttaggtcttagtagtaattatttggtttgactttggaaaagtgtagatacctgcatctcctcactgtgggctatgcacagatgaaatgtagcattattacgttttgaaaggtgcaggatagcttctgtttttcaacattatgctttagttgttctagccaccattctttatttaaatgagtaggaagccaagagcaaagtaaagatggatttttggagtcctttgcttattttcccacattttttcttaccagagaacacataacatagacaggtagataggaagggagggaggtagataggcaggcagttcaaccagaaaaaaatcaagcctgttttagcaggttgtgaaaagatgaactgaatctgtcaatgtccgcatcttctttagttaccaggagtggatgtgggtaagccttggtgcagcagataatactgataagtgtatatgttccaaatagagatgtggtcataggaggaaaaagaatgttaatgccatctgggatgttaagaagttagggaaggacacagagcataattgagatgaaattgtaacttcttactctcttcagtgatagtcaaatctaatttaagtctgttactctattctcatgaaaacattctcaagagttgaagaaaataaatagtaaggcagtctgtatggaccttaacaaaacttagttttgactattggaattaaattttaatattttaattt

SEQ ID NO: 117089 - DNA, 1291 bp, Homo sapiens
ggtgagagctaagtaacagcaaatctaacccaggattgtaacaggaaaatgaaatacctgaaatgcttaaatgacagcttttcaactgttcaagaaagcaactgattcaacttggaactcgaaatgtaacaagcaagcaacatgcctacaatttgcagccaaagggaattacagcttttataattctgaatcctgtaggaccaaaaacactcctaaaaagaattaagtattcattatcaatctgttctctgtttttgactatgttttgactgagagcttcttattagcagcccacactctctcttctcaattgtatcagtttgttaaagtaggtgtcagcacatttcacagatggaaaaaataagtggtaaaagtatatatataaaaggcacagatctgaaattatattatacaaatgattgatttttatgtccttttacaaacacctttacatttgaagaagttcactggtaagagatagacagactaggtgaaggttttccgtaaaatgaaaggtgtcagactctgaagagactgctcttatccaactcttttctaagtggcggcttagcagagctgtcaccctttttccctagctctcctgcggctgcatgtgagctcttccctgtgctccgccaccattatactttaagggatctcttcacaaaacagactctgagaaccttttaaaatcagtactctttacccttataagtgaaattatccaattggatgtttttagaacgagtactattttttcggaagttcctaactcgatctgtgtgtaaattatttacagatgaatgcagttgcagccaaatcaccttatttaaatgcatcattactggacacttcaatggtttctccatttgaacactgaattttactttacttcaaatatactggcacaagcagtctacatcattcatgatttacctgttttactgtattaaagtaataattttacccatcttcaaagccatatgcattacattattgctaccatgagaatttatgtaaacaatgggtaattgttcctgtccatgtgaccttgtgctaataattattctaaaattgaaatttttttcttttcattgctattcattacttttttgtttttaaacaggcagctttcgattgccagatttaagagtgtgttcgttagcaaagctgccctagttgattgacataggtgtccaatggctttctctgtctttccttgatagtatttctatgaggaatttcattgtattactctgatgctgctgagaatttccctgcctgcttttgt

SEQ ID NO: 117090 - DNA, 1027 bp, Homo sapiens
ttaaagagacaacagttaagaacttcatcgagctcttcaatagaagacatacactttaaaaaaaaatcaacttgttgatgcagcatgctgctactatgctagaattgctttaatcttggagaaaaacaaatttttggaactctaaatgtaaaagtttcaaagaaatttaggatcatccaaatcgttcgtctaaacaactgaagacattaaacagatacatatttgtaagtgacagaaacaattactgatgtatgtattatccagtggtactatgtcaaagcccagtctctccctcacaaacctggttctgtgctttgctggaatcattccctgggtgtttaccccatataaggagtatgagctggagattttcatcttgttgccagtagaaatagatttttatgtcttaagtagaattgatgttgttaaattgaatatgaactcctggggagcctacatattttttaattttcaaaaccaattgtaaaatgttgaagtatactgttagtccttctatggcacagagggtacttacttatgaggttctcagaacagaagctttaggtttgttgaataaaacttaatgggaatttaagctggtttctaactattaacagatgtaacatttagggaaacatttcaaaattacattaaaccagctaaaagtggtcaggatgacatataataaaatcatcaaagatttgagaattgcccaatttaagttcattcaaaactcttgccttttaacccattaatcatgaaaaactctgttcttaattgtcatgcagtccagtaaatatgtgcagtttttctgtcaccaatgccaagaacaatctgacaatttactgatagttttattatagtggctacaaataattctgaaaatggtattttaagaaatatcttgctgagaagcattgtttcttccaggaagtagcctttcatattggtctaaacagttcaaggcgatggcctcctactggaactctagggcattactattttcagaccttgttttttgtgcaac

SEQ ID NO: 117091 - DNA, 1420 bp, Homo sapiens
atcaaattggtcagtgcagcctgcagctggggacttctaaaaacatgttaccatgactagaaatttttatttcagtgcacttacttgacatctttctggttattattgaccaaaacacttgactcctgcctcttctttctttttatccattttgttgtccttattttgcatatttttgcatatgtacagatttctggcttcctcattcctatcaacaaccagaataacttttagtggtctaacttgtatcttcacttatcaacttaaactgttctttttgaaatgttaccagtgggttcagtgctcctgtctctgttctctgtctctggatctctcttcaacctttggttccactggccagccattcttaactgtttcggtttcagaaatattttttccctttagttttataataataattagctaatttttcttgagcacttactttgtatctttgactattctaagcactttacatgtcatatgatctttaacacaatccttagagatctaagtttgtattattttttccactttcagataaagaaggtaaggcacagagaggttaattactttgtttgaggccacactaataagtggtagaatcaggattcagacacaggcagtctgactaaagagctggtacttttcctctttagatgctatactattctgatgagtgtctcctctcatctttttctgtttggatctagttgtgtatattttcatttgccctacacttacctggttaggttaaaatttctacatccctcaaaactgctgaagtatcagttaaaaatatagttttcaacagaatagaagtttaatacatgttgtgaaccaatttcttcgtgttgccttttgaaattaaatttaaagagagcagtcattaatggctcaaagttagacctaagaggatttataggtgatgtgtatatgtgtttttgttttatccatcattcttcagtttcttaattaccaatactataccaagacaaatgcctgcatttcatcattaaccattaaaatatgattttcttagagttgaagattgaatttagggccagttttttcaagtacattaattatgtttaaatgtgtaagtctactcattataaaagtgaattattttgtaagtgttggttattaagtctgtgtattcccaagattttcagtctgaagtgagctgcagatacaatgcctaagcattttgtcctttgtattttgtaccagcaaaatgaaaatcattttttatagcctcattactcattcccaaaatgacctgaggtaccagttaggtccatttgcacaatatctggcaatatttctatgtcaaatatgttacaatctggtatttaaaatggccactgtaagtattatcaggcactattgttcctttttaaaaaacagtataaaattt

SEQ ID NO: 117092 - DNA, 1019 bp, Homo sapiens
cataacagacacagcactgtggtctcctgtgtgactgttaggtctgagcactgccccatattgctaatttctcacattgcttttcttaacattttttttctttaggagcttgatggagagatataccatttctgtcaggttttgcaaaatgtcttgagctccttgaaaaatagatgtcatgtaaatgcaaagtacggtcagttcttttagcctaagacattatttgatttttatagcaagtctattccatgtaaatgacatgcagtcatatagcttaccatgaatacgttcatgtcctaaaaatctcagatactgcctatattcagagtagctaacatttaattttgttttcatgtgttctttgaaaagagtagggaaaatgttttttatattattatggcttaatctctggatttggtcaccagtgaaatgaatttcatagcctcattctattacagacattttgtctgcttcgcaaaataacacaattttgcattattggtggtctgtgttcaagagacattacatctaaagagagctagaaattgcaatttaatactaagcaatgtgatgtgggaaaggaggccaactctccacatgctctttctgctagagcataatattctgcatattgacttttttttcactatccccaaaagtcaggatttttcattaagttctgataatactgttgaaattgaccttgattattcatgtaaagggcctctcagacaacctataggtatgagaatagctttcagaattgtaatcatatttaggttatatttaagcagtgatgttacacacttcccaaaaagtaatttattgggacatttacataactctgtgtacttaaatttatctacttattgcttatttaaaacattacatatgagagtttgtgttttccttactcaccattttccatacggctttattttcctcttagtttgaaaacttaaaaaaaattcaagttaacaagcatttattaaacatctgttgtattcaaggccctgggc

SEQ ID NO: 117093 - DNA, 1045 bp, Homo sapiens
tgaaatccatgcatagttttttcataatatgcatttttcatgagctttttgaagaaccctccttgtaatgtatcttaattccctattccattaaatctatgattttgaaccagccatatgtgacctgtaatcaaaaagtgatgtttgatagatgctgtcaccattctgtcatttttcctcatccaagatagaagatgtcttcgaaagctttgtatatgttccagtcctataaaacaattctacaaaacaatttcaagttcaaaattattattgagaacttttaaacaggatatttagaagtttgttttattaacttggcctaggtcacaaaactcattaatattaatgactagactacagaggcatgtagcctgtctaaacattaacagatacaaaacattaaaccaaattgtgaagcttcgttatgctatgagtcatttcaggcaaagaccaatatagcaagcaaaagctgaacagtccagttgaaatgtttctgatctaagcctttgacttctgtttgtagatgaactggagttttgaaactgacactcaaattttttattgacttcatatgaataaatgattcattaaaatataatacttggaactaaagtcatcattcaaaaaaggcatttattattaataaactacagaaaagagaaaatttgagggtacaatttactttttttaaagtatcttaaaattgcatttattttctcttagagaactttagatgatatcagtcattactaatgtcataaaatgtatgtaaatatgagctaagtgatgtattttatttacccaaagatatgatctaacagcctctgcaactgtcaccaacctttcctataaaacagcaatatattaaatgatagtgaagagggtctgaaatttcaaccttgagatgcacttacactgtattcagtacagcagatttatacttctacttatatatcaacaacaggtctttctaactggcaagtcttgtggtaaacatgagaaatatggatgcttattaggtcacttttggtaaatagaactaata

SEQ ID NO: 117094 - DNA, 1029 bp, Homo sapiens
gaatgagtgtggctgtgttccaataaacctttatttacaaaaactgaaagtaggtcagatttttcccaaaagctgacagcaggtcacacttggcctgcggactatcaatccctgagctacatttgcttgattttcttactgtatactcattcctctgttcagctgggcttggcttttccccatcactgcaccaaaatacttttgccaatatcagtaacattctcatcattgaattaaaatgaacacttaccagtccttgtctcatttggattcttgggagcagttgacattctaatcaatctgtccttaaaattttttctttctttagtgtccctgacctacctctagtttttaacccacctctcaaggcagtctcttaattattggtgtgccttaaggatttattattgatcttcttgacacatttgccttaagcagtactttgtgttactatagctctaatttctgtctgtttttctccctcctgagcactcttaagtattaatctgtagcccagattcctaatttaaatactgagtttgtacatctaatggcctgctggtattttctacatgcttatccaaagatacttggaaatacctgtcttaaactgaacttgaaattcccaacctctatttcatccccaagattacttccctcaacccccattctatctcaatgaatggccctacccatctttcacttgcccaaggcagatacttgtgcttcatctttgattcctaactcttcatctcacccatgtctttcattgaaagaatcagttttgtggatgtacctccaaaatagctcttaaatctgtatgtgttatagtctgttgcttctatgctagttcaagccaccatcatcacaaatttaaattactagtagactgctctgcttttccctttcatgttctcttttgctggtgggaatatcccccatcctgctttattcccaataatttatctttcaggtatcagattagatatcagttctactaggaatcctttattgactccagaatgtagg

SEQ ID NO: 117095 - DNA, 1001 bp, Homo sapiens
gcaccaaagcaagcagcaggtggataggagggggagaggaaatcaggcgaggttttgcagaggaggtaacacttcagaagagtcttaaagtatcagtaagacattgccagaaagaaaaataaaaattaatttcaaataaaatatatataagcatgtgaagcatgattgagaaatatcttcttttttttcttcttttttgagatggacttctgcttttgtcacccaggctgtagtgcaatggcactatctcaacttactgtaacctccacctcccaggttcaagcaattctcctgccccagcctcccaagtagttgggattacacctggctaatttttgtatttttagtagagacagggttttaccattttgccaggttggtctcaaattcctgacctcaggtgatccacccacctcagcctcccagagtgctgagattacaggcatgagccaccatgcccagccgtatcttcttaattgtcaaaggaaaatcaaagtgtgttagtagcattatcatatattatgtttttgtgtcatacatgatttttttattctaaattttaaaatctaaccttaattcagttatttaaattaagatacaagccttgctaaacagaatttttactgatacatgctacaacatggatacatctcaaaaatattatattaaatgaatgaaactggtcacaaaagaccacatatatgatcccatttaaaattgataggatttccagagtaagcaaatctgttagaacaaagtagattgctggttacctaggaccgggagaggagggagcagggggtaagacaggagagttggtggataataactaaaggacatagggtatctttttgggatgatgaaaatgttctaaaattaattgtggtgatagttgcacaactgtatgaacattctaaaaaccattgaattatgcactttaagtgggtgaactgtgtgggacatgaatatttccataaagctgttaccaaaaaatataagtt

SEQ ID NO: 117096 - DNA, 1123 bp, Homo sapiens
aatcatttagacaaaatccacttattctgatattttccatatccaatatttttttccttcaggggaaaaatgacttgatgtcaactgaactatactaaaagatctagctaaatgaaatcactggtgtatgcatgtatgccctaggatgtgcatgcatgcaattggaagcactgttgggagaacacaagagacaacatgaaaaaagacccagagagaagtatgtaaaaccctactggtacttccgtactgcctggacatgcagtgcattaagaggatattgagagatgagtccgtaggaatcatgggccagagtttggaagtcttgaatgctatgctaacaagtttagagtttttgctgcttacattcttaaataggtaatcattttgttaaactgtacttttcaaaaattaaaagttattcgattgatttaacactgggaaaatgccttttgttgtgtattccatgtatttgttgcagttgtccttttgtaacttttatcaaactttgatgtaagctcaggagtttccgtttgcccagtgcccttcttaaagaatggggacattcctgtgaggttttggaaactgctggactgcataatattttaatgaagtctttggaatcacagggcttgaggtagcaacagagatcagctgaaattcaggtgaaaatgataattatgtagtatattcactggactaactttttttatttgtttcatattagaattttaacctgaatgaaacctagctttttaacttggcaatggtattgcattgatgtttgtaaaatgctcacagtggctgtgaaaattttgttggtctaattggtgtaacagatacaaagagatttgattacattttttcagaccatttttgagaaattgaagactttaaccttgcattacctcttattattaagacagtgtgacaccccatccgctatatttatcaaaataccctcagcaaagcttttaaatatttctgtatagaatgagttactgaatggaagtaattgtgcaaactgattaggacataggttctatgtattatcttgatatacaggtgaaagtgctatagcgatctgaagttaccacagtaatgcaatggcaagaacaatgacatg

SEQ ID NO: 117097 - DNA, 1046 bp, Homo sapiens
gattacagcagtgtgatcagagcagttagcatattcttggcattttctcctcattaactttcacttcttcagagggaccttgagtaaaataaacacatttgagcagtcttaagcaaattgtttgaattgtttcctcagtatacagaatcaaccaaaagtaggttggattgagttgagttgggtttagtttaatatcatactttactacagcatcatacatacatatacaatattacctagcatctgtagcacccataaaggattctctaatgcatgtgaagtaaaaggaaagagagtgtttaagtcctgactttgaaactgttgtgttaattgtgaacttttgctgagtctatacattgaagaaggtaacactcagcatgttgagatcacaactgctagattagtgcttggaggcagtagctgtgctgatgtgaggcattaatggctgggtgagttcaatcagatatcctgcctccagtgtctttgtgtaatggtatttactagatttcaaacagactgctgagaaagatgaaatataatctcatgtattatctctgtcttgaaaaaattagataataaagttgttctcttactggcatatgttttattaaccttcgtagagtcaacttaaaggacagatgtctgtagaattgaaaccttttgctagagtgttattaagtgcatttttgagttctaggaatcatggggttgagtagagcaggtaagcattttttaaaaccactcagaggacaatcttatgtcatattctgaggttagctggagagaaaaaatgtgatgtaaattgtgtgcaactacattctttttgttgtttttcttccttacagagcctggagaaagttcttgtggaattcagtcacaaggagttgtttgatttctataacaaggtctgtatttttaaaataattttctaatatgtggagtttttttcataatattttgtttcattttatgaattcttatttttaaatgtcatattatggaactaagttctttaaacttcccttataaaagaccttatgtttcac

SEQ ID NO: 117098 - DNA, 1044 bp, Homo sapiens
taatattcatagttaccagtgctattttttcctttctatttgcatgtgtctgaataacacttgatatgagtttcgttcccttcactaacgtctttttttttttttgtctttgtaaatagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttaggattggttgaagtgtacattttttaattatatacattatagtatattttatgccatgaatgtatgtaaatgaatacatttacgtacattt

SEQ ID NO: 117099 - DNA, 1022 bp, Homo sapiens
aggacccaactaaactatgcttgaactctacccatggtaattgtgagatgataactctgttgttttaaacctctaactttgtagtaatttgttacgctgcaatagataactaaaacaacagccatgctcaattgtttacatatggtctgtagctgcttttgaacaacagcagggttgagtagttgcagcagagaccatatggcccacaaagcctaaaacctggccctttatagaaagaaaggatgcagaaccctgctttatactatgctctctaaaccggagcatccctagagaaataaagtagttggtagggaacacaaaaagtcgtaagatggacgttgtatatatttcaatagcatcacttctactttttgccagaagtagaagaaattacattttctatcctcttttgcagctactgcagccgtggaactaagtgttgctaatgaattgtgaatggaagtgatcattcatctccagttgtcttcctctttctgtgattgaaacccagatttggagctgagtcagctttgagcagacaagaatgctaatgcttaagaggtagggagcaacaagatggaaggaacctgggtccctgaatatacttatagaacacagctgtctccatgcccttgacagaaataaaatatcttgtttgagttattaaatttggggtcagtttaggctatacacagcacgtttgcctgtagcctaactaatatggtggcaacataattttattataattggccagtaatgtacaacatattttaaaatggagatttacattttatggcaaaatgcatataaatgttaaagaggaaatgggaaaccttaaaaaacagaacaaaacctttgtgcttgcagcctgcgaattcaggctaaattctcagtgttactgggaacctatattcacctccctccttcagtgtggttattttgagacaaatgttttgagaaaccataagggtatattgtaaatttcccccaaagtctttccataattctttttctactgttga

SEQ ID NO: 117100 - DNA, 1023 bp, Homo sapiens
caactaagactgtgcctttagatgtagagcccaatgtgagggatcagtttcttatgatagagtaatatttataacatctaacttttctaccttatggcagaatgccctgtgaatccttgaaactcaaggccttctttgtcagagttttggttcttactgcaaagtatgttctttccttatgtcatccaaacaaagtaactagagtagtaaaaagaaagtcagtgagtttggatgcattggctttctggacttgcaaattatccagtgcaggcatttctcacacagcaggcttggaggactctgggggtggccacctttgctagatatgctattaacctccttcatatggttgggtcagtgatcttgtaaagttctgcttggcaggctcataggtgttgataggtgccctaaactgatggaccagtagagggtggccaccatctgtgaggttatttcttcaggccctcaataagcacttacccaaatgcactgattttacagtgctgtggttctgtactggattccatgaagcacccttcccgtctctgattttccaggatcattttccttaagttaatgccattcctgtaaatgcatttctactctttgatcccttttctttagtttacactttcagttaaatctgtaagcaagataatctttgaaaattattttaattaatgtttatatttagctctatagtctgtgtaaggagatccagggttacaagagtctgcttgaaaaaatagagccacatcagatcaaattttctttccataggattgtattttttgaaatgttaaaaattctcctataattaaatatttaaaccttatttcatcatttttctaagcgtttttactttagggtttactaaaggaagccaaatcaatttcataaacttctctgtataggatttcaaatagaacatttttatggaaatagggtgaatatgttatagaggaagaaatgcttctgcctctctgcctacttccctattggccctctctctcgttctcccac

SEQ ID NO: 117101 - DNA, 1609 bp, Homo sapiens
caagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattc

SEQ ID NO: 117102 - DNA, 1075 bp, Homo sapiens
tattaccaagaactttgttctgacatttggaagaatgaggtttgatgaccactataccctctcctggctgggcttgcaaaaccaagtgaatacatgcgtcactccaagtgttgtaattatacaatccagtgcccttctgatttctttgctacctactgagctttgtgtttggggatggaaagtttcatgaaatagaaatttaaagtaacatggatttagactaataagaaattagccactctaggcttgttaagcatctggcaagttttttctccacaccagcagcaagcaccctagtgtggtctgccgctagttattactcaaattgtagcctagggaaagttgatgaaaagcctttccacttttcatctattttgctgatatccagaaggactcttgtgctacacagtgttgcccggcctggcaatagcttacccttgacccttctccttttctcccgttcaaactttacctattctaagttccaagccttcagtgtcagctgtctttattaacagactgagaaatctcattttaggtgagtatagttaatcatagatcctaccccctggttactcttacattttaacactctcccatgcttaaaatgtaatggatttgggattttaaagcaccctggttctcccaacacagaaggtaattttttggctcctatcaagtcatatgtaagtgattttatggacagagaaaattattcctgatgacagtaataaaggaagaaaaataggcctctcctcttttcctgactcttaaacttgggcttaattttctctgccatttcttcagtaatattaccgttaacaaaaacattttctgaggtgtctcaagcagaatttatcactggctctgtggtgcaatttggatgccaataaagagtaagaggctgtattagagatagacgtagttcctgtccaagaaatatcaaacaccagacagatggaacacaggtagacacaaaagcacaccaaaaggcctttatgaccaacattctctttgtgaaatgccaaaaccacacaccacagactttaaaaaaatatattagacaagtaaagac

SEQ ID NO: 117103 - DNA, 1034 bp, Homo sapiens
aagaaataagagctttcttttttaggttaaacaatactgagaacaaatagctattcttgtgcctcttattccttaccaaaagtaacaatactttaaagctgatttccaagaagtctatgaggtatgtaaggaaatcagccacatccagagcagccaagagagctgtgtagcatacacataaaatgtaaatgctgaccactgctatgaggacacaagaatatatcctgaatagaataaaaatcccctacttcagactttattttataataaagagttcttgtgagctctcagaaaacagacaaaatagtaaatatagagcagttcccatttaatcagaaatgccagagttgtagtatgcttctatcttttgggaaatctttaaagtgagatattatcacattattacatttagtccagaaaatatgcacattaaagacaagaataagatgtattacagaaacagaatttaaattagagattaagtgaataagctaaaatggatagcaaatgttgaatatattttaatcaatgtacaagctatttgtataagcagtttttagtttgggaaataatattccggtaagattcataagatctataaagatgattagtattgtccacatctcacaatcctaaatggaattttataaatcacagatgttatcaataattctctttatagttaattatttaatctttaaatttgcagtagcctacagcagtatttcctccgagggagatgagtagcaccttacatggcatgatttaggtggcagggatgtgatggccttcaagagtattgagtcatgtggtggaaatttatgcccttttcaatgctctttcagtcttctgcgttatcttcttgattatgtgaaaggaaaagtctcagtttggtgttttctcattaacaactccctaaacttgctactatctctttttgacaaagagagaatagggtttacactggggctttgtcttccaactggatctagctggaattaacattgttttgctttaagttaatttttgtttta

SEQ ID NO: 117104 - DNA, 1082 bp, Homo sapiens
tatcattgtgccagcttggatcaaagcacctgatacaatctgtatttaaccttgtggaatgatggagggagagcttacaaacgaattcacaggaaatggctagagtttctgctgtaactctcaacctagccattcttctcatattatcctatggtagcttatctgaacctcagaaatctatccttttctaatttgaatcattttagtcaacgcagcctcagaaacggaaaccatctattgaaataatacacaaaagggacagccgtaatagcgtgtagccgttgaagcctccattccaatgaaaagacagtgggaatagatccctttggaaaccactaactaatcccagaaagaggaatgcctgtgaagttgagttgaacctgaagactagacacactgtagaacctccataggaagggtgcagagtaactgagttacttgtgatagggacaagacttacccactaccagaaacctgccccatcggtcacaaatgggattcccagagtggacactttctgtgtttagtgctgccatgggaatatcaaagaaggacactggcctttcttgagcacctatgtgtcagacactgtgcaagatgctttcaccattatgtcactatcctcccaacaccgagaggtatctttatccccactgggtgcacaggaagaggttaagtgattccctgaggcccacccagcaagtatgagagataggatctggcccttcattttctaactacaagttcaatgggctttctgctgaacacaccccacaccaccaccaccaccaccaccaccaccaccactaagccgtgtcatttctagggccatctcctctcagtcttacagccagcttgggtgtcccacctccaggcctctgcgcaaagggaatgtgggtctctctggtgatgttttcctaactgtatttgtgatgaaaacagggcattccagttccctcttgcccagcacaaccacatcagattcgacggctcaagaggggtatgagtctaggggaggaatgctggactggaagcatctgcttgactcacctgacagcacagaccctttgggggcagtgtct

SEQ ID NO: 117105 - DNA, 1186 bp, Homo sapiens
ttacaaacctcatgctgctcagttttttctttccagtaaatcagatgcatggtttctctagatttacatatagaaaatcgagatgtggtgggtattagactaacacttcagtgataggaagaagagactgatttctcatatttgtgtaaaacattctcttacctaactaccatctggtccacattaatttcctctcatagccatagctttccattaccaatgagttttccatgtattcacagcatatgggccaggaaatctttctacagagaatgtgtcccttaggcatatatttcccctagattaccgtattaagaaatgttctccctaaaccatacttatggcattaccataaaattgcctcttgaacacagttaaattgaaagtgctcaaaatgcgtatcaattcaggtaaaagaaatcttgctacttggaggggaggtattttttattcttccccactttctctttctaactccctacaaagctatttctaattatttgcttatgctgggcactgaattttctcttaggctgaccatatattttattaaagtagtcttgaattcaggagtggaaaaaaaaaagttatgttttagacctcaatgtaagctgaaaggaaataaaggaacttctatatttccatttctcaggctgattttccttcccctgttctcttatctgtatcatgacatgagatgtgaacctcagaaatgtaaaaacaaaaagtctagaataaagcattccttgaattttaaatgaacatgcttttagcagctggatacgaagcagactattttcaacaaattgaatgtttcccacttgtgtgagagccaaacaagtgccatacagaaagggacctcttcaatgttaccaaagctttgtggcagcatttaagtgtggtggctccatagaagtcactatagcatggacgagccacttggcttgctttttcctgctaatcaaagttttaagaagataaaaagctatctttgttatatatgttttgtctaatttgcaatattacagtctcctggggggaaatccaacttccaataataattgtaaaaaaaaaaaaagaatgcactgtacttattcttttaatctgtctttctagaggccaatattttatttatcatgtgcatggtgatcatacttcaaggctggagcttttggagttgttgtga

SEQ ID NO: 117106 - DNA, 1045 bp, Homo sapiens
aaagcaatatacaacacttaggggatgtccattttagttctttttaccagagagtagatcaaggtccctaagttggagggtaacatagaatgccagggtggcttgcacagattcagggcccagaggcagctagtgaggatggcagagattgtgcatacaaagtgtgcttttgtttgaggaaataaaaagctaagcagtctgtatggaaatgactttatgtggctcggagctgattccctgaaggatttatgactctgtattaaatgccacagccttatcttttaaaacatgctactctaatgctgagttttcctctttttttcttttctttcttttttttttttgttactgattttagaaacagtattaagcaccttgttgttttgtttctgttttcaaggaatgcagattctactaagatctccttgcaaaatgaatgcatttaattttccctatgtgtttttcctctgcaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacaggtaatcatgccctagctgtgttgacctcatcaattcttcctggcttccttctcccagggggttctcttctaataaaccatatttgcaactgactgaaaattgcattcattgtgtgtagctaagaagcacttaacacttagttttcatcaacaaattaaaagtagtttataagcactattaagttaggttttaggggaagtaattagataaattatgacaatatcttctatttatataagcctggtatataaacactttttatgtgttatttataaatccttctagtaatcctagaaactagataatattgtcttctttttccacttaaggaaagtgagctcgacatattatact

SEQ ID NO: 117107 - DNA, 1041 bp, Homo sapiens
acagtttaaaagtggcttcaacagggtccatctcaaagtgattacagattacaaaaggcctgtcacatcctggaaattatttctgagggtttagggcaaaagaaaaggttgttgtttgtaattaagtctgattatttcatttagatggatacattggaaccattcggggatgaattcagcggaatggccagatgcccatatgatgccaaacatgccaacgttgcactgtttgcaggtaagcgacctgatttctcctcgttgcacttgcttttgcttgtttcatcctgtcactgtgaatctgctctagaggattcgtggagtcacagttgtgctttgattctctggtgaatactgtaattaagaatgcctttctgtttgaaattagtatgaaaattgtacttttgcaagtctttgcttcacttacccatgtgtttgtgccttcaggaaaggataacagcatagcgctgaacatgtgatggatcagttagggaatgtttgggctcaaataatagaaaatcccacctcaaaccaccaatgtaaaaaaaaaaaattaaatttaaaatcccctactgatgtgcctttattgtttaaggtaggatggactttgggattggctaggttcaacaactcaacagtgtcatccgggaggcagctccttttcattcccatgctctatgtcgacctcatgatgagactggtggttctcacagtcagaggatgactgccagccccaattagggctacatgtcttcctgtccacatatagaaaagaaagggaaagaaacaaaaggaagcctctggaagctctctcagagcaatgaggccacatacccccaagcttccaacaaacatcttctcaaatatcattgacctgattaggttacacacccatctctgaccaaaagactatggtgggtgaggggagggtgctaattgcttaggctgacctctactccccaacactactccttctttccactgcaaaagatataaagaaatagcaaacagaccatcattttcagatgtagtgggatttttgtg

SEQ ID NO: 117108 - DNA, 1032 bp, Homo sapiens
tttgaaccaggatggtctcgctctagagtccatgctgtcattccctgtactatgctgcatactgaggaatagagctggtactgtttgtcctgagaatacccttgtaatagctgttgcccaagaacatggtcattatgagtagccattataaagcatttccataagatgctcagtagtcacctctctgatagaataccagctccttcttagatgtcatttttattttcctaaacgtaatagggttggaaaatgacatactcaattatctaagggctgatcaaaacaaatgataaaacattgaatctgtgagaaataggttgacttaagaatctcttgtgaattgttcactttccagttgagtttccgggggaaaaaatggtataacagactgcccttgtactcgatgatttagcagggcgtggaccataggtcccagggctacatgagtgttaggagcaaggtactatgcagacttaaaagtgaccattagtctagctcattaaaaccaagacagttttattctaactcctcaccccaaggaaggaaaggaaaagaaggataaaaagaagaaacacactaatatttgaaactatcaaataagctcatctttactaaaggtcaagtttgtatcactgtagcattgacatgtttgttttcacaccatacgcagccacttcctctcaacagacaaccttagaaaaattcttaaaggagttccatgcccaccatatttaggacctcttctctccttttaattttacactttatttttacacttccaactttaattcactttaattttacacttctcaacattgctctgagagatctaggtttctaggcagcaagtaacacgatttaaagctaaatccctccccgcaccccaccccccggccaacccccgcccgcccaggttcaagccatggcaacacaattcagtggtgcttgctggagggggaagaggaagtcctaggattaagtcagtttatgttcaaataacttaattcaggaagaacagcatatgagacctgg

SEQ ID NO: 117109 - DNA, 1084 bp, Homo sapiens
ctcagccaaagagaagtgtaggaaaagagaaatatgctcattgactcaccaagtcagggaaaatttcagatcacctgactggctacactcagtttgaccctgtcctgtcaaagcccacatctctgtgaaattgttagccaattgcttaactcaagggtgaacttcccacagttcctagaatgccaaccaacctctcaggggctgccttcaatagtggattattccaactggacgcctgtggagactgtatttttcttctggctcctggacaagggctctcgcctccagaccacattgcatttgtggtgattgatgggaaggctgctttgaaatagttttgtcccgagacaagatctttggcagactgccccctcaggcttagctctacagaagatgaaaagaaaactgtggaagaaaagagcaccttcatgcaaagggttcactagcgagttgagccctgagaaagagagacaaatcaaaaattgtgacacttagaaatataaatccaggcttataattatctagaaatgaaagtgtaacttgatgaaccttaaggagcactcttctatcatatttcctaaaataacagactcatatggaaatggaaaatggtggcatggtctgacttaaacacgggtttcttttgtgacctgtctccctcccctccctaccctgtcaattcctggcttgatttgcttttcctttcttgccccatctcctcttttcacagatacaaaacagtatccggtgtttgtgggccacaagccaggacggaacaccacacagaggcacaggctggacatccagatgattatgatcatgaacggaaccctctacattgctgctaggtaaggggccttttccccatgtctgccttgagagtgtccaaaagcccaaggtcctaaatttaccagctatgcattatttttaagatcttgaggtttctaaatagagtgttatttaacttaaagcctcctttaacttatcaagcaatcattatttcaaaattgtctgtgtctgtttaaccctatgtggatttaaatagaaataatagcatatttgggcacttacactcaaataatcc

SEQ ID NO: 117110 - DNA, 1097 bp, Homo sapiens
atactaaaataactggttggaatataaaatatttggttaatccctattcacactaaacagactctttattcacactggccagattcttttttggtgtttgtgttttgttttcatgcatgaggttaataacacccttagagactgtctgaatgtccacccagtaccagcagagccttggcttattattatgccagtttcacaacttgaatccgttagttaatttaacatggtcagagaaaaactcatttgtctttttcatgtgtttcacagtcaaagtgacacagggtcaggcattatctgctggaaggggacggcgaaattaaagtcccagggtacagccattcacagcggtagaacggatgattatcaggctggatataattatagagccacagcagtcccccacaatacactggctatctgcctagcacaaaggtttagatccctaatttgttgcaggctagaatatctgtgaagtagccatgtatttttgtgtaccatcaatcacaacttaggcaactgctgctgtttgcattttggaagcttggcggctgttaagcttctgcctgcttttcagacaggaagataggatgcagggctgcagaaaggcttttagtggcagaatgatgacacctctgccagggtcctatcgcaagctcattagctgagtggatatttgagcgcctagtcagtttcaatacatacaaagtcatctgtttcattaagttaatttacctgagctggctctcctgacaatcaactgcttctgcagtatcagcttgatattgtaaaggcgaatgaggatggggctgggcaggaggcattggtcagcaaggtactggggtctgtgggattgtacttccctttaactgggcacttccagaaatccacattatatttgtaagcaagaaacctggctggaagtttactaaggcttgctatttacttttagtttcaatgaatgaaattgggaaatgagaagcaaatcgggtactatattaataatttaagaatatttttccaattgttaaggaagcgaagaaaggaaaaggaagcaaaagaaaagactgcacatttgttggttagttatttaaact

SEQ ID NO: 117111 - DNA, 1050 bp, Homo sapiens
taggtgtaatctgttttacaaaatcatttataggagcagtctctggagcagaagctccacacctgcagttataacatgacctatataatagctggacatttgttgaaagtgctgcctctttcaacatccccctcagctcagtcttagcctgtttttcaaggtgtgtcaggaccgcatggaattagtaggacatctattataaatggtgattctttgtgggtccccttgaaccttagctgataggataggacagttagcataactgtggtattaccttgatcacagtttctaatcattcaaactccaaagatcacatacttattaggaactcctgctgcttactcatacatgcttactgcaacctcctcatgccaccatgcattttgctcatcactgcagtttctatttatctccacccaaatcctttctgtcctcttcccctaaccagctgcaaacacaattttgtgttgtgcaggacttgcagttctgcatcccactttctacccagcttctctgtttctcccgcaggtcagtgaccttattagttggtctaactttggcctccccatctgggtaaaactctccccaccatcactccacttccttctccttccaggcttttgtgctgtgtgctcctctcactgagctagcagcagtccattgccaggctgccctccttccttccttcaggccatcctagtcactgctcccaacacaatgtttgtgtatttcctgcaaaaggatatgtatttgtattatgctaaatgcttttcttccccaggctgagaggcctgatttatgtatatgcaaggatgagttagcatcttttctgacatttcaaatgctacaaaacctaaaatttgaatttcttcaggtactcttttttgagttacttgtctggtcagatttctgtagtccttctagacagtccttctgcagaaaagtataaagtcttcatctgttcattcattcattcagtaataacgtgcccattcctgggctaagcagcgggtgtccagtgaaaaaagggacatgatccaaggactcaag

SEQ ID NO: 117112 - DNA, 1031 bp, Homo sapiens
aaaaaaactcaaaccaatgagcccatacagatggatcagaggcataatattcatgtgtaaagtatttggtccaagttttttttgtgtgttttgttttgttttgttttgttttgctttgtttttgagatggagtcttgctctgtagccaggctggagtgcagtggcgtgatctcagcttactgcaacctccgcctcccgggttcaagcgattcccctgcctcagcctcccaagtagctgagattacaggcatgcgccaccacacccagctaattttttgtattttagtagagacgaggtttcaccatgttggccaagatggtcttgatctcctgacctcatgatccgcccgcctcggcctcccaaagtgctgggattataggcatgagacaccgcacctggcctgttccaagtttttaggagcagatgaagctgttaaactttttgtttgtgccacctgtctatattaattctctgtattttccccatatgcttacttgcatacttatatggttattctctgtgtatttcctgtttcttttctctctttttttctaaatgtattgaaatttctgagaagatgaaaataccacctttatggctactcctaatggcaataagcgtagtcaccaacatttatttaatgttggctctttgttcaattaatctttgtggcaactgtaaaggcacaagttactttatctccatttgggggttaaatctgttgaaactctgaagaagaaaggaatttgtctctaggtcatgcaactggaaaccctggacttgaacccctagcactgatatatcctaggggttctagttcagattagactgatgctagaacccctgacctggtctccacagacccctcaacactgcttcacgtgcagagcaggaagcaccaggacatccttcctaagtggtgttaagaacttgatctgatgaagtatccatgtgtctttgagtaagtcatttaacttctctggaagaacagcttctttacaaagtaaggtcacatgcctcttagttcaca

SEQ ID NO: 117113 - DNA, 1036 bp, Homo sapiens
agagaattcttttttcctattttctactagggtgcatttaatctgtattagtaatgccacagagaacatttactgtcatataagcaaagaccttgcaaatgtattttaacagcagttcagaagactaaagaacttaacagagaagtagagaagagagagcctgcaaagtctactgtaaaagtaaaacgtgctagttttggcatcaatttaaccacattggagacttggtcaggagcactgaggcttgaccacattatccaaacacatctgcttgccttatcatattgtcccatttacttttctttttcttctgccagcacaaacttgtgtcagcatgtggaagtggtatttctgctacctaatctgtgttaaaacagccctgaagggtcatgcaactagtcggattgtaaacctttggagaagattaaacagtcatcatgtattaatcagtcttgaccacgttgtgaattaaaaggtgaaattcttggccttattctaaaagatgacaggtctagatgttagagataagcattgtttttatattagtcagtatttctatgtagccagttatgtttccagagtagtgagaattattctaagaagaaaaaagtattttcagtataaactaaacaagagaaaaatggaagtttaatacacatctgcagtgaacatgaacataggaaaacgtgaaaacgtgagcatagtgaagtttgaagtgggagagaaccttttctgaactgggttgctttgctcacaggccaggtaggagagagcaggggaggaggttttactggacccaagcgccttgtaagaattttccaaaaacattaagtaaaatttagttagttgtgaagtagaaagttagcacttctatgtcttcaaggaatccggttatagtcataacacagaaaaaccaatcatccctcccatagtagttgaaagataaaattgacatcttcttgaaagagaaaagctactattttatgagcttagaagaaaaaaaattcttcaactttatgatatgctatttgagctc

SEQ ID NO: 117114 - DNA, 1531 bp, Homo sapiens
gtgtagcttacatattgcaaggatctgagtataatataccttaattaacagtgctgatcatgttccttccttatttgcagaacactttacattcacgggtgttgactcaggggatcatttggctttttttttttttttttttttttttaagtatcagatacatagcagtttacatcattggattttatcccctggtttagatccaaagacattattggccagtcttaatgcttgcttgttagtaatactgttatgaaataaaagcttctgttgcagaagcttccttaatagataaaacaaaggcctttaaccagtacgttacttagagaatattaatgaaatagttaaaaaatgaggggaaaatgatgaatgctttaaaaatactggccttttcaccttaataatgtgtcagaaccacttattttctacaacacatgtctcaaatttgctggcatttcaaattcttaggagttaattttctatgtttgaatctttaaaaagaaacatacaaatgtaggatgaatacattcagagggtttagtgcatgctttggctagcaattcaataaagatgacttggaaggatcaaagcaaagatttccataaaattgaatatgagatatttcagcaacatcaatgctatacctcttcaggacacttgtatgcatgtccacagtactacctagcatttacttaatgccactagaacaaaaaagataaattttgttgaggctaatagatttttaaaaaattgttttaaagtccttttagagtaccaggaaaatctgactcaaaggcaaacagcaaacagaaatgacttaatggaaatcagacaataagcctaaggaaaaaaaatagggttggaacctaaaataaattcaatatataacacctttccattttgttccctttcctttttgtttttcatgagaatctatatggaaaagtcagttgattgcttatcaggctgaagcctgtgtttgctcagactagcgataatgagcaataaaaaggtggtaatggttaaagtgagaggagagggaatcagggaaaatgggtgggctcagtatagtttgcaggctctgagttttggaagccctgtaattctcccttgtgctgttatgttcattggaggggagttaagatcaggatctgtaatgagtgtgggggctttccaggcagtggtctgatggctgcacaaaagaactcccagtgattacctagttacatccctacagtcagcttggcaagtaatcttaaagccttgctcctgaaccagcagcatgagcatcacccaaaagcttattagaaatgtagatgctcaggcctgataccagagtgcctggatatgaatctgcattttaacaagatcttcaggtgattggcatacacattcatatttgagagacactgactgaaggaacacatggacacaagatgtgaggacacatacagtgtggggtgcagtagtagggttatcctaggaaaagaaggagcagactttttagctagtgagctaactcattataggc

SEQ ID NO: 117115 - DNA, 1049 bp, Homo sapiens
atccttgtgacaaacatctggcagatatgttttaaagtcctacgatagctgtcagaaagttgatggctcctgatacgttacattgtcagtccagacacactaattctttagtgggattattgatgttgttgtagcacatctgtgtttaattgcagacaggaagctgaaagagaaagcttgttgtgattacgacctctgagatacctattatatctgaacttaacaatcaggtcaaaacttagtggtgggtgggaatgaaaagatgtccgcaaatgaaactatgtgcatgggagaagagactgcatgtcactgacctgcagagaagccagtgcctgggttcaaatccatcactctctagctgtgtgacatcaggcaagctccttaacctccttgggcctcagtttcctcctttgtaagatggagtagtaatagcatctgccttatagggttgctgtgaggattaaattagtccatatgtatacattcccttgagttcccattacatcataagcactagataagtgtttcctatttttatatttccccccaaatcttctgctttgtaaaggtaaatcttctgctgatagaggatgagctgcaaagagaatgtgtgtgtgtgtgtgtgtgtgtgtgtgtgtgtgtatgctaagactatcatgcagaattgattctacacttgtaacacgggcatatttggctgttattgcctacgttatccattttgacacctcccctactctcaaagcccctgcatgtcactcgcttcctctgcttttccccttcagattatttcacccatgttctatttggtcatgacctgtatgtgtacctcatctaagtgatgctttatgaattccataaagccactcatctttgaggtctccaagaacagagactattccctaatgatccttttgtgcagtgttagttgttaaatgtgctaacggatgccagcgtttgaaaatggtgctgatccatgacctcttctgacaatgttagattcctatccttcagagtgagaattttaggcatgaggctgcttgaggtac

SEQ ID NO: 117116 - DNA, 1032 bp, Homo sapiens
cagaatgatgtctggtacataaacactcaataaaaattagctattaatatttgacaccaaaccctcctaatataatgagctaaattcaatgtttttgtcaccagcaggatatgggttcttgacaagtaaaactaaaaagatgatgaggagatgatagtgtccagatgaatctttctgccagtttctgtctctttatgttcttttgtgtgtcagagcatggtttaaaataactaagtaagtaatcattatttcattttatgtaggaaatatagtacatgcctactatgtgcagagtgctaaattagatcttattggatatttctaaaatattaaataaggcattaggagttaggtgactatgttttgctacagttgttatttgcctttgttgggtccagtgcccagttaggagcctatgtttatcaggcccatggtgccttgagctatagccttcctgtcttctgttctcagaggaagaaactccgaggtcataatatcaagtatttcctcactgggtgagttttctgaatgcagtgtttagattgtaggtaatgtagattgtgtatttggaaacacaatactcagggattttcactaacaaagagggcccaaagatctctgtcaattaattagattttttaaaaatatgtatttatcttttagagactggtctcctgttgcccaagctgaagtgtagtagcatggcatgatcatagcttactgcagcctcgagctcctgggctcaagtgatcctcctgagtagctgggattacaggtgcacaccgagcctggataatttttacaattttttttttttgagggggggtcttgccatgttgctcaggctactccagaactcctggcttcaaatggtcctcctgcctcagcctcccaagtagctaggattacaggcatgagccactgcacctggctctgttaacttaatgtctgactcaaaaccaatgtatagatacaaacaagtttattttatataataaaactttgttatatgtggcattaactactcgtacc

SEQ ID NO: 117117 - DNA, 1640 bp, Homo sapiens
taagaaaagtaaaaagtactttttgtgtagatgtcagtcaaatacaatgtggactttaattaaccttaattaatgatttctgattacagattttcttttgtgtgccttggaggctgtatttaggtagagtattttcagccagtagtgacatgaacttgcttcctttgtcttgccatgcaaaccacactagattctcattacaaggaaaaatgtgattctgcatcatttcagaatggtcatacaaagaatgaaatatcacttggggaacaactgaaatttgtaagtggtgtggagtatttgaatcttcagaggaaccattcctaattttaaaggaatttacctatcaaaattgctgatatttactggcttctggctggattcgaggccattccttccaaagattgaatgggattttgagtggtgccccagttctttcaaataaaagcatactgcagaagtgctggacctagcagcatttcctttgcccaagtgtaccctttataaagtactaaacatagcaactagggaatattgtagacactgtagagaattgggcctttgtttttcatgaagggaatttattaacaaaatattttgaggagtcttgtcttgttcacagatggcgaccacggcgaccccccttcctgcgggtgctgtcagagaggatgggggggacgtcctctatccaccccatcttcatacccgagggggcaagggctcgagggccgactgggccccaggtccaggagtctttgtcctatttcctcctgtggcccggtgtttgatgtgtaaggcagtaatacccagttccttgcacctctgagccatatcctgggcagccaacatagcagcatatggcaaagattcatctcggtctgccttcaccttcatcccaccagtcacacggcagagggtttctttgccagaaagatcagtgacatggacaaaagtgtcattgaagggtgcaacgatatggcggacaccaaatatgttttctccgtcagccacctgaggtcagaggctgatgacctgttcttccttttccttcccctttcgaggtgccatttctgcacgttgtctccagactccacaccggaaagagtgggccttatttttgattaaaagtactttttcctgtgtcatgagttttagaacaaatatcaaaaacctgaattaggatgttaatgtgctatttacattcaacttttaactagagggtctgataaaggttagatatgatatattaatgccaatttatgaattatatttctctgtgaacaattattttgtagcttatacaaaaccctaatagcatataacccatctagtttagtgtaattatgcttatgaattataaatgcttagcttttacaattagacttactgatctgtaggcaccttaatgagaaattactgaaattaaattgattcgtaatatttgatgtactgtgttccagggtagtggttgtctaaaataatttttagagtatgtgtctgactgcatagcagtatggctttatttttaatagaaaaaagtcctccctgttgcatgatcccacctttgtccaaggaggagatgtcaaaagttagaaagagcagagtagattcacatgtagccaagagaaaaggtaacacatctt

SEQ ID NO: 117118 - DNA, 1051 bp, Homo sapiens
tctggcattaaatacaatgaaaacatgccattggaaaataaacattgttagagactacgaagaaataaagattgtattaattatgttttaatgttctatgagggttttacagacaagctgtgatagatccattcttctttccctgttcctattcctgattcgttttttaaagaaaagtattcagtcttttcattaatattgcagcgacttcagcacttccccgcccctcccccagactcctactgtccttgaatgaggaaactgagagaatactgattgagctggtgaatggaaacgttcctttcctgaaaatggaatgctttacaaaaaattgcattccacaaaaaaacactcaaaacaattcaacaactgtccctcctcctttctacccagagagccacttgatttcattcacatattttggtttttcaatgtatttgttcttaggcctaaaatacccaggtggaaaaccattctattaagcctttcactattttaaaaacatgagcatctgagtttctaagaacattctcattcctgcatagtgagcgataaatagaaaccaaattgtttgtagcattctaaactcaagtatattggcagaatggcagtggagttgatttttataagaatacttgttaatggttttcgagacggattctgtgctaattcttcttgtatcatgaatgatggccctagctagacactgtcgctgggatcttcatctgttaatcatggaggctgctttcttattcggttgccatagtttcagtgcctcacatagtgttggggtgtcttgggaaaggtttgagatatactagggcttgcaagccttgcagttattttgacagttgtgctctgaaagactgaaaaccgcttctcgtataattcagtgttggattaaaagaggcaacttctgagagtgtctccctggaccttgttatgtgcacatccagctggtatttaatccaggatttgcctcttgctcagtcttgctggcaaaaaaaataaataaataaaaatacagtacagaggctgatgtcactttcat

SEQ ID NO: 117119 - DNA, 1052 bp, Homo sapiens
caaagtgctagtatgatgataatgttatggttttgagaagaataaatgtgctaacatctgtaaaatgcatgtcacaatgccgggcacacaacaagcagtcattcaacataaggtattatttttacttgagtaacagtagttacgaaaaatgtcctaggaatggattttgaaaaagcagatagtacttttattctggggggcaggggaaatagtagaaaaggaaatggctacgaatctgtaatataaagagatgatgcaaaagaaaacaacctttggactagaaacaaacattcataccataaacaggccataatgtcatgggttttaagttgagaagcatgtgaatacatcacttgcagggaaacaggaaacagggaaactttggaatttgaaatatcacacccaaaacatggaaggaaaaaaccactatatataaaaaataataataataacaagcagagccttatatcaaataggagcccaagggatagtttttgaaaaatgatagctatcacttattaacattttaataataaaatgtacactctgcacctacatttagaatctgaaagcaactcataatgacaattttagggatgagttgaattcccaaggaccacacctgtcttaggagagaaactcggctgctgattggaacccttgaggaggttgtggctaggacttctgcaagagggtcttcaggttgggcatgcatctgccaggtcactcttccctggccaagcttgaaatcaatttgggagcaaaagcaaactactgccttccacaccaaaggtaggaaataattggctgaccccagtagagatagcagttattctgctgacagacacactactacaaaacctgaaatttgattcaaatgatagtcatacaagttcttatcagtgagaaaaatctgacttctaaaaggcacagcagaaggggaaataaattgatgttatcaccacaattccctgctaccattatgttttccaggaatgcctccatggcttagagttacagttattttcaactaggaaataaaatgttctcaa

SEQ ID NO: 117120 - DNA, 1802 bp, Homo sapiens
gggagcagccgttcgggtgacgcggcgcccccgccatgggtcctgtcccccgccgcagctcccaacccgagcggcaaggatatagcccgtcgcggctgcgtccctcctgaagcaccgagccctttgcaccgggctggcgcacggtacgccctcctcccagatcagcgcggtctcgctctggaaagatgacccaggagggggaagggtgagagacctggcagaagatggccctgggtttgaaacccagactagggctctgttccgactcctcactgtgtcctagggcgctaccatgggggcaatggggcgctggagagtaagccgggcagtgcccacccaccctgcctgatccttctggggcgggaagtgtctcttgtcccgattctccgcgttttgctcagctcctcgctgtgggagatggtgcaaaacaggatcctgaggtctcctccctcctcgcaagacccgagcggcacggggggagccagggagcggtcccgggcttgtggacgtcgggaaaggaaacagaattccgctgtttttcccgctccctcgccgcccctccgcccagcgcctcctcccactttacagcggcggggtcactagaccaggcgctcctggaaagtttccctgaaagccaggggcggcaggcacgaccggactggggctcagcatgtgcagtctgagggaagccggacctggagggaatcatgcggacagctcgggatgcagctaggagctagatcccggccctttggagagtggaacctcctggcccgcggtacttgctcgacaagtcggggaagggatgaatggggaagcaggaccccggaggcaggtgcggccactgtggacagaggctgtggggaaggtgcgtgtggacacaggccggggctcagtggcttgcaagtaggcagcttcaggtgcagaatcccgagccatctgctccctgcgcacgatttcccagcgtggctatccagggagggaggaagcagagccaggtgtgcgtggagcgggagaggaatgggagactggaggcgctgtcttcacagccggggcaagcacttccagggagtctccggcctgtatcgcactggggagccctgcaggctttttcgcgtcggtctttgggagaaaggtggctgctttggaactgcggtggccaggcacagccacagtgggatcgctcctttttttacgctcagcttttttacgctactgaatgcgatctgtgaaaggtttaaaacacaggcgtgcatggacacacacacgcacacactcgcccttgtacgcacaactttctttacctcagatctgaaaagccgtttaacccacttgcagtgttgtgccagcaggtctcagaaaagctatttaatgccccccagcgctggtttttaagtcttgccaggatgggaaggtcgagtgcctttgccttgtctttctttagtcctgaaattgttcgtcgtccttcccctggtggacacatcttgggcatcaagtctgtggtatgctacagtgatggcggggaggactggtggtttaattaattatttaattatgttttctccccaaagtaaagatgcctatgtttaattctgactaaaaatactctacacttttttataccgtacccaaatggctaccagcggtcaagattgcaagaattttgtatgactttttaatgctgtgtttagtctacatggagcagttttatgatttacagtaagctttgattaaactactccaggcaccaaagttaattattaacctaaccttaaatacagtggcagaactatgtctccacc

SEQ ID NO: 117121 - DNA, 1042 bp, Homo sapiens
cccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaaggtacgccccgggcgcccgggcgcgccccacctcccgggcagctggactccagcctgagggtcccggggccgtggctagcgcgtgctgtcggctttgtggtgcctgcgttttattttgtcttgtgtctctgtttcccgagccttgcccggtcctgggggagcagccgtgagccctgcctgcctttcctctctgccctgcgccccagagtgcgtccggctccacgtcgagagctttcccacccgcgttgcgcacacgcccggcgccgccccgggccgcgacggcgcgtatggctgttcctcctgggggtgtgtgtgcgagacccaaggctcatcctcccgcgtgcccagcagggagcagagcgggccctaaatggtgggattctcggaagctccctggcccggtgtgtcgaaggcaggggaaggggttctgccctcgagggctggagggggttgggtataacagcgctgttttcgtccagtgccaggtgggagaaggggttccgcggagacggtgtggaagcggagagaatcttttgttgtcagtgtggggtctgggctgggctccgtggagtgcaagaaacttgtaatggctctaggcacccgcgcgccctgtctctcggtgagatcctggctcct

SEQ ID NO: 117122 - DNA, 1061 bp, Homo sapiens
gtccttgtagccatcctgacaagaatgcagacatactgcttgatacttaatgttccagcataaacgtatccacattcttgttgaaggtggagatgaaagcatgtatttaacagctctgatcaataagacatttgccaaaatgagcagattgattttatttacacctgcagcaatgggttctctgcacttctcctcctttgactgcatattgttcagggcattgacagtgacaagatgccaaggatcaatgcgaacagaagccacatttagcaatggtcggcagcatgtggagatttagctacttgtaattaaaagagttgaaagagaaacagttgaatttttgcagccaactctttaaactcattaaagagcatttcttaccaggtggaaggtttacatgttaaccatgatgttctggaaagaaaccattaaattgattctctaaaggaaaaggaggctgaaacagaagccgacttcatctgtggaggtgacactgcaacaagcttatttgttccattgtcagtgagttctggatcagaaattctagtcccagcttctgacaatctgggtaactttgacaagtcatttctccccgtgacagctaagcatgcttctaggactttgatggtgaaatcaatctgtaagttctttatgctttttttttttttttgaattggtttttactatactctgcagttcgcaaataatggccccaactccagtactggatttttctcttcttaccttgttattcttaaaaaatctataatttttgtccacagtgactgttttccctaacagcacatacagtttaatccttggtaaatgtagccctcaaaaatcctggatttcagtctgaatgtgccgggtctctctcctggtcctatcatccctgagtggtacttaggccagaaatgccagacaggctccatgtcaactgtgaaaaaaaggcccttgggttgggatttgcaaacctagctatgcctgggctcattgaaaagaatgatgtgattgattagcagtatctgccatggctgccccagagaaggaggagtggcaca

SEQ ID NO: 117123 - DNA, 1045 bp, Homo sapiens
attcactggctcactgaaaagcaggatttcctactgtacttgtttttaaaaatgtgcctctaatacatgttttcaaacccaaatttaaaatatgatttgttgttgtgataggttagaagttcttacttgtaaaatagaagaaaattgttgtagtggattggaacggtgttgtgtccattaatgtttataaataattaggtgtagaccaataatataagattcctacatcagtttgcagtcctgactttacagtttgaaataagtagcaaaagaaaattatgataatcaagtaatttattattttgtaaaatagtataaaggaataaggaaattttaagtattgtttaggggccaaatttgaactcagctaatatgatttaagcgctctattaattgccctgatttttaaagaggtgcatgtaattttgaaatagcacacattttcatttgtaatcactctggataaatttgtatttttcagtgttcattgaacaggcttattgactctggtaaacttattttattgatgttttcatatggaaaataataagtggaatatgatacaattgttattttcagaacatatttctttagggctatttaatataacctttttaacgagcaaaaactttccatttgagagaaaaaattcttcctgctctgtgggaaaatatttgctgagattttgtatagaataagagacatgtatgtaacatatatgtatattcagcacaagtctactgcaattatgtacacattttggcaggaagaggggattttgtttagtctttgtttatgagttctagagtttcctgtatctagtgttaagttgtaaggaaaaactaaacatgccatttaaaggtaaacttggtaactatttatagagcatacaccaatgattatttctcacagttttcatgatcatttgtttattatttacttggattagactcattaaaaggtataatgctggtcacaattagaatgctaatatttggggaaactatgcagaaaatattttaaaatattaaaagagtgctggctt

SEQ ID NO: 117124 - DNA, 1041 bp, Homo sapiens
gaagcattatcttatttaaatactattatttggttactgaattacctagttcttactaggaatgactaagtttttattaaatactttttgtcattcattattacagttatatggtttattcttcagttttttgatgtaattaattatgaagacacctttcttaatattggtccattcttatattcctggaatggactcaactgagtaaactattaaacatttttgatatattgctgaaaattatattttatttagtggcattgaattatgtgtatttttggtccactgtcatgtttggttattaaaataatgttaacttccaaagtaaattggagagattttaatatttttctatgacctggaatagtttaaataatactagaattccttgcaccttagaaattagatggaactcattggtgaaatcacttggttctgttctctttaaaaatggtagcttttaaattcttctttcaaactcttctaaggaaattattcaagctttctacttctatttagatcagtttttaataacttttatatttctctagggaattatctcttttctctaagttagcagattggttgccatatacttatatacagtcttaaataattattttaattactcaggaatgcatttttttcttgtttttaatcatacacacacagacatagacacacacacatacacaaacgttttttacacaaacagattcaaaaggggtttctctattttatagaacttttaaaatataagcttttaggttgtttatattggctattatagtttatttttatttcattacgttgaacttttttctcgaccaattttatatttcatctttttgggcttattttcttctattattcttctgattttataagatttttactaagagtacttctgtagactgaattgtgttccctgtccctcccccgaccccatgcatatattggagccctaacttccaatataatggtatttggagatgggacctttgggaggtgattagattatgaaggcagagccctcatgat

SEQ ID NO: 117125 - DNA, 1094 bp, Homo sapiens
caaacactgtttattgacttaactaataatattagatgtgagaggaaggagtggtattagaaagctaaatcctcatttgttatgagaggcagtacttaagggctgtggagctagactgcctgagttcaaattcttaatagttctataaactctgaaactttgagcaagttaattaacatctctgtgtttcagtttcctcattagtaaaatggatatgacaaaagatatatttctctctctctttgtattgtacttagaattgtgtgccttaatattagctgttatgatgatgataattggtagtttttggataatatctaaaatcgataaatcaagaaatagaaaaacaacatatattgtatggttatatggagataactaccagaagaaatagccaaaagagttaaagtgattgcctccaggatgtggtactggggagtacatctgggaacaactgtggcattttaaatcttatggcactatttaatttgacatatatacatgtattactttgataaaggtttagaaactgattaagtttgtgtcacagtctcatggtgatggtaaagagagaagaacattgtattaaacattggaaaatgtcctaaaaccacctaaggcggagtaactaatcacttggctctatgggattcaaggtagaattctcgtggcaacaagaaagatggtttccagtgatggaagctaggacattgaagaaaccactgacgacagtcaacttaatggctttttcagaaatggccaccagatttctccactctaaagttattatttttgttctctttccatactctatattctttggaagcaaggccataaatccagcccacactcaagtgggaggaagagattaagttccaccttcaggaggggggagtatttacatttattatttggaattcttttgtaaggaagatttgtttcttctcccccatttatttattaagtcatttatttatatcattctggactctaatttgtactttgggttataacccagtactgtgttatttattttcttgctcagattgttcaattttagccattgggagctctttaagattggcttctgtgtc

SEQ ID NO: 117126 - DNA, 1051 bp, Homo sapiens
cgcgcccctgtaatcccagctacttgggaggctgaggcaggagaattgcttgtacccgggatgtggaggttgcagtgagccgagatcatgccactgcactccagcctgggtgacagagcaagactatgtctcagaaaaaaaaaaatcacaacagtatattttttctaagtctatccttcctccactcctaaagccagttataagagaatctagtaaggaaaacaattttgcagggtatgggaatattattgttatttgtacttgaagcagtcagacatggaagatgttatctacttctgttttggagatgaaaatgtattataatgttaatcatgtaaagctatttctacttttattggttatgttggatatatagtttcagaaatctgacaatgactttatcttacagatcacgttagtttctttaaaatgacagcagagggcactatggtatttagttttccaaagccagttttaaaattggaaaattgttgccatttttatgtgtaatgcagtgtatctattcaactagttgaatgaatagctatgaaactttttgttctttgctttttcgctatgttaggagtataaaaattttgttgagtattggtaaagttgaggtgcactatttttctgggttccacatttgcttttgtttagtactctttaaaaagagtacttgtaaatctgttcactaatctttaaagtttacttatttgaatcaccttgattaaaatcagtactgtgagaaaaaagctttcagtgaatattatataagaaatttaattaaagctttgaaagatttttttgtaggtcctagcatctctagtcatatgtcagatataattttattagcccacaggctgtcagagatagtatgcccagagtgatacacattacctttgtattacagcatttgtttaggaagcaagtcagtcttagtctgacaggaagcccatgtatttatttctacatccttaatgagaaaagaagaaaaagcttatttcacagaatttccttggggaaatgatttgaaggtttcatttatatt

SEQ ID NO: 117127 - DNA, 1981 bp, Homo sapiens
tttgccagtctgtgtcttttaattggggcatttaacccatttacattgaaggttaacgttgttacgtatgaatatgatcctgtcattatgatgttagctggttattttgccccttagttgatgcagtttcttcatagcgtcgatggtcttcacaatttggtatgtttttgcagtggctggtacttgtttttcctttccgtatttagtgcttccttgaggagctcttgtaaggcaggcctggtggtgacaaaatctctcagcatttgcttatctgtaaaggattttattgctccttcacttatgaagcttagtttggctggagatgaaattctaggttaaaaattcttttattcccactggctgctctgaaaagccatctttgcattgttcctcgtccgcctccttgctcgcggcagcctccttgctcgcggcagcctccttgctcgcggcagcctccttgctcgccgcagccgcctccgccacgcgcctcctccgccgccgcggactccggcagctttatcgccagagtccctgaactctcgctttctttttaatcgcctgcatcggatcaccggcgtgccccaccatgtcagacgcagccgtagacaccagctccgaaatcaccaccaaggacttacaggagaagaaggaagttgtggaagaggcagaaaatggaagagacgcccctgctaacgggaatgctaatgaggaaaatggggagcaggaggctgacaatgaggtagatgaagaagaggaagaaggtggggaggaagaggaggaggaagaaggtgatggtgaggaagaggatggagatgaagatgaggaagctgagacagctacgggcaagcgggcagctgaagatgatgaggatgacgatgtcgataccaagaagcagaagaccgacgaggatgactagacagcaaaaaaggaaaagttaaactaaaaaaaaaggccgccttgacctattcaccctccacttcccgtctcagaatctaaacgtggtcaccttcgagtagagaggcccgcccgcccaccgtggacagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagagtcagccatttttaatgatctccgatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttcttttttttccttttttgtctatgaagttgctgtttattttttttggcctgtttgatgtatgtgtgaaacaatgttgtccaacaataaacaggaattttattttgctgagttgttctaacaaaaaaaaaaattcttttatttaagaatgttgaatattggcccccactctcttctggcttgtagagtttctgctgagagatctgctgttagtctgataggcttccctttgtgggtaacccaacctttctctctggctgcccttaacattttttccttcatttcaaccttggtgaatctgatgattatgtgtcttggggttgctcttctcaaggagtatctttgtggtgttctctgtatttcctgaatttgaatgttggcctgtcttgctaggttggggaagttctcctggataatatcctgaagagtgttttccaacttggttccattctccccatcactttcacgtacaccaatcaaacataggtttggtcttttcacat

SEQ ID NO: 117128 - DNA, 1099 bp, Homo sapiens
ttgactgcatgataccaagcaggctagcttacacatggatacacaaatgccaggtttttcttctggcttaaaaatagatattttttaaaaatagattttctaaaacacataatagatttatcacagcaactgaatctggttaatatgaaataagttctaagtcacatgcaaatcaaggtatttcatcatgaaattattttgcatgtttttaaaacataaaacatatttttgcctattttggaggtatacttccttttctattatgaatctgatttttttgcatgactttttttttcagaggagaacacaattttcttggtggtgtgtgacagattcctccagttaaaaaataaataaataaataaaagcttaaaatctacacatggtggctgagtagggcgaggcagctcacctgagcacggctgggcccagtcctgggctggggccggggctgggaatggggcgcagtgaggctgtgagccggccctgagccagccctgcgtcgggtgagcggggctcagggggcgccagagctggaggcggaagcgtgaagtcaggactgagtgggtgaagagaacctgggctgagcagacatggccacttatcaccaagaagggcagatgcagctgcccctagctgatgccattcgttcatgtctcatcgatactttctcatctagcatttgcaaggcttgagccaagctgtgccgtggcacactatcagggagttacttcatccttcccaccagaagaaacttatgttgggagatcaacaccagctagtgtgcttctccataaagcctcaacgtataggacagatttcacatgcccagaggctgttgagcaggcttcatgtgcgctgcactcagaggccacctctttctttgtgggccggatgggtccttgagtgtcctctcttcacaaacttcgtcatcttcctcatctttttgaatatgatcgtattgatggttgaaatagaattgctggaatccacaaatacctaactgtggctattgaagctgagcttggaggtggcaacttggtttatcttgtttattttcatcctggagatccttcttatgtggctatcctagcttttc

SEQ ID NO: 117129 - DNA, 1099 bp, Homo sapiens; identical to SEQ ID NO: 117128

SEQ ID NO: 117130 - DNA, 1099 bp, Homo sapiens; identical to SEQ ID NO: 117128

SEQ ID NO: 117131 - DNA, 1035 bp, Homo sapiens
ctaaaaatacaaaaaactagccgggcgtggtggtgggcacctgtagtctcagctactcaggaaattgaggcaggagaatggcgtgaacctgggaggcggaacttggagtgagccgagattgcgccactgcactccagcctgggcgacagagtgagactccatctcaaaagaaaaaataaaaaagtggacagagttcagagttgatgcatattttgcagaaaggactgacagaatttgctaataggctgtatatggggaggtaagggaaatagtgccaaatgtagattttttttttaagaaaacacctaaaattggtcttttaaaacatttattctccctgccttaaaacatgatagttaatactagtattctacatggtaaatgtttccttgacacttttatcatttttatttatttatttttttaggcttatgcatctggatgtgacattgtaatactgggaagcgattttgaaagattacagataatcccaggagctaaacatggaaatattcaagtgggatgtgtagactgttcaatgcaacaaggcaaggtttgtaatcttcttctaatatacaaatttgtttggaatatggtttttgtcaggataatctctgaagtgtgtatttcctattgaattagagacttggctttgtttcaaagatagtgtagctagaagaatttttggctgtctaagatgcattctatagagtgccagaaattctcttcttatataattttaaattatagcatcatcttctctgagaaagaaatacaatacttactgatatagaatgagtctaaagcttacgtatttaaaaggtgattggactgggggaaaggagtaacaatgaatcttcaatatttacaaataaactaaaggaaatgatttagaatatttttttttttttgtctgtgaacaggtagttatctccttgtaacttctatgtaacaagggctgtgtaactttttgtggaaatgaaaaactctttgagagtttataatattctaagcccataagaaaagtgaaaaact

SEQ ID NO: 117132 - DNA, 2457 bp, Homo sapiens
aaaacagagccaggaaaggttatgatccatcaatttaaagagtaaattcaaaggataaaatagaatatgttttaaaatgtactcagggagtttccagaggaatagacctaagttatatttttgaaaagttaatgtacactgacagaattgtcaatttagaggatggatgacgacaattaacatttactgtgcatattgtatgtcacttattatatgttaggtgttttacaaatgttatttcaaccctcaatgctgttaggaaggtagtgttgtacatattatgaacactgtaatggaaactaacgtttggagagattaagttgctagttaacgtagtaagttgcagttctaggattctaatgcagatgtgatagtcttcaaaactgacattcttaagcatcagtgaatgaaattgtgtgtattggcatatttaaagttatagtattcatttctttgctttttttgattcataagtaagttaacatatccctaataaattctttttttctttttaaaagattgcagcgtcttatggaaatgttatctccatttttgaaccagttaacctaccaaaacaaaagaaaaatttggtcagtaatttatgatttcttcttttaggaattgaaatgttttaagtattgaaagagtgtaaaatcagagtgatcattgagtaaatcggtattacttatatactgtaattgaacctacatgttaaattccattttgatgttaaaaatatatttaaatttttcattggaatagaactaaaataaattgtgccaatgaattgttgaaatgctttattattttatttctgacatttttaattttataatatttcaagagtcagtaacctaaagtttggcactactttattgctagtatcaaataccgttgtccagccatatgtggtactctttcctttgttttataatctacctttatacaggttttctgcctcttcagggcttaactttcttgcattatttagatcatgtaatacagtcgttaacaggtcaatgaatgtttttctttataagcaagctgtactcagaaatagttctgaaaactggttacccaataatttataaatattcgaatcatgttagcagattttataggttctttaatgcttgtgcctgtaatcctctctatttgggaggctgaggcaggaggattgcataaggccaggagtttgaaaccagcctgggcaagattttaaaaaaagtttagccaggcatggtggcacatgcctatagtctcacctgctcaggaggctgagatgggaggatcgtttgagcccaaaaatttgaggttgtggtgagcaatgatggcaccactgcattccagccagggtgacacagtgagaccctgtctctaaaaataaaaataaaagcaaaccgtctgaaagaagataagtgtagtgtcattgaaagagcagtgtaagggagctaaatgatgagaaattatgaacacaaggaaacaacagacactgaggtctacttgagggtggagtgtggcagaagggaggggagcagaaaagataactattgggtactgggcttaatacctgggtgatgaaataatttgtacaagaaaatcccttgacacgaatttacctatgtaacaaatcttcacaggtactcccaaacctaaaattaaaagattttttttttttttaaaaaaaaagaaagagcagtgtattgggagtcataggactggtttctatttctgggtctatctagctagttggtcttaggtaagtcagccttaagaaattctttgcttaactctcaaattgattactatctattcagtcttgatgggaatattattaggctaacatgtcaaagatggtttaggaatgtattaattataaaggactaaactgttttaatagcagacatacctttatatatcttttgatagttttcatgtcatcttcacttagctcattagtattttacaaattacttcaaacctagtttgtgcagccattatttcttctttttatgaataaggcagtagagtaggctcaaagaatatagtgacttgacaagtgaagcagctgttaagccacagaactaagagtaaaaccatctgtattgattcctaggtgtgagtgttctttccttaccttgtgttaatgaaaactattttctgagttaattgatatttatctttaaatttcatagaaatagtgttcacacttctgatttctatttgtttttatagattgcctagtgaatccactatttgagcctcttaaagccttaagaattagtaattggcagtactaaaaagaattttttaaggcgattaccccacccagcccagaacagtgtatttcagtactcaataaatatttattaaataaaataagtagcttttgaaaatcagtatgttatgttaaaatgcctttattgggaaggatagaatagagaatttcaatgtttg

SEQ ID NO: 117133 - DNA, 1006 bp, Homo sapiens
ttaacgtttcattgaaaaggagcctttggacctgagagtaaacagactttagcaatgagagttgggtagatggaacaggaaaaaagtgaaatttaagaaaatatatgccaggcgtggtggctcacgcctgtattcccagcactttgggaggctgaggtgggcagatcacctgaggttgggagttcaagacccgcctgaccaacatggagaaaccctgtctctactaaaaatacaaaaaattagctgggcatagtggcgcatgcctgtaatcccagctacttgggaggctgaggctagagaatcgtttgaacctggaaggtggaggttgcagtgagctgagctcatgccattgcacttcagcctgggcaacaagagtgaaactgtctcaaaaaaaaaaaaaaaaggaagaaaatataatgaatatatgtatcagttatctatttctgcattagaaaagcatcctccaaaatgatggatggcttaaaacatccatcattttattgcttatgattcttttggtcaggaagactctgtgggaatggcttgtctattgttccatgtggtagtgactgaagcagtttatctgcagctaaaagatccaagaaaggctttgttcacatatctgggccttgctgcttgctatctactggaatgcctttgttctcctccacatggcctcttctgtggccctctgtagcagggcagcctggattttacatggtggctgcattctgagagtgaaagtagaagctgcaaggaagtcccagaatgttattgctgccacattatatggtcacaggtccagctaatattaagggttgggagacatagactccccctcttgatgaaagatatggcaaagtcatattacatggaggcatcaacacagagagacataatttattgggagccatttttaccattctacgaaagtgagggaaggcacagagagagaaagcataagatacattataataaggattagtatttcactgggctgagtctc

SEQ ID NO: 117134 - DNA, 1055 bp, Homo sapiens
ttcctcacttttcctggcacttttactacaggtacacattaatgtctccttcctgtgggcttccataaagctttgcatgcatttctatcatgtatgtaacacttccacatggtatcatatttccatgtctttctgctgaaatatgaactcatgaaaaacgacaatgttttgtttgtcattgtatttccaatgtctagcacagtgcccgggacaaagaagatgctcattaaatacttgttaagtgagagattataagatttcttcctttctatctcaagctattttaacgaaattaaaatacagccttctcctccgttcttcaaaattttttttgatatttgacttttttttagaagttgttttatatgaaattcttgagcatgtaaattaagtcactattaaatacctaaataataaatgaggaataatattttttttaggcagtcgtcttttaactggttccagctatttgcaactctggtccaatactaacttggagaagccaactgaagatgaaaatttaaataaaacagatcttaactttggagattggaaatgcatttggcattgcaagtaagcaattaatcaggggagtaaactgataaacctgttgttctatgtggttttattataaatgtattttagttgtgtaaaaccacactgacataaaaagtattgatttttagtctatgatatgctttttcttatacacagataattctctatttcccgtgttctacaaatacattttttaaaaatgtcaattaaaataggaagaaacaaatgtgtaaggcttacatgaagaccattaaatacaaacttgccaaattatatgaaaagatagatgactttcatgcttttgaatggaagacttcctattctgaagaaatctatttttcccacataatctatatattgaacataatccttgccaaaatctgagtggaatttctattaagcatagttctaaactctacttaaaaggacaaatatgggaaagtcagagaaattctgaaagaaaagaagaatgaagatttgcagtatagtaaaatgaa

SEQ ID NO: 117135 - DNA, 1030 bp, Homo sapiens
tttgagagtccatagttacaggacttctgagcctatgaagattagagtaatattaaatcgtctctggcctgcacatctctggctgtggctcaactatgtttgatgcttaggataagagccgtattaaaggagtttaagctgggatagtttactccatatcagatgtctttaagtcacagagttgtacatattttctttttctttgtgttttgtgtctaattctgtcatctattttctccagattgttgtttgtttatatttttacataaatactctgtcgtcttgtaccttctagtatgtcttccctggttttcttcttttaaaaaatagctttattaagaggatatatcatgagttcttgtatgtttatttgactacacccagcatatgtgaggaaaagagagagtaggttaataccctaccttattcttctttgaaacagctataagtttaaccacaaaagcacacagtgacacacacatacatatcctcagtatcttcttttttttttctgtagttctggaaagagttaatgtaatactgaattttagtaggttatagagacctattacttaaatacaggtataaattccctatttttgtttgttttttatgtgtttttgttttgtttagttttgagacagggtcttgctttgtcacccagactggagtgcggtgccccagtcatggctcactgcaacctctacctcctgggctcaagtgatcctcccgcctcagcgtctcaaatagcggggactacaggtgtgtgccaccatgctgggctaatatatttttttcttttcggattttttgtagagatggggttttgccatgttgcccaggcttgtcttgaactcctgagctcaggcgatctgcctgcctcagtctcccaaagtgctggaattacaagcatgagccatgtgcgcagccagaaatcccattttgtactatatggccattttcaacttggccacaccatgtggcattttttccctagcttttcactgttctatgaattttgctgactaga

SEQ ID NO: 117136 - DNA, 1396 bp, Homo sapiens
aaggggttggggaaggaaaggaaaaagatgctaggaagggagaggtaggggacagaaggagagaggtagaaagggaaggtggcctggaaaggctgtgaaagcaaagaatggtgggagagagaagcccggagaggaggtagaaagggagaagaaaacaaggaagtagacagaaagaggagagggcgccagagggagagagatgcaagaatggaggagggaaggagaaggagagagcaaccaatacaaattatgctgttctcccttctgttctgcaacttcttttttagtcagttaggtaagtttaacaaagtggctactagacaatattttgatttctcatttactttaactcactgagttactgataaaacctgctgattgttccgtttttaaaaatcagatatgtatgctggaacaagttactactacaaaatattgtgactttttctttctttcttctaaacttactgaattccctgatggaaggtagtccttgctgatagggtttcaggctttgagctcttgttgcttgttggacttattaacatatatgtaattgatttttgcttttattttaaggaggtggcaaaaaggaaattaactgaaagtcaaggatgactaaggagggggaagtgtttagtactttatcatgaatattcaattcttgcatttcactgctttgggcatctgttaggtaaggagagaataagtgtactcagtagttactgtagctttttgtgacagtgtgcaggtgcctttataggaagtagaaatgaagcatatgatataattcaaagaactatccactcaataaatcagaaaatcttattagaagatgtggttatttcttatgtgtcaactgagagattgtggcttaatctcagtctttgtttttttagatgtaaaaagaatcttattgagtgctgggatggtggcacacacctgtaatcccaggatgaggcgggaggattacttgagccagaggattgcttgaatccaggagtttgagagcaccctgggcaacatagtgagaccacatctcttaaaaaaaagaaagaacgtttggcaacattattgaaacaagaactactgaattctaggcagaaaagaaataggttggcaagcatttgctgtgatgaaatctgtacatattgatattttcttcattggtaccttagttggtacatttaagtaattacagaaacatcgtagaatttctgtgatactatgtgaaatttgtatttttgcttctaaaatcttttcattccttagggcttctgtatgtaatgtactgttgacttgctgcaaagataatgtgtgtcgtctttgggtagagacatttttaccaaatgattgtttgctatacggaggtgactgcagccattggactgaatca

SEQ ID NO: 117137 - DNA, 1043 bp, Homo sapiens
ctatccagaagctcggtaattcttaatttatagtaataacctgtttgtatttacttggttcatgaactcttttgcttatagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtactactgttatttctggagagctacttccttgtttatgtgggtactattttctaatacctctttatataattttatatgttctaacacttgctttcttgattctaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttct

SEQ ID NO: 117138 - DNA, 1061 bp, Homo sapiens
aactcgtgtgctgtttatgcaatttgggagaagacaaattttcttgaatgatatgttttataatgaaaacttatggtttggccattggataaatatcatgaagtcatccattatagaacttattcatttgaaaaatgtttggcaccaccatttcatcatgatatgttgagttgaagtacatattacatagttcctatctgtttagaaatttcctacttcttatggtttaatctttgtgaacaatttgatgatgatgactgtaaacctatcaattcaaacatgaaatagcatacatattattgtaaaaattttaagttaatacaaattcatgtggtaaaggatttgaatatattttataataccacttgtgtttgaagccttaggtaaaagtttttaatcttctttttttaaagtccaattattttaacttggcatgtttagcaagttgtctcttttacacatagtaacagtgaaaaatatcattaataccaacaggcagctcacctaatggattttctgagaagttctacctaattgtaatagaatgcactcaagacaaccgttcactgttacacatgtggaatttacatctaaagtcaattcctgtctcattaggtgagtcttttgtgtgtgtgtttgtgcaactttaataggtgtaagttaacaaattacacaaaattagataatttgggacatatttcttaaagccattctcattaaatggtgataactgtagattattcaattaattcaaaaagcttttcttattttctttctgtgaagaatcatattaatatgtttactattttatcttttacaaggcagttttggattgtaaaatgtaacaatcgtaatatttatagggttcccctgcctcagtttttggttcttttcttatgttttgtagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcaga

SEQ ID NO: 117139 - DNA, 2999 bp, Homo sapiens
aagaattgaagtaaattatctcagagttccctttcaactctaggttttggtgatactttctttttatatacctttctgatgtcattaaaagcctctttcttactattcttgctgcccctttttaacttaaataaatataggctgtctattatgcagtttaaaaaacatacagccaagatgcccctttgattttgttcatatttatagtagttaatacaaaagactaaaatcgtaagtacataaaaacagaagtatttaaccaaatttgacattttgttaacggattatttttattttaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgagcagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtaaaactaaactccgtactgataacatttttacttactttcacagaaaataattttaaataatttttattaaaatgatgccattggctaggcacaggggcttatgcctgtaaattcagctctttgggaggctgaggcaggaggatcacttgaacctaggagtttaagaccagtctgggcaacatagttgagacccccatctctatgaaaacaaaaaaaaattagccagatatggtgcctcatgcctatagtcctagctactcaggaggctgaggtgggatgatgcttgagcccaggaggttgagctggcagtgaactgattgtgccactgcactacagcctggacaatagagcaagaccctgtctcttaaaaaaaaaaataccatgaaggttttttttggaaacatctttgctaccttcacaacagttttaactttttttccccccgagactatcataaacagcaaactcttaatatgcactatttatcctgtaaatcatagtactatgagcgagtgcacaaagactcgttatgctgttcatttttactaattttctgctcaatagtataaaagatccaactgaatctttctgagtttagcaaaatttaacagattcttattaaacaattattttaagtacctaaaaatgtggtttctgggttttttcccctcattttgtaataatccactattaacaattataatttggtttttaaaacattgagttttttttaaattagcattaatgtatgctcctacctagaaaagcataatgtaattaggtcttttcctcacccagagagcatttaaaaaaaaaatactgccaagttatgaacagtttgccataaaatctcaagtaagttctgaaatgaacaaattgagccttgtagaccatatatacgtcagtatccctttgaatgaaacttgaaaggaaaatatagggtaaatttaatataataacaaaatttaaatttaagaaaaattaagttggttatgaatcttgacacttttagag

SEQ ID NO: 117140 - DNA, 1033 bp, Homo sapiens
atactatttttgatgtgaatatgttataggtgttttatgtttttagtttttgcttcaaggaaaaaatatcaggccctcccaccatagaactgtttctcccagtgttaacagcagattattggggtggatgtatgattcgaacaaactgtattggttaaagataatactgtacatgtgccacagaaaaggttaaactgttcaaaaatcagtcacattttaatttaaataagatttcagtcagaagaggtcagtttataaagagtatcagattctctttattctctttattatttttccaattgtttatactattttttctgtaatgtaaaattctgtagaaaaagataaatgttagaaaatattttacactgataacttttttcttggtcaggttaagaatgttatatgcctatattgggtgttcttttgcttacaattttttttttaatacattgcttcccctttctcccattgcaggtggagaaactcttgatgaatgtgggttaaaatttcttttggctgttcgactccatacctttcttacaacttcccttccagcctatcgagctcaactccttcaccaaggtgattttgatagtaatctattaaagggaaataaagcgagtagaaaatgagagacttgggagtttttaaacttgtttttacccaaaaatgataatgatgacatatttaacatattttaagtttcctttatttgttaaaatgtttattttgtcataatctttgcttaaaacattggaatttttaatggtaggcaaaaggagttaatgaagaaacatactggagatgttctgtgttatgtttttaaatgcatgatatgttcaaggcaaattagtattgtttcattttctttaatttcttctttagattgtcttttctctccttttttttgacatttatctaaattcagtttttccaccaaacattgaataacatttgtgttataatacattctcaaattttaaatatttcacagagtacagaatattgaaagtgtaaatttacccacact

SEQ ID NO: 117141 - DNA, 3737 bp, Homo sapiens
tcttctctgccattactccctcttgtttttgaagcagcaaaaggcttttgaatagtctttacatttcatttataacgtgtttcaaaatatctaaagttttaaaatgtatattctaattcccaagtttttaattgacaaacttgttagtagtatatgtctgatttttacaaaataatatatatgtttagaaaaatttaaaaatagtacagaagaacttgtaatgaaaggcaatagtcctattattctctgtatccattgaagccaccactgtaagtcacttttgttattattttatatatacatgcacatattattcatatacatatttttaaaattttattaaacattcaatggatatgtgccagcctttcatatgaaagaaattacttgttcaaaactgtttctgtgaaattttgatcaatattttttgattataggtagctaaagcagccttttatagaaagaatgatcctttagatgctgccattttttaccttgcaatgaaaaagaaagctgtgatttggggattatataggtaggtaaaaaaaaaaaaaaaaaagggtgcttcaatgtgaaaacctgttcataagaagtaaatgaatgaagtaagatttgttgttcttgttgatgttgattcatgtagattcttagttgttttatatttaaaagagagatttcgtaaggaaaaagccccaagtgtttttcagagtggaagaaacctgatgaggtcagtttaatttgttttcagatttatcaatccagaaacaatattttgcttaagaacttctcattatgctcctataaaacaaaggtaatgtattagtccgttttcatgctgctaataaagacatacccaagactgggcaatttacaaaagaaagaggtttattggacttacagttccacgtggctgggaaggcctcacaatcatggcacaaggtgaaaggcatgtctcacatggcagcagacaagacaaaacagagcttgtgcggggaaactcctgtttgtaaaaccaacaagtctcttgaggcttattcactatcacaagaatagcatggaaaagacttgccccaatgattcagttacctcccactgggtccctcccacagcacttgggaattcaagatgagatttgggtggggacacagccaaaccatatcaggtaactaaaccagaaacttatgcttgggacagggaagaagatgaattaaatggtggagtctggaacaggcatttacctctgcactatgggccagcctaccccacaaaactatctccttcctgtgggccccaccttctttctgagctgaattcacttagaatttttctctctcacttctgagcaagactggtgaacatgattatcataaatagttcatcatttgttttgagtttatttccagatgacccacatgaacagcgacctttgggggaaaaatcacgataacaaatcggttttctaagagacttgatgatttacggttgttttgattcaaggcacattctttagatttttatctcttaggtcattctcagatggcaggggtgaaaagatactgatgagtttcaatggtggcacccaagttaatataaatcaaacattttgcatggatttaaaagtaattttcacagtcctgctaatgtagttttctttgtatttagaaagaaaaattttttgtaatctctgagacttatataacaaatgtttacctaatataatttttactgggaaaagaagcagatacatagtaagttatgaactggcagatgtttctatttagacttagccaaatcttaactttagaaaattgattctgatgtaaagaaaattgtattccaaaattttcacaccattttttttcctttatagagctgaaaaaaacaccaggatgacacagttttttggacacaattttgaggatgagaggtggcgtaaagcagctttaaagaatgctttttctttgctaggcaaacaaagatttgaacattctgcagcattttttcttttagctggttgcctcagagatgcaattgaggtaatgagtgaaatttaaataacaaagtatagcaatgtcatcttttaaagctccttagtgcttaaatttttatttttttaaattcaactttattggaaataacacaaggccaaatatctgaaataactgttaatatttaataaagacatttaaaattttgactgttaacttgaacggtatttatacagaattaagattaaccaaatggtgtttgttagttggtagagataggtaattgatttgactcttgagaatattcaaaaaattaaagggtttgtcctaccagtttaaacatatttgaaccccatatctggctctctattatttgatgaatgttagaaaatccttaactgattatttcttagtaaaccttaaaaaaattatgaatatttaagatacaacatttctgtctcaaattgcccttttgctcagagtttcatacaagtaattcaaaacaaccttttaatatggagactaaagtctccaggggcggatggagaatagtagaggttcaagacagaaataaaataatatagcttaaattgacgtcatttaaattatccattgtttcctcatttagtttaatttttgcacatatatatatatttagtactagaaggtaggtttgcagttattaaatgttgtcaagtagatttgctaaaatctaaaagcaagcagcatatgttttgtttcttatccttctttgctaattttggatatttataagcctttatatttttctagttattagtgagttaacagaatttatcctaaaatgaaacctgctcctgcttatttaaaaacaatatttttttttaaaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatggtaagctgcacttctaagatgttaatgattaagaatattattggtaattgctacatgtgcagatcactctattaggtggtaagggtaatacaaacaaattgaattcatggtctttataacagtttttggttggttgtttggtttttttctccagaaagataaatcctttgaaaacaaagaacgttggattttctgtttttacaaaatagatttacataaatattgaacataaatattgtcaacacttgaatataaacattttgaagaaatactgttataaagccagtttttaaatcttaggttgaatttagtgtgtttgtcaatcagttttagaattcttacagtgaaaaatgtgttcagtgtaaaaacaagttgacttaagtgatgtgataagaaaatctttagctagatgaacttttgactgtcttgttatgaactggtagagcttatgtactcttttgagtctgctagtaccttttcttttagaaatcctctttgctaaagctttcttagaggccagtataaaatggaattttttatatagatgcatataaaaatgagatttacttttcagatatgttttcatagattgaattgtgtttggtagctgataaaata

SEQ ID NO: 117142 - DNA, 2949 bp, Homo sapiens
ttttagattgaacaataggtagatgatatggggaagaattgttttagatcatggagctttctctgataaggtgaactttgatcagagaactggttgaaatgagtgagttaatcagtatagatataggtaaagagtggtttgggtcaagggcacactaaataaaaaggccccaaagcaagagtttatacacataagtaaaaatgaaatgtaggcctttggatataggagtttaggttttcagtgtgaagttgggactggagatagagatgatgtccaagttatcagtgtgtagatgttattgaaagtcatggggactatatgaattcaactcagggaatatagatagaaaataagtcagcagttgaaccctaggagactctcagtgttcaaaggtagagaagatgaggaggactagcaaagcagactgaggagaagtgttcagggaagtaggagaaaaagaactaagagtctataactggacgttttaaattatcctagaatattacctgaagagacttgtttcaatgggaaagcatcataatctttgttttcctactttgttagaacatgttcattataaatgtgttgttgtctcttcagtgccatggatcattgtggcctattagtaaaattttgtcaaaagactctttagataaaggtgtcatagtagatagagaaaagacactacaatagaaacacacagttcataacttttcttggctcataaaatgaatttactttcagatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggtatgtaatttacttgatagtcaaaaatggtacatgtctaaaactgtttttggtgtttcttttttggttttgaatactaagacttgattttctttattacggttgctttagggaaagctcccttttgtgtggtccttcatattatgaattatagagttgtgtatttatagtagttacagacgattcagtatcaggccttatgacctgcttaattcacactccaaagtgttgtctgaatgcctttgtagggtgacagacttcttattgcaagaggatattgtcttattttttttttccctctctgtgcccctaaatgtcttatttttaaatatgattattgaaatgctgacttcttcacatcccttctaactctaagtttctattatgcttttattttttaattgttttgaagtgttttaaagagcccttgatttactgaagtaatggtttgtaactgtaaatagttggttaaccttttatccctctttgtttttaaggaaacatcagaaccactattttctagccctctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtaagtatgcttggtttcaagcttttacttcatctgtacaatgataaaactacaagataaatattaaggcttttttttaagtaattttaaacatcagactaagcatagcaattgttacattgccaagtttatgttgattcctattaaagaaatcttctggttgtagactggcttatcttactcatgttacttacacccggtagagttcttgaattttttatcacaatgcctagttatttagtctagctgctttaagaaaaataggtacgtatgagtcctttagtagtacatttaaccaaaaagctcattgttttttaaatatagaaacttaatattttaatgtaaaggcactaatatgtaaacgaagttttcccttgttaatactaaagaaatccacattttaaggataatgtgaactatttgcc

SEQ ID NO: 117143 - DNA, 1019 bp, Homo sapiens
agattgtgctcattttagccaaactatatttcatatttaaaactaattatagcatacctgtggtgtatcagttaccttttgctgcttaagaactgtcctgaggccagtgtggtggttcacgcctctaatcccagcattttgggaggtcgaggcaggcagatcacctgaggccaggaattcaagaccagcctgaccaacatggagaaaccttgtctctactaaaaatacaaaaaattagccaggcgtagtggcacatgcctataatctcaggtgtttgggaggctgaggcaggagaatcacttgaacccaggaggcagaggttgcggtgagccaagatcgcaccattacactccaacctgggcaacaagagcaaaactccgcgcccaccccccgccaaaaaaaaaaaaaaaactgtcctgaaacattagtggcttaaaaagccatcatttattttgcttataattctgtgagttggttcattagttctttggtttgggccagctatactaatgtctggactctctcattcatctttggtcaactggtgggttagtcaggttctagatgatctaagaaggcatcatttacatttctggtggttggcgcatgttgacagcactgacaggagaatctgggtcatatgtatctcatcctccagcaggcaagcctaatatatttgtctggattcaccaaagaaacagaatcagtaggatgtatgtgtgtgtgtgtgtgtgtgtgtgtgtatatatatatgtgtgtgtgtatatatatatatgtgtgtatatatatatgtgtgtgtatatatatatatgtgtgtgtgtatatatatatatatatatataatgagagagagatttattataaggaattgttttatgtggttttggaggctgaaaagtcccaagatctgcagttggcaagttggacacccaggagagctgatggtgtagttccggtccaaatcagaaggcctgagaaccaggagagctataatttaagttcaggtcagaaagtcagca

SEQ ID NO: 117144 - DNA, 1047 bp, Homo sapiens
tagcgtgttttctttaaattttctgtagtaagactcatgtagataaaaatgagtgttgtagaaaaaaaggaaatagttcatgaaggcaaagaatcaaaaattttttcattcttttaaaaatgctgattatattaggtcttgaaaaaaaatctgcactttaaaaaggttatacttaaagtaattttgtttttgttttccaggtgtatgtaatgcatactttagcagcttcactttctgcttgtatttatcagtgcctttgtggtagtcataactacaggtaactatctttttatgaaatttaagaatgcttacagtaagcaatgaggtttcatattttgtatgttagtggtttagaactatatataacagtcttttaaataatgcaaaaagcatatggttgaggttttgagtactttttgttcatatttgaaatttttatggcagatgaatctcaaacccttattctgtataacttatttagcagcctattactggtcactgccttatgtcagacattgtgattggcactgagaattttaacgcaaataatatgataaagtctatttcttagggccagtctagttagagacaaacatgtgagttgataaatgatatgtatataatatggcatagtactaaaatggtaactataataagacagtagatagtaaaaggctcagggaccacatgggagggagtaacttggaattgagaaaaattttaccaaataattgatgtataggatatttctctgtatttctctttatgttataaagttttactgaaatttatctaggcttcaaaaaaatagtttgttaccctctggggtctttctatatctatctttagttgtttgaagtactctatttcttcaagtattgtctcatctctcttctatctttcctattaaacagatattgcaacttctgggtcatttcttaatgttctttaactttcccctcctatattccatttctttatctctttttgtttcatttcaggagaaattctagcttcattttccaaacacggattcattattcagca

SEQ ID NO: 117145 - DNA, 2685 bp, Homo sapiens
ccattttctgtcagaattatttcatagtttatgtcaagctgcaggtttttttgttcattcatctgttagtcttagctttgcatcttttacttggggaagcttatcctgaattctcaaattgtgtgaaatactcctctgtattgccttgatagcgtcatatgcataggtttcatcttttaagagtagtatgataacattatttgtgttttgttccactattaaattttatggggacagagacattgttattccttatatgcctagtacctgctacagtgcctgatgtagggtaggctagccattatacatgaaagtgagcctaaacggacttcattttcaaccagataactatgtttttaagtcaaatatgtaatcttgctacttgtggtacatagcgatttagttttctcatttgtacttattctgtcccttaaaatgtgttttaatttagaaaatgtgtatatttacacttaaaggatactttgtttttatatagcactagactgtacattatattacttagatgtactagcagtataattaataaacaaaaattgatactcttgaaagtagatctgaaacatgaaaatattatataaaatttatcatagatttaaatattgtttttttctcttagttcatttcagacgaatcagtttactggaatggtatatcagacagtactgcttcctcatcgaccttctttgaaaacaggaagcttagatgaagcattaactcccaatacgtcaccagctcaatggccaggtataatttttatgtatagatcagttttttcttagtcttatttataatcttagataagtagaaagacttttagttttgccacatgataatcattgttaaatactgttagaattgataccagttaagtattcaccactcattctgaattacagttacttaacattagtattcccttgatcattatactaatataactcaaatgttttgtaataccgttttttaaatcattttgcttttgacatactagaaaaacccgtctatgaaaatttatctatgacatcttagtcatgaaagattttaatgtttaatattaaagatttttaatgtttctctcaagtaactcatttgtgcttaactataataaccgctactagtctgtgaatctagggaagaaaatacagtattaactcctgatgcaatacattttttcctgaaattagaaaaatatagttaatttttaaaattttaaaaatttatagtcagtgacagctatgtttgtttgtcgttctaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctggtgagtttaaaaaatttttttaggactgaagctttatttatctgagtgatatcattctcaaacgtaattacattttaatttagttatagaaagttctggttagagaccatttgcgaaaagcataaacaaatagtcatacagtgaaaatgcagtattaaagtttctggtgcagtttttaatctttaagatattcctgtaccaataattagaacgatcttatgtaaatttattaaatattttactactgaaactttcatttgttttgaaacacactgtaatattggtttttgttctatcccaaatacggattctttcttctttctttggcaggaaggcactttgctatgcctagcccccaccaggtagtggtattctccatggaatgtgtgggcttttccaaagctctttcagccatcagttctcatagccctcccagtcttgcaggcaagatatgagctttagaaataggcttttatcattcagcttgctttgtgttgttttgaggggttggggtacagtgggacagttttattttgtttggcatttatagaaaattgagaagtttcctttgatcaagccatatttttgatttaaaacaatgattagcagtttagaaaactatctctgctattttattctgcttttaaattctttgttttttatatttctgtcccttagactttaacattttaaagtgtgtaaaaataaaacactgtcagtgctaatcatagaaaatcagactatggcttgaaatgactagaaaaacatttcaaattaggctgctttatgatttgcatattatgattccggccattggagtttttggatttctaagtgttcataataccatgaaaagtaaatattttaaacaattgtatccccgtttaaaaactttctaatgttaaaactgtatttttttcatgtattagcccatgtgtgataatcttagttttccaattatggagggcatgaggagtagctttatttttaatacatagtacttgaaaacttatttcattctatattggtgttgaataaattgaaaatgttaaatgtttttccaaaaaaaaaaaaaaaagccctatgcatacatttgagagaagctcagcaaggttatttatctctttatgagctttcattcacttcttccctgacgttta

SEQ ID NO: 117146 - DNA, 1039 bp, Homo sapiens
gtctcactttgtcacccaggctggagtgcactggcatgatcctggctcactgcaacctctgcctcccaggttcaggtgattcttgtacctcagcttcccaagcagctgggactacaggtgcacaccacgacacttggctaatttttgtatttttagtagagatgaggttttgccattttggcctggctggtctcaaactcctggtctcacgtggtctgcctgtctcagcctcccaaagtgctgggattacaggcatgatccactgtgcctggccagactttttttttttaatcactaatcttattctttgatgattaagaagtaccttcaattaattgcttctttaatccttttatttttggaatatttgaagtttacttggaaaatcatgttttacatttaattttgaggatttgttttatacttagtgttcacgtacatttgtagttctcaaactttttacctgaagataaaggttaacatatacctcttaggagactgaggacttagactgaattggcttgctgaaagcaagaaataaatttgaaatctgtttgtcttaaacttgcatgacttttatcttttccatatttggggggctcagttagaaggtccagactaatgtgcctcctgaagcttcgtgtatactctggcacactcatgaatagctctgtggatatgggtgccttagattgagaaatagagagtgagacctgctggttactttaagttcagttattttgttgtttgttttgttgttgagacaggttcttgttctgttgcccaggctggagtgcaatggtgtgatctcagctcactgcaacctccacctcctgggctcaagtgatcctcccaagtggctgggactacaggcatgtgccaccatgcccagctaatttttctatttttttgtagagactgggtttcaccatgttgcccaggctggtcttgaactctaagttcagtttttaaagaaatgacatttaaatctacattcagaatattaatttcattgtgctgattttaaatgataaactga

SEQ ID NO: 117147 - DNA, 1076 bp, Homo sapiens
tgcattatttttcccctgtctaaaatgcttttcttccctcttattatatggcttgttccttcttgtcatttagttctcgtacttttcaaagaggccttccatggtcagcttatctcaattctccttattctccatttcttttctttgtagcacataatacagtttgtatttagttttctgttatttgcctatttttttccagtaacatgtaaaaagtaaatgagggtggtgattgtatctgtcttaaaaattcttaaatccggtagaattcttgccgcacagtggatacttaataaatttttgctgaatggatgaataaataatggaatagtatcaattgatgtcaaaggcataggatggtaagataatagttacttaactctcttataatgaagtatctgcaaatgagatgaattattactattagactgtatgtttgaatgtattaaattagatatgtggctgctaaatttcatgatttctttattttagccttttctaccctcttctcaaagtagagccgaatatgattcagaggagagtctgggaagtgatgatgatgacaatgatgatgatgatgatgttttagcatcagatttccatctccaggaacattctaattcaaattcatataggtatggtatattttattttaaatttctttttaaaaataatggtgtatataaataatatttttgaaaaaattacatgtgaaattaatagcttgttgactttataacacattataacccagatttctttagttgaaattgttaaattcctttccttaacaataatttctctgttgactttataacacattgtaactcagatttctttagttgaaattgttaaattcctttccttaacaataatttatcacatacctttggttgtccattaatggaccatccgtaatttgcatcattcctcacagatcttgctccaagattataccttgcattttgggctctaacataaacaagttctactgtttttgtctggaaaatatattttcagtagaacactagtactataagatgtcaataggtactatcttcaaaaagtactctgta

SEQ ID NO: 117148 - DNA, 1046 bp, Homo sapiens
ctagaatagtgaaatacataaagaataaaaataaaatagtggttttcaagggctggtggtggggggagaatggggaatgaatttagagtttcagctttgcaagatgaaaggaattctggagttggatggtggtggtggttgcacagcaatgtgaatgtacttaatgcccctgaactataaacttaaaaatggccaaaatggtaaattttatgtttttgtattttaccattaaaaaattactaaaaattcaatcctttaagaaataaatatgttccacttgaaataaaagagaacctgacttttttaaaaatcaaactatataaaaatgtgaaatcacaagttttacttaaacttctctttactctatccaatttcttctgcacatcctctacagctaaccacttttattagcttctggtttatccttctgtttgcaaaaataagcaaaagcatctatctaaatttattccccctgctttcttgcagagagggtggcatactacatacagtgttctgctacctgctttttatttattactacataccgaaactgactccatattaacacttagagatccttcttcattcttccttatggttaccctaatattccataggtcaaaaatagttattcaacaagtactctcctcatggacaattttggttatttctacacttctgctattgtagataaagctgacatgactacctctatgcatatattattttgttttcatagaggggtatgttcaggttgattcctgatagtggaatttgttgagtcaaagggtagtatactcttctaaatccctatagaaatagttaacagatccatcgttgctttatttttagttggtccttgatgcggttggcgatggtgcaattggtgctcaacaatttgaagactttttatcccttcgcaggtcatgatcttgcaggtaataaatagctcaacatgagctaatggtgccattgcttttgacttactactctgttgtttttttttttttttttttggtctggactggggggaaaatttagtgatt

SEQ ID NO: 117149 - DNA, 1060 bp, Homo sapiens
attcaaagctgtctgggccgcatgcagcctgtgggccatgggttggacaagtttgatttaaagcgattaattttccccacatacatattttcataatcttcagatacatttttctggtaatattaaggtcaaaagcagtaatgttgaaatacttacacagatttatggcataccttttgtaatccactgggtttctttgcccacctcaccttgcacatcttccctgccaaagtgtatgttaatatttcatctcagtctttttttttttcctgcatctgctctcccctctctcatttcagtctttcttaaaattgaatatggcattttactgcataagattaatatgagtcaatgttcccattttagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaagtaggttttcttatgaatgctatttgggtttttttgtttgtttgttttttgagatggtgtctcgctctgtcatccgggctggagtgcagtggcacaatctcagctcactgcagcctctgcctcctgggttcaagtgattctcctgcctcagtctcctgagtagctgggattacaggcgcctgccaccacgcctggttaatttttgtatttttagtagagatggggtttcaccatgttggccaggctggtctcaaactcctgacctcaggtgatccacctgcctcggcctcccaaagtgctgggattacaggcgtgagccaccgcacctgccctgaatactgtttttaagataggagttttactttttgtgctgtacattcttgtcataactactcaaccctgccattgtagaataaaagcaaccatagacaacatgtacacaaatatattcagtttttgtccaataaactttatttcttaaaatggtaggta

SEQ ID NO: 117150 - DNA, 1065 bp, Homo sapiens
gctgaggcaggagaatcgcttgaacccaggaggtggaggttgcagtgagccaagatcgccctgttgcactccagtctgggccaaagattgagattccatctcaaaaatatacatacatatatatatatatatatttttatatatatatatatatatatttatatatttttatatatatataatttcttaccttcaggttatgcatataagatgtatatgaaacataaatgaatttttaatttagacatatatattcaaatatttcaaaatctgaaaacatatgaaattcaaaatacttctggtcccaagtactttagttaagggatactttacctgtacattatcagacttgagtagttgtgacagagaccatatggtccacaaagcctgaattatgtactaatcctttaaggaaatcctttaaggaaaaggttggccatatgatctgcctccagtcatacagtctgattgcagttaatttattataatttatatggcaccaaggaattgttatcaagttagtcagaaatttctgaagtttatcattaaatttgctgtctctctctgtagatccaaacaccatctggcactgtctgtgaagaggctttggcagtatttggtgaagcaggaagaaattcaggaaacctttatcaaaaatatattcacaaagaaacggtgtctaaatgaggtctgtataagttaaaacctgtttactattttattattgaagtcttttatattatcatgtaaccattaaaatgagttgtattttacagattttttgaaaacacgtatcataaacataggcaattaatgcttagaacagtgtaatttataaaaggggcagtattttcataaatcaatttaattaattcaaatgtatttgggacttttttctcgataaaaatgtttaatattccgcatcttgttttgaattgtcatgatcatcaatttaagagacaagatagaaattttctatgattttcatgtgacagttaaaagaagtctatcttagaagtttaattgtaacttagaagtttaattgtatactgaaaattttttatt

SEQ ID NO: 117151 - DNA, 1048 bp, Homo sapiens
ctaacctgcccatcatcatctaatttctgctctgtatgcagatattttcttctgcctcctctaacagagtgaactgttaccctttttgttcaaggccagaactttcacttgtgcacagttcttatctgctttcacctacccaagaacttgtcttcagttcttaataactgaagcccatctccctctctccttgtcaataaatgtttacctctctcaaattattctcattagcatgagcaaatatattttaatgttttgcctttaaaaaatactccatttctctagtctcctatgtagcaaaattcacttagagttgcctataaagtccttcaagatttaaacaataatgttgaaacaccataaacaaaccacccagcttaagaaataaaacattatcaattcagttgaatgtctctgtgatcctttccccgtggactccccttcttattcaccagatatcacattctctctaatttggttattatctccagcccactccactgagattgtcctagacacagtcaccactgacttccagtatactaaatttagtagtcaattatctatcttcatatgattcaacttcttaataatcatttggtagtgttgacgcataacatttttctaaaattgtttcctcacttagtttccataatatcaaactaatctatttcttatattagctaattgataactactgaattgtcctttttcccatccttgaaatattggttgccccagaattcagttctctaactttttatctttcctgtctttactctctccttgggttatcttacggtttaaatattaatataatttgtatgctgacaactctcaaatctctctcaactaatttcccgaactccagacattgcctgctccgaacctactccctactgtttccttcacttctgtccatctcagtaaatggtacctttactcacccacctatcaggcctgacactaggattcatcctttttctttccttcttttattcacactatgattacagtccattaacaaaatgtatcccaattccagcca

SEQ ID NO: 117152 - DNA, 2063 bp, Homo sapiens
aaattatagtgaataattattttaataatagaaccactgccaacctttattacataagccacaaccgtacctcaattatttattacctcatcgtactcagtttgtattttattactttttttcagttggtcttttatgagacacattaatagtaaacataggaaattattattagtttttatattctaaggcagaatatatgtgttttcagttaatcttcctaggaatcttaaaagtttctcttccttcaaccaagaacttaattaatggggaatttattggaggtattgattctggtgggttggaatcaatactcatactggtgtgtgagtattccaagttttttaatatttttttttaagttatgcccttcgtcaaattgtcctactacatagtaacaagaataatgcatgttaattaatgggtattcatgtcccccagtttaatagcctattaaaaactttagaaacttttctcttgggagatattctgataaaatgcagttaacaaaatcagtattcttttctgcttcatttatgataaatgctcaaataatctattatcaaagttgtgtacgctgtacgaaacaaggctcaagagaaccgtatatgtaaaatgaagagaataacatctgttacttatgctagaggtataacataatataaaaaatttgtctgttttcactacatcaaatttattcatcgctagaagtgtgtattttttacccacaagtttaatgtcaggtgagaactaaaaagcagtcatgaagcctatagtgtaaggagtcaaaatgtgttttatatataaaatttaaataatattattctacatcaggaaatacttgatattgcttaaaactaccctattctatgcagtctggttggaagttttctgagatactgaagggacttcatttttctctcagtcccataccatgtgtcctggcaggtgtaaatatcctataccttaatcccataaacttaaagaggccacgctcaaagcttcaaaggtaattgatggacctattgtcagaggtgttaggtagcatcaattactgctgtcttgagagataaatcctttctctgtttagagaactgccaaaactagcagataagacacctgaaaaattaaaagctaattactggattttttttccagtatatcttttcatgtcacaaacaagtcccacaggtagtaatttagtttgataacaaacacttttcgtgttgtgaaaatgttatgagacaggatttttaaaaatattagtctgaagttcagatacctcaagatagctgttttctttccttggaatagatcttttgaaaaattcttaaagaactttttagaagttagcctagtacattttataattttctgagtagaaaacacactgtttctctatgctgtcatgtacagttctgataccagatgtgttggcttttgtccactccaagccattctccacctctccaagtactggctgggtgccttataatttggtttaattatgacacagtctacctggagttagaatcatatcctacaggttaagggctcagtcccacaaaactgctccttacttcagacaccactcgcaggttatcagttttcacctacacatctggcatactggctataaatcagagtgcccacagctccctccttgggtttgattaatttgttacactgattcacagaactcagggaaaatgctttacttacatttatcagtttattataaaagaaacagatgaaaagtacatagaatgaggtctgtaagactcctaagcagaggagcttctctccccttggagttagggtgcactacaaacctggcacatggatgtgttcaccagccaagaagctcatcagatctccttgttcaagagtttttatagaacttaatctccagctccctttcccacccttttctggaggttggcgagtggaactgaaagtttcaatgctttaggctatctgtgggaccccatctaagacactgcattagcataaattcaggtgctcttccatgggttttagtagctgtatgccaggatccaggg

SEQ ID NO: 117153 - DNA, 1032 bp, Homo sapiens
taggcaacaagagtgtaaaactccatctcaaaaaaaaaaaaaaacaaaaaattgtagccagagcatgttggctcatgcctgtaatcccagtgccttggcaggctgaggcaggaggatcatttcagcccaggaatttgagaccagcctgggcaacatagggagactccatctctacaaaaaaaaatttaaaaaattagccagacatggtggcacacatctgtagtcccagctactcgggacattgaggtgggaagattgcttgagcccagaaggtcgaggctgcagtgagccaagattccaccactgcattcttttttttatataaaaattagtttcatataaatttgttggttacttgtatttgttgcttttataaatttaagaaccttctgtgacagcaaggtttaaaggtcacacagttatatatgacatattttttattgttagcttttgtgtcactcagaagtaatctttttttttttttccagaaacgtatgtttgtgggatactcttgtagcacctgccaatagtttagtccatggtaagttttcaaagcattttataaattttgaaagtcaggaaattcataagctaaatattatttataagtggatttgttactgatgacacatatatttattaacccatgagatttcttttgcccaggatggcaggatttgaaagcaaaaagatgcaatatacgtaattaactcttcactataccttgatgggggacagtgagacatcgataatataaaaatcatttgtctttactttgaatctgatagccacaggttatcgttgtaaacatgatgtaaactcaatattatgtcccctcttaccactcctattcaacattgcactggaattcctagctaatgcagtaacacaataataggaaataaaatgtatataaatggaagggaagaaataaaactgtctttattcacagaaaacataattttctataaaatatcccaaagaatctacaaaataaattcacaagtatagcaaggtcccaggatacaaggt

SEQ ID NO: 117154 - DNA, 2545 bp, Homo sapiens
ctaaaatttttatttggtttcttttcttttccttttttttttttttttttttgagatggagtttcactcttgttgcccaggctggagcgcaatggtgtgatcttgggtcactacaaactccacctcccgggtcgaagcagttctcctgccccagcctcctgagtagctgggattacaggcatgtgccacctcgccgggctagttttgtatttttagtagagatggggtttctccttgttggtcaggctggtcttgaactccttaccttaggtggtctgcctgccttgacctcccaaagtgctgggattacaggcatgagccaccgcacctggcctcatttgatttcttaaggtcatcatcaaccctaattttccgtttgttcttaatatctttcagatttggagtctctctacctttggtcttctccatacttttgtcagtgaacatgctcggcagtccatttttagaaatattggaactggagtgatgcaaattgagacagggcctgcaaatcacattttctcctgtggagctgatggaacaatgaaaatgagaatactgccagatcagtttagccctttaaatgaagtgttgaaaaatgatgtgaaatttatgctataacatttttacaataagatgtacaatttattacctatatggaagtggccaacagatataatatacagtgatcattctctatgccacaaattagctaatgctttcttgtttttatatttattttatggagctttgcccttgatgcactgatgccttaaaaattaacaaggtcattcagaagtagattacattgcctaaagtagaatgtgtaagtaatgctgtaataatacatatcatagtatattataatcagtatgtcatagtgttaaaggtgttttgttttcttattgatacttttccacaggcatctctgcatgaatttcttccacagtaaaaatacgttttttgtaaaggcaattgtacataatactcatcacttaattcaccacactctcacttcctttattagccttatacatctcaaactcttctcttaattaatgataggtatttgagtaagaatgaaaaaaataatgaacatcttcattaaaattgtcattgagacgtcagtgataaatgagctagatggctcaatatgtaaggttttcagtagtttaccctccggaacccaagttgtatgtatgtatacgtgtgtgtgtgtgtgtgtgtgtgtatcttacacatcttatttgaacttagttgtatatattagcgaaaactggtttttcatgtgtttttgtgccataacaactattgccaccagaataactttttttttgcaactgtgcttttcatttttaaaaaatttttgaattcccatcctaattttcaaataagtttcaaggagactatcaggattattattttaaagattagatttagtcaaataagtcttagcaggcaataaagtttctgtggtggcatatatcatgtaagacacttaaagtaagtttgtgaatttgtcaactttcgagcatcaaacaaatattttacttaaattttattttatcttatttttaggtgcttttaatctcaaaattctgaaaagcgaatagcagtgttttcagaaacaaatgtgaaagcagtcaaattaagtagatactatttagaaatgtaaaatactctccagatctaccattaatagaaaataaactaaaccttatattttatttttgccaaaatattttattataaaatatgaccaaaatatttaaaatgcacaatgcttttaacttaaatgtgctaaccctgtttctgtctgttttgtgctgtaccttttctgattcagaattatagaaaacttgataaatacttgattttaaccaatgagactacaggcagatgggactaagtgtttatgggacaattatgtactatttaacttaaatatattttgtttaataggaaatatataataatagcattttatgtaataaaatatgggcaacgattatcttggaaattaaagagtcaaagcaaagaaatgaagggctggtaaaatgaattttgtaatatcctcaggatacttttatcttaaaagtatgttgttaaagattttgtaaattgtatttcaacaattttaaatgtgttgagcaagttgcagtgcaaacactgtcattatgtagagagtttatatgcacataataacctgtacctataaatcgtgcaataaccatatgcgactattttgccatggagaaatctgacagcattgcaaacaatagtattgtttgatgtagttaaccttaagttatttttcagtaatttcttcacaaatcaagattcaaacagctttaaacacttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttttttagggggtatacta

SEQ ID NO: 117155 - DNA, 1088 bp, Homo sapiens
acgcatttactgtgtgtggggcttttgattttttagtgtagacacaagtttccatcagggattttttttttgtccttcagcctgaagaataaaaatttttaatattatagctcacgtctactggccacagatcctctcagcttgttgtttgtgcgcacacttggcgtctgtgtgtccagctctcctcttataaggataccaatcaaattggattggggaccaccttaagactaattttaactgagtcacctctttaaacattctgtttccaaatgcagttgctttctgagatattgggagttaagtcttcagcatatgaactttttggtgtttcttagtctgtttgtactgctgtaacaaaatatctgagactgggtaatttgtaaagaacagaaatttattttccacagttctgggggctgggaattcaagatcagggcacccacagattcagtgtctggtgagggcagctctgggcttccaagagggtgctttcttgctgtgtcctcacatggtagatgagatgggaggtggaggggcaaaaggcactggggtacacctttcaacatcttttgtaaaagcactaatccactcataagggtggagcccttatgacttaatcacttctaaccacctcttaataccaccaccttggggtttaggtttcaacatatgaattttgaggggagatacaccttcagaccatagcaggagggacacaattcagatcataacaatcgggatgttttagactgcaattaagcaaatgccaatgaacagtgatttgaatagtaaagacattaaattgtcttatatgaagggcagtctgggattgggtagattcaggattggatccttggctaaacagtgtcatcagggaccagttctatctattctcatccttagcatgttacatttttatctgcagacttgcctctttgtgggcggaaatagctttctcagcaacaggtatcacaggttcctgccaacctctttttaagacaggaagggggagagagagagagagagagagagagtgtgtgtgtgtgtgtgtgtgtgtgtgtgtgtgtgtgtgtgtgtgaagggtg

SEQ ID NO: 117156 - DNA, 1070 bp, Homo sapiens
atagttcctcttgcaggaactatgccacctagccagcttgcaggggcttgctggagggcagtaacagagctgggttccagaggctgcaggatggagatcttgaatattgtagaacagttcttcaacagaaaaaaaaaatcttttgaacagatttttctcagagctatttaaaaatccctgatttaggccaggcacctataatcccagcactttgggaggctgagatgggtggatcacttgaggccaggagttcaagaccagcttgaccaacatggcaaaaccccctctctaataaaaatacaaaaattagcccggcatggtggtgcacgcctgtagtcccagctccttgggaggctgaggcaggagaatcgcttgaacccaggatgaggaggttgcagtgagccaagattgcatcgctgcactccagcctgggtgacagagcgaggctccatctagaaaaaaaaaaaaaattctgtagcataaaaacatgactctaagtctcacagcctgagtagccccaggtttataaatccattgtcagggctgcaaacaacttgagagcaacctgccttgctgataacaagtcagcagtgttactagcatttgcttgttaacaatacctcaataagggacaagaagaagggaggtgaaacttaaatgtgccaattttgaaacttgctaggcattctagtagtgagtttggtggagaaagaagttaaaattatctaaaaataacgtttttgaatttcttactatctgtgccatctctccatatgttgtcagaatctttttttttctaatttaaagcatcatttatacccagaggaatatcatagagaaattttgcttacatggtctttttgaaatagttaagcaaaggacgcagccattatttggtactaggtaatgggaaaagctctggacaggcgagcaggaggaggcgagcaggcgagcagactgggtatataatattgctgagatgctcaacccctctgggccataattggtatatctaagaaatgtgagttgtcaactataaatcatctctaatccctcagtgtgaaaattct

SEQ ID NO: 117157 - DNA, 1072 bp, Homo sapiens
ttggaataataattttatttttaaaaactcatggattatttttagcttcaaagagtgttcttattttgcgtaagttaaactaatgaggcagtaccagccacggagtgcaggaagggctgctttcatctttgaatagtgaaaggcagcctctttcatgcatatgtttatgggataaaattcctttttaggatttggggcagagttttttccctcttatgccccttagtttgaatggaatagtcattcattgtccttgtattttcgttgcccgggtaagtatttcactcaagagatagtttcaagaaagttggagatttcttctttcaaactagcaaagacatttttgcttttgtctcttgaaaatctccctcaaactaaaagaatgaaaatcaggaatgcagactgtatccttataaaccttggagacatctgtaaccctgacccatacaggacctaaagatagaaagcagatgaagtgatggcaaatgcatttgcagagaggagaagtgaagtcaagaataaaatgcctgcagggctcaccgggagaggaccggaagcgattgatttgctcacagaatgccaggaaggctcagaaatgagagttccccagttccccagaggcataggtgaagcagaggctttaggatgggagtaggggtgggaaagtctgcaggaggtaaaggggagccccagaaggacttgagaagggaagttccctattgcagctctggcccaaggagaagagcccatctagaatagagctgaaggaggagggctccaggaggagtgtttctgggaggagcaggaatgaaactgattagaaaagaagaaaaaaagaagaatgggccgtactgggtttgaattctttctctgtcaccaatgaactgtgagtatgaggaaattagttaatgtctttggacttttcatttccttatttattaaataaaacattatatcatatggtattttgttattctgttgggtaaaagacagtacaaaacccagcaagtctacttccagatgtctaccccaaaaaatgaaaacatgtccatacaaatacttataagcaagt

SEQ ID NO: 117158 - DNA, 1059 bp, Homo sapiens
ccaagatctcatttaacttttttgtattggggaagatatgggagaaatgaaagtctaggaactagagaggtgtgaaacagatgttcctaagaattttctagtttatcttcaggaatgaaggtaccactttgattacataatttccaaggtcctgtcatgctctgaaatagttttagttgtttcagtccccatctcttagcaaataagggaggagttggttattcactcaccagatattttgaatcataggaccattatttagttgtcctagttggggtcaggctaactggccagtgcattgaacttgaccttcaaaccacctgttgaatttggttttaaggtatagcttccctgtaactgctcactggtactttatgagatagaagatctgtgctctcaagggtgacaacctcaagaaacttacattccaagagagagaatccagaaatatggacatccttttattagagaaaatgatttctagagaacactaaatagtttttttctcctctatttttagtatgtttcctgctagaatcccattttctcctctgcttctagtatgttttcagctagtcactgggtaaatgtaaaagtaaaaattcacctgtctttgggaaggatgttttgaaaatgatttatttttctcttgagaattggctctgctgaactgtcaaattattcacctttatcatattgaataacatcatcttctgccactccttttaccccacagtctttcagtggacatttcgtgagctcatctggagggtgttgctcacttgaccatcatcttttcattaggttagctggatcagtgcgttaatttccattcataattaacacttaaagcttatgacctaagatcgttcacctgccaaaacaagcaaaaacaccaaacagcaaactctcttatcatatgctgagatgaaaaggagaatgctttttatatattcctgggctttctctctgccctaattttgcatcattgttgaaggagagatgcttcctaattgagatttcccattcctgagtggagacattattgcgaattgttac

SEQ ID NO: 117159 - DNA, 1015 bp, Homo sapiens
ggcttggctaacccagcctgaaattcttaaaagtgctcctcctgctttcagaatcaagttcaaactccttcaccaaacatattaaaggcctctttatctggttcctgtccagctttgcagcctcatttcctcctgcttttccaaaggcactcactctgtgcttttgccattctgaactgtttcttacctctaaactaaacacacaattccctataatggtccctcagtgacccacagggaaacctgatccccttccctgataccatgcacacaccataggcaaagtccttaaaacttgcaccttagaattacctgaatatgatgcctagtcctcacagttactctctggttgggaatgttgtgcaaagaccacgattgcatgagctcacttctatgagatgaaagtaacataactgttcctgttttctttccagaggataatttcctgtcagtgaaactgatactatccttttagaaattattttcagttatcttctatatcaactgtgtagcacaggtttcccttttggatgcatcaggaagcaaatcagcatatttctgtttaatacaaattgattgaagtgataaattctaactctgtgtttgaagctgcattgtaccagaacagaaaagtcccaaaagaatggtgaggtgaaaattatctgaaaaatgatatataattaaaatcatttatgaatgagtcagtgtaatctgcattctgcttgacataaagagaaaataccacattcctgggagggaggagggaggtgaacgtcaatctgtaaactccaagctggaataacagaggaagagctattggaagtgtagattccagtgctgtgaactcccagttataagatcactctgtaagcagaatctaaataagctgatttacaaaggaaaataaaaggtttcagaaaatatggggtatcttaaaaaacctctttgatagtcattttcgggctttcttccctcaaaaatgaactgatttttcaaatgactattttcttaattg

SEQ ID NO: 117160 - DNA, 1021 bp, Homo sapiens
gcgtgctccttgttgctccatttgactcatgctctctccagttatctatcatagcctggtaaaaaggcaaaagcagttgtgcatgtatgtgataaaattgctaaactgtttcttgttaactgtcaagtggcattgaaggagacagttatttacattttcagttgctttttgtgaaatacaaagatcaaagacctttactgcagtttcctcctctactcaaaccacaacttccttcctctgtgttaaaagcctctgcaacatgcattggtattctactttctcaccttcagtgacaaataataattttattgtgccaagatgaaatgtggtcacttgagggcttttctgtgggtgcctctgcatctctgaatggacacctttggaagacacttaccatactttcagcagcatttttagtttttatttgttaaaggaaaaaaagactgtagaagtgttcctgactagatttcaatccttttttggtttctggacccttttgagaatctgatgaaagcttgagggtggtgatgcttgtcacaggggcagctgccacaggggcagctgtggctcgctccagcacattctccaaaagggattccctttcaacagttgtttaaataagatggcaagaagatggctctcaagactataatgaaaagataacaatagaggaaatggcagaagagcagggtgggtagttctgcacgtgatcgaagcatcggtgttcagactatgggaggagcaggggaggcaatgtgggagcattcagagtgactccccactcacaaaagacacatcaccccagtctcaggacattctgataaccccaaagcccatctaggggctgctagggagtctgtgggcctcaggttggaaaattctgctcttgtcttattggcatttaacatgcgggctcaagaagtctggggcggaccattacctgaatttcagctctaatgcttcccaagcgtgaggctttggctagtcaagtcatttgcttctttaagccactgttttccca

SEQ ID NO: 117161 - DNA, 1041 bp, Homo sapiens
agcagctgttcacactgcttaactcactactctacctggccttgtgaggtcttttgcctttctgttaaatagaaaggtgttcttcctattttccacacagtttgctttttgtgctttctgtctggtgaatcatggatgcttttgcgatatgatatgaagagaaaaaagccagcagatgtaggctcatatcccagcattctgctgaacagatatgttaactttatggagctgggtttccacacctgtaatccgaggataatgacgcccacctcccagggttttggcgaggagtgagtggaccacagtgagagcaccatgcacactgtggacatctccaggtgcttagcagcaggatttccccagccttgtctagacatggaccatgcaagtccatgtccagacaaggtttggggaaatcctgtgctgtgcaaggcctcctttatgtgagaagtgagtctgaccatccgccgtctctgttaggccatctggaaaacgcttctgagcatattgtttatctcagtccctgagtctcctggaataattccttctcagcctgccttcctccctgcttcaccaatgactctttcctctttgaagaagaggagagagacaaagaggagtaagttgaatagaggagggggaagctataattagcgccatggtttaggcacgccattgaaagagttagcatgggcaggattcagcatacgaggagggtacagagaggactgatgggaagagaggaaggttgaacagaaagaaaatgaaattaatcttggcagccatggcattaagcactagggattagggaacgtcctgggaatgccaaagcataaaggccaaggtgttttgtagacatttccagttctgtctgaggctgtagaattagatgaaataaacaaatgaaagtatctttttatgcagacacaaatgtcatcactcttttgatgattttgttgaatgtgcttctgataaggatgtgggtagctataaaggaaatatttttcttggggtatgtgataagcagttgatgaaactagg

SEQ ID NO: 117162 - DNA, 1066 bp, Homo sapiens
gagaaccgtagtggcagagtggcgcgtaggagcttgtctactctgttcctggtaaatttcactcttggatatcagcacatcctgaccatgttgccatctagtggaactggctgaattgcctgtgggagcatcaccaccttttcccaattcaggataaactctagtgtgatatcctggcaatagggaaacgtacttctcttttgcctaggaattttaaatgaacgagagagaggaggtgagtgctctccccaaatcacattaatttaaggaatttctcatagacagtgtctggagtccatggcatgactgctgagaatgctgggtgtaaatgtccatcagcttaaggtatggagcgagcaggaagcagtgcttgggaggttctgcagtggagtgaaagcataccgcatctcgctctgggccctttatgtttcacctgggctggcttgtttttgtcatgtggttacagagtccatcccaatggcagagagagccctctgaccataagcaccacaccccacagaccccagaccaaagacattgtaaaggtctgtaatccttctgccctcccttccagccatccatggacatatctattcagcaaatacttcttgaattatgtcccaggcaccttccaggtactaaggcagtgaacaaagcagatagaaatccctgctcttggagagctgatattctaggtgtgggcaataaacatcaacaaaataaataagtaaaatatataataagtggagaaccgagtgctaagtagaaaaagatattttcaagctgaagagggaaatagggattgttgcagggggtgagggggtggaggtgggtaattgtggttgcaattgtgagtgaatcctcactgagaatgtgattgatattagactcacctgagaagtgtgaggaagccagatgtggatatcctgggggaagaactttccaaacagagggcaagcggctgcaaaggccctgaggtgagaatgggctgatgtgttccagaaacagtacagaggcttaagggagggggagagatgagtcagagaggtggtgaggggctagatgg

SEQ ID NO: 117163 - DNA, 1008 bp, Homo sapiens
gtgctgtctctgctttctcaacaccagatcattctgcaacctcttgcaatttggctgctatctctagtcatgttactaagttatctttctcaaagaatctccattggtcacccaaccatcatagccattggtcttcagccttcacttctgactggttattctctacctgggggcatttttctttcttttctccctctcttcctcttctttggctggcgttacttttttcagtctctgaagggaagctcactcctaggagacttgcttaatagaatgtttatcgcctgcatgtctttagcaaagaggtgtctggaattcccatctgggatttattagtctaaatattcaggtggtccagtgccggatgttagttcttaacttaaaggaaacaaagtttccaatccgaggatggtgagattgctgctgttctacagtgggcagccgctgctggtgtcttgcttgccctggaaatgccatcaactgaaatggaattttgttcaatccatcttattaatagttcctaaagcaattgtggtggggttgataggtggctagtaaggttgcctctgtaaagataagcacaatccattaattaagtctggagtccactggacttctaccggggatgtttgcatttgctcggcactctgtttataaggatgtcgaaggaagtgcgtccattctgtgcatgttgtaaaacagaaggtttgcagctgtcagatttatttttttcttggctccttttctgacagaacttttgtaaacttgatagttttatagattgtcgaaaattactaacctcggttctgcagatgccatgcagattttcttgtcttgttttctttctttgaagatagcagatatttatgtacatagtttcttgtaaggtactttttggggaagaggagattaagattattcttatatgctatcataattcagtattatgaaattattaaatgattattttattagttatatagtgctttgaaagtgtccagcatgcat

SEQ ID NO: 117164 - DNA, 1805 bp, Homo sapiens
ttgctcttgagctaaaacagagcattcttccccaaggtgactgcttgcttgcatttaaatacaaaagaagtttctctccaggcttcctgaggccgatggtgaatgttcaaagatcaacgaagctaacatgaatctaaaatgaattataaggctgacggagcgcttgaactattcattcagcagttgtaaaacaagtagcacattaaaggacatgtattttaacatatcttatgtggtttgtccccagttggacttgcaaaatgacatttaataaatatttcttgtaagggtactttctaaaagaagagagtgaaagtaattctgctgtaggcagattgggcctgaaatttgggttgtctggatttgcataatcatcaccttgaaaaggtgttgctttaccccaattatagatcagtggaagctctcttgtgtagcacacggccctggtgagatcccttaagatctcttgtggactatctgtggacatctgggttgcagtgaggaagggcaaggatagatggtatagggagagaggggcagaatgttgacttgggcaggacaggaaaagccacttgtgactggtgagggagcatttctttgggttcagaatcatcctcatctcagtgtatctccccataagtctgagattactgagtgcaaggtatacatatcagcagctcctgactcaggatgtgtggcagaggggaccatgaagttaactgtgactttcggaagggtgcagtctgttaccctttcggtggcgaggtcagtttccgggaggctctgcaacactgatattttccagatgtttctcctcttctcccttctctggctggctatatcttcctcccttcatcctgctctttcagtgaaattgagataacatgttagaatcttaggcaggttagaatctctcagcagtaggatgtgatttaatatctagacctcttacattaatatttataatagccttcactgcttgtgaatagcataagcactcttttctgttcaaagtcaatactgaaataaaacccaagagtatgttttataaaaatttacttttaatggtgcaatggtaataatctatgtagtccttatggttttcaaatccctttgtgcttatattaccttatttaatacagacataaatctgtgaagtaaataatactatttttatcttcattttacaaatgaggaactggaggctcagagaggttaatttgcataaggtcatacaaatgatagatggcagaactggatttaagttcagactccttaaatccatgtcttttgtacgttcttttcactaaatttgccatagtgtttctattggtttttgcctatataaaatcggaaacgaagaaaaagaaacgaactggaaaataaatttgtcaaaagagtatatttttttctcataatttccaagcggatctttcagatatgttatttgaggactttttgcctcagactggcgataaaacaagtgttctacaaaatacctccgtaagacaggcctatcagtggcagctcttgtccccgctttgcagaagggaaaaccaaggctccacagagctaaggggacttcctctcagccaatttgtaggggcctgtgggccagacccgggggcagaattgagatctgttgtgaaggctgtccggcttctttattctatcagcatttcaaatcctgaaaacctcccctttggcattttgaaggaattcatccccagtttttgctggtagccgggagggaaccgtgctctccccctgaggaaggccctttggagtaactgcagcaatgagtg

SEQ ID NO: 117165 - DNA, 1017 bp, Homo sapiens
ctgttatatttggtagtggtactagaatagtatagaacctaccagcaaaagtgtctcagagtaatattgtctgttgtttcctttctatttttttaaatggcaccatctatccctatcttgtgaactagttaaacatgttttaattgtatatcttttaaagcttcagttagccagatttttaaaaaaatgtttgatgttgttttttattccatgaatgactcaattgactacatgtaggcagctactaaacttggcagtttgttgccattagcatgcccttggacaggaagtattcagtatagatatgacaaaccagtttccaggcttaaaaataaagcggggatttctggacagaataggtctttgtcactcatttcaacatgtctgatgagtgttaaagttcaaagcctatccctttgctttctcattttttttcaggccatcactttacctgacatattctattatatagattgaaatttatttcatgatgctggtgttttgttcagtttttaaaaatgaaataagaggatatttgaatagtcatgagaatcagctagagtcagtattctctccttgttatctctttcatgtttagttccttttaagtcatctccccactgaggtaggtaatggtgaaataatgtttccctgcctgtaaagcagcttaaattaaaagtagcaagtgtgtgccaggtacactacatgacttctcttcttgaatctgtggtccacttgaaatagcatttttttccccaaaagttgcttcccatcagtcttgtagttcttaatttcatttgtcaggtagtcacttagcaacttgggaagaatcatactattttgacagatactaacaggttttttggcatcttgttgcctacagttattgctttatgacttaaaaagtaagttcatactttttttgctatctcccgaaataatataattttccctcctgtctgttaaaaaaaaaaacccacactttctcttctttctttcacttacctattctaagca

SEQ ID NO: 117166 - DNA, 1051 bp, Homo sapiens
ccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgac

SEQ ID NO: 117167 - DNA, 1074 bp, Homo sapiens
ctttaccatccctaagggggactttccttcccaggggctatctctggaagcccctcaaggataggggccgcatgctgtttctctaggtcagcaactaaacccagaaaacgtttattgagtgaatgatgaaacgacaggtgaatagatgaacgcaaggtgtcgagttaactattcttctacacaagtcctagcagctcccattgcttccagccgcagaaatggcccctggaaggcaagtcttccagcgagtggagtcactcttaactacatttcccaggattccaagggagccgcgcgctctgcgctcatcttcctaccagaaatcggcaagtcactgaccctcgtcccgcccccgccattccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggtgagcatgcgaaggttggaggccgcgccccttgctgaggcgcagctggctgctcttttcgggccggcatacgcgcgcagccgcagctgaggtcaccccgctgaggtggtggggaggggaatggttattcttgaggcaccgcatctcttgaggaggaaagagccggaaacacctggtctctcaagcaggtacagcccgcttctccccagcaccccggtgtgggcttcccaaggtcctgcctgagaggagaggccaggctgggctgctgattgcaaaactgggtgaaagttctccctgacccttatctgtgggcatcgattgttactcttcctgcaattaactctcttagatctttgcctagtcttttaaaggactgaaaagccgcgaggggcgggggctggaattcgccccctgaagcgcagagatgtcagctcctgaaaagtcattcggtcgttcagtgtttgtttccctctgtcgtaagattttaagttcgtgagaggaccttctttaaagagggcgtctgataagagcccttccccgttggagtttgtatgcttagcaagtcacaatctgttctcga

SEQ ID NO: 117168 - DNA, 1042 bp, Homo sapiens
ggattgggccgagcctatgccctggcttttgcagaaagaggagcgttagttgttggtaagttggtgtgtttttctttttaatctgtagctgataactgaaatacaatctttacaagctatctttgtctttctatcaaataatttgtcaaggttgaattttattattaatttttacttttgccagaaggtttttaccccgactaaggctgtctgtctaaattacttttaaaagggaaccagtttcacagaattcccagcttaacagaattgataacgaagggctagggggtaggcatgctggcttgtggctataactccagtgactcaggaggctgaggtgggaggatcgcttgagaccaggagttcgagcctgcagagaactatgattataccactgcactccaatctgggtgatggcgcaaaaaaaaccctgtttctcacagaaaagggtggggacaagcatttattgtataaaaggaaattcttgacttcagtaaattgtaggctgtaattttttgagacaggaggtttgtctactggtgcgagatcaaaagagagcccctgtaagtgtattgataaaagtaagaaataactgaattttgagaactggaagtttggagtcaaggaatctaaagtatgggtttcttgactctttcatcaaaacttttcagctggaagtgttttaaaaaaatttaattgagggggcagttacatgagtttttgtttgtggaggggtcagatggaagatactgtattgaagaatcctaaaggtgggaggttttagtaatctgcatggtttggactgatctaatgtgcttgacagttggtgtggacacagaaacgaatttgtccacaactgagcctttctggggaataactaaatgggtgctaagtgcagggggatatgtaggacccagtacttattagcatatttcctgggataaaactgtgggcccacaatgatcttctaatttcagctttctgacatcttaacgaggcaatacagagagacgaattttcatcagtttgttcagggagacac

SEQ ID NO: 117169 - DNA, 1050 bp, Homo sapiens
tcgtaagaagctaatgacagtacacatagttgcttttgataggtgcagtagtaccaaaacagagttagagttgcaatgttatcaaattatggaaaagatgatattgagagattgattttctttttaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaaggtaagtaagcaagcttatatttttcagtgctgttacttacaaacctatgtggaatgagctttacaaaagtatttaattttctgaatacttaaaaattattatttttttcaatttcgaaagcattatctgtaaattgtgttcattgtggaaaatttagaaaagcacaaaggaaaaaataaaaaatgacccataattctaccacatcgataaaaactttcattctttttctctgcatattcataattttttttttgttttacacaatggggtaatattcttcctgtttcataataattattgtaaaaatacattattttttagagcagttctagatttacagaaaaattgtacagagaattcttctatactttacctcccacagtttcccctgttattaacatctttggtcagagtggtatatttattacaattgatgaaccagtatggagccgttatgataagctaaagttcgtcgtttacactgggattcaccctttgtgttgtacaaatgtatgggttttcacaaatgcataaagttatgtatccactgttataatgtcatgcagaatggttttactgccctaaaaatcccctgtgcttcacctgtttgtctctccccttttcttcctgaattctcagggattgaagctcatttctttttatttttcagtaatattccgtggtatgaatgtactacaatttgtttattcatacacctattgggggagatcttgg

SEQ ID NO: 117170 - DNA, 1052 bp, Homo sapiens
ccctttcaagaccctatctattcttcctgtaggtagtccttattcaggacttgtcctgttttattcagaactggctattccttcagacagcatatattgataatcatcctcccatgtctttgacttcccacatgctcgttcttgctgtttcagcagagaagtgagtgggagggagagctgttttggaaaaagatgggttgagcctattctagagcagcaggcaagttctccaattttcccatgtaattattttcttccatgaagcaggagacgtcaaggggagtgaggaatcacattggacaacttactgggacagaaattgcagctgatctatgggaattattccgctttagcccaatagttattttagatagtaaaattattttaaatagttattttaaataactatttaaattaaatattttaaatagttaaatagtaaatttacttggcttcaaccctctcctaccccatctctcaaaccttgtgaactccaaatttgagaattgctttatggcattaaaaaaattgtgaaaatttctgtgtctcagcttatatttagttggctatgggtatcaaaattaatccaattaactgaatcagttaaaaggttgctatctctggagggcattgctgtagtagtataatatttttagaattaatggtcattttctctaattgttaaagtggcttatattcttgaagcatttttgagtgtcttattgcattcatttaaaaaaggaacataaggttttgcagtaaaagctatatctggcactttatcaataggaaagctctagacacaggcatttctgtcattcccaaagacaaatcttcagtttaacaatcatcagtgtctgactattatgtttaaataaggttattagtagttgtttatacctctggtttttaaaaagaaaacaatgttaaaaattctccttatgcagcagtaatggtttttatgaatctgtgcattctaactgacttcttgtggaaatagaggtagagcaaagagaaggtaagggagaattatttggggccacctgttacac

SEQ ID NO: 117171 - DNA, 1109 bp, Homo sapiens
atcacatgattaagaagaagccaaacagagatagataacttggagagaaatgtgagcctgtggatggtaaaatgtcacttgcgagtaacagtatccataggcagaacctgtggagcaagaaagtttgctaataaaattttgtttaccctaacataggttcttcatggagagcagtacttagagttatataaaccacttcccagagcaggtgagttattgatatactaattccataataccatacttttatttccagattaaccttttaaacaacatcagtgtgttaaactggtatagagtgacctaatgaaacatatcacaaattgttatgcacatgtgagccattagagtagactgatgttaactagtatctgttttggtcaccttaagctttgtcctttaatagtcttaaaaatttatttcataatttatctctgttgatgtatgtgttattaacaactgaaaggaacgttcgtgtatgtgctctagacttagtgattgcatataatctgttatggttcttatgattattgttcttttctcaggtatttatctttatactgattttcataaagcaaacaatgttaaaagatacagaatttcttgtaattcatttttttctttttttttggagaaaataaaaacaagtctttaataatcatttttacttttctcaaaaatatcttacttgtttagtaaatctcttttaatttttttcactataattggatatatttatttctctactttgatgtttgaatgttgtctaattatatactggtcatataaggtggtagaatacaaaaaggaatgttttgttaatatttgtcatttcatgttatacaatgtagaggtcggcaagtagctagaatcctacttgaatatttttcttaaacctttttatttttctaaaaaatgtatgagatttttattgcttgaagctgaatagctttatttcagtgtaagtattatagcataaggtttcaaaacagctctttttatgtgaaacagtacactttgtggtgattgtgcattgatcaaatatctgctggatacccagtatttgcaaggcacagtattaggtagtaggtaattttctaacctgtctg

SEQ ID NO: 117172 - DNA, 1152 bp, Homo sapiens
tttcttcaaaatacgtagaagataagctttggcagtggtcattattaattgaacaatgcttattttgtgttatgattgaatgggtcaaacatctagtcagttggcttttgtcatttctcataatgaaccttttttgtcttcgtttaactctgttatctatagaaagcaatgctatcattgaaataatgtgagatatttcatattaatacgatttcttcagaacactgtattcatttataggaatgatatatgtgggataagaatactagtactaatcttagaaacttggttgtttgtattgttgctataatctttaaaaaataactaacatttattgaggtattatttatcaaagataataccttgtaagctttatcccacctttttccaactactctgtgagagtaagttctgttagcctctaaatgtttctaaatgagcaattgaggcttcgaatggtgaagaaacttgcccattaatggtagagctggctttgaatctagatctgactagtaccaaatcccatgatctagcatgtgtttgataatttcctgtcacaatttcaggccctgaaatgtgtttttctttcatttgtatacatcatgatatatatttgctaacattttattatataaagtgcttttaaaaaattatcatttacttctcttagcatctcatatgggaccttgcaagtcaccagtattcaataattgtttatttgatttcattatattaagaagacatgtaaaggaaagaatattgagtcattgggaaagtaaataatctatagaaccattatatggagtcatggggaaggaaaagagcttattggaattatacaaagcatattaaaaagaatgatgctttcttatgaattatagaatattttctataaataaaacttgttaaaaataatcagtagtttaaaagtaataaaagatcagtaattttaaaaagatatggctagtctttacacagcatttcagtagtctttggaaaacagcacagcaattaatgagaaagggaagaagtcttgaggctgacctaaaagggtcggtcaagtttacagatacattaaatacacttactattagctgtttggtgaatttcttcctttcagtgctggtaagtgctttctaacttggaagaatg

SEQ ID NO: 117173 - DNA, 1181 bp, Homo sapiens
gtctgtctcaaaaaaaaaaaaaaaaaacaaaaaacaaaaaaaacccaaaacttaagttttagagctgtaaagaaattcagacttcatgtaatttagtattattttataaataaaaaaaatgagaccatagaagttgattaatttgatcaggatctttctaaagttagctaaaacataggttgtccagttcctatttttcttttaaaatattatttctgaattctaataaaagtaaaatcctgttattaagaggactgaggttctgagtgatgtatacaaataagaaagtatgaaagacacattgtatgaagaaaactgacttatgtacagagttttaaaaaatcttttttttgcacatgttttataatcacttttctccatgagttatttttacagaacttttaaagtttattttgttgtcgttgttagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggagtaagttatagccctgattttataatattctaaggtaattcttagtaaataaagtatctttttaacaattaaagacctttgaaggtaggtaaatcttacctttttaggtaagttttttttcttttcccgtgggaatgaataggtttgggaatgtccaaaggggggtgtgtgtgtgtgtgtgtgtgtgtgtgtttgtgtgtgtgtgtaagagatgtagggaatcaattgaaatgaaaataacctgttttaagatttcattgtaatccttgaaagtagtttaaacagtcatcttggctatatgcatctttatctaatcttcagcttcttaaacataaggcaaattcatcaagtcaaaatgaagtatttttaagtcatgatatttgacagttacaaaattattttattcataccaaaacaataatttggattatcttaattatcaatataaaatcactattttctagatatatacagattatggtcaaaggtgtttgtttatctaatctagggaaattatctattagagtgccatgcacccaatataaaacatcttgccgcagaaagaaagcagtcatatttcttttcactgatgtggaggtccaaagagaccctg

SEQ ID NO: 117174 - DNA, 1054 bp, Homo sapiens
gttgttgcattgcagagtgaaaggaagacctcaattaaggaaatagtaataatggagaggagagggcctatgtggaactattgctaagattgaattggctaacttagctactgattatgtctaaaaatcaagaggaatgagaaagagtcaaaactaatactgtggttttgagcttgtgtgcttgaggatgttgactgcattactagaagtatgaaacaggtagaggagggaggtttgggagagaagaaggtaagttgtggtaccaacactgtagccaaccaagatctggactagattgtggggactgtgggcctggaatttaagagtaacttcatagctagaggcagagagttggaaagcatatttgaggaattagtagttggaaccaagaacgttggcttcattcaccaccttgcttcatgacatgcaggaagaaaatggaaggaaaatctttgttggtcctgctgttcctgttcactttatggaataatggttctaaaatttccatttgtctgtaaacaaaatgaatatcatagaatttggcccacaggttttaaatatgcaatttgtcagtattttaggcaaagacaatcctatactttcaaatagaaatatattgtttgtatgtatccaatacctgtaaaataatattactgaaactttttataaagatttatttccatgtgttgaatacaatgttgctgagcaaaatctgttttgttttctttaggatgataggtttaagctggttagcattgagcagtttggttgttttcctcctgaatttaaatttggtttcctttcacatgtttgtaatcatttccattataggaacataagtggaatttacatttagttggcaagatactatggatttttgtttgaatattgtttttgtttgaataaataataaaatgagccgagttttaaaaggcacgtactataattagttgtgtagagttaagtctgcatatctggactaaatccaagcctccattatgtactatatatgtactgtatgatgatgtgactggatgaggatgttctttgactg

SEQ ID NO: 117175 - DNA, 1062 bp, Homo sapiens
aacacaccagcttttgcttggtaatgatgaattaatactctcttatcacatgtcaaactactaagctaagcactctacacattactttatttaacacgcacaacagagttgtgttatttagggactgttgttatgccttttatagatgaggagattgaaactcacagaggccacgtatctaagcattttctcaagctcaccttgctattaaggggcacagcctggattttaactcaggcattctgatgctacagctgtgatctattcaacattgtgttatattctctaatttgtcatttcgtggctttctagttcatgaaactgtagtaaatattttaaatctgcttttagaagttctgaattgaatatttttattaggaatacagtgtagccttttattaatatggtctcaaattgtaagaacataaagtaaagccagaaacgtaggttgaaacagaactcccagatccatgagttcagataaattattgtatagttttctaaaatacacaggaatgatttttcttttttttagatgtctaaaaaaatgtgctatctgtagttattaaattgtcattgctaaataaaggttgcctttgttgtccagaattattagctcaattgtattcagtctgaataatcttaaaaaaaaaaaaaagaaataaactataacatggtaacagttggcactctttttccctcctctccttgcaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgccc

SEQ ID NO: 117176 - DNA, 1088 bp, Homo sapiens
ttgaatgagactgtatgctcagtacttcgtttcctcttccagttagtgtcctatttctttgcttccgtttacagcagaacttcaataaagagctgtttatacttgctatcctcaattcttttttctgctttttcagtccattctcatcagacatttgttctcaccaccgtcacttccatagtgtgcggtgtcgacaaaataccatttctaccacttatccccctctggtttctgcttctattcaacaaaataatgtcatccaaagtcttaaagtaagctggaaacataaggatcgagtaaggacctcacagttagatacagaaaggaaattctttatcccgtttatgagcaagtcactgtttagattacacacagtagtgtaagggatatttcatattttctagtaacctatactcaagtaagagagctaagcaacactcacctgtgttacagaacaatgtgtgaagaatgcctccaaaacctagtaatgcagaaaagtttccaaaggcggcaaaatgaaatgggtgatacttgtccttggtctttagggatcttgcacaggaattgcagtcagtgattcaggaaaggggaagaagtcattccaggcagagggactggtataagcaggaaagggctagtagcagaagaacccgtgggtaatacagggataagtaactcttcactgatgggaacttgtgagatgaagaaggaaataaaactgaaatatattctctgctgccagattaacgagtcaggatttcagttgacagtggagtacaggatatgctgaagagggaagctgaaagtagttactatttactcataaacatacattaagcttgtgctttgtgccagaaagcgtttggtgggctattttgcattaggttacctgtgatgtatgaaagatcagagtaatgtccctgggatttcaaccccagggagcttcatatcaaattttgtaatgactttgatgatggaaatgacaggggatgagtcattaaagactcttttcacacttagctaacttttgttcttcttcaaaacagttaaaatttgacctttaggaaaccttcattaactcctctcgg

SEQ ID NO: 117177 - DNA, 1002 bp, Homo sapiens
gcctgggcgacatggtgaaaccccgtctctacaaaaaatacagaaaaattagccaaacatggtagtacgtacctgtagtcccagctacttgggaggctaaggtgggaagatggcttgagcccgggagggggacggaggttgtgatgagtcgagatcacacaactactctcctgcctgggcaatagagccagaccttgtttcgaacaaagacaagaaacccaataattttgttaactatgaattacttcaaacgtatggaaaataatgtaacagatcttcttataatctacttcctatgtttaggaaatgtcagtgttttgctatatcttaatatttaattccacccatcttcttttctacctcagaggtaattattcctcttggtgtgtgtttttctcttatatatttttcacaattttagtaacatacgtatctatacccagtgtatagtattgtgttgtatacttttaaactgcatattgttttacaaattataaattgtagtagtctccctttatccatgggggttatgttccaagacccccagtgtatgcttaaaacctcagatagtaccaaactctgtcattattattattattattattattattattattattttctgtacagtaatgggcaggtaacggatacagcagaaatacactggatgtatgatttacatcccatgtgggatggagtagtacagtgagagatttcattatgctactcagagtggtgcacaatttaaaatttatgagttatttatatttggaattttggctaaccgcaggtaactgaaactgctgacaacaaaattgttggtgggggggactactgtattttattcaccaaatgttacttttcaggttttatccatgtaatacctacagatcttttgcattgatttaaaatactacattgctatatgctttatttatatacgttattttctctctcatgctacattttgttaaaatgatgcaatgaataatcttgtgtgta

SEQ ID NO: 117178 - DNA, 1037 bp, Homo sapiens
gtatattatcatctcatgcacctgcaaagttcagcaattagaaacatttgttaatatattttaatgtgcagttcatcgcttgctattagtttattttatgaataacttaactttaaaaaatgtatcatgacactgtataattctgtttatgcaacgtggccgttctttttttttttccttaagccttgtctgtgtgccttttcatttatgcaaagtatgatttttttttctaaatgggtctttgaaacaaattcctaagaggttaacttatctagcaggaaagaaacctgattactgtgcatttttaaaatatattatgcatttgaaacagtgaatagacagtgtgtattgctacatttctggtcatttatttaaccaatatttattggacacatactgtgtgccatgcactatgttaggtgttaagatgcagtgttgaataaaaccagatacttgatcaacttcacagaatttataacctactggggaaagacacattaaaaataatcagattaaaagtaaagtattaagttaccaattaaaggtacttgtgaccctctcagggaagccagaaaagacttcacagaaatgacaattggtccaaaatcaggatgaatagatgttaacaagttgacatgggaaaaaagaacattctgaccagtggaaatggtaggtgtaaaggctttgtagtagacgtgagcatggtgaggacaggggactgaaaggccaatgtgattcttctgagagcaattggacaccgttaaagagagttacttaaaggtacgacattggatatatactttaaaaaattttattgcgatggcattgtggataactgattggagagaggcaagaagaacaggtgtggagaaaccggttaacagtaactcagccaagattgcaaaaaggtcaagatagggaaaaaagtggtacaatttgaaagataattaggatttaagattaataggacttggagattcattgtgaaggattaagagagctacctctaaagacctttaggtgtataactaaaagga

SEQ ID NO: 117179 - DNA, 1391 bp, Homo sapiens
gcctatagctctgctttttgttcttagagttaaacattgttctccagtagggtgatttaaattatgtatttgtatgtgtgtgcatgtgtgtgtggggggggggcatgtatgtttacatgcacatatgcttgcacacaatgcccttgtgtttgtggatcttcttttaaaattatacttgaaataatttgttactaaaaataatgaaagatttgttttataaatatgtaaaataaattgctaattaaaagctaatttgctaattaaaatagtcattcaacaaattaaattcctaccattatgagtgaggctttgttttaacggtgggaatacaaagatgaatatgacaggctgtgatttcagggaactcactgtttattatattccaagcccagcaagatataagtgtaacattaaaatacttatctcgggtaatactgtgactttttaaaaaattataacttgtttttcttaagctctcagacacatttttagactgttgatttattccttcactatttatggaagaggtttgatttcatcaagctacgaatatagttagacaataaaagtagttaaagtggtagactaagtctcaaatattaagactcaaaataaagtgtgtttgttcctgaagtaagtgcctttcttctaattattgctttattcttcaaaggttgtgaagatgagaaaagaagtgaagagaattcgagttttagttatccgaaaacttgtcaggagtgttggccgactgaagtcaaaaaagttagtcatttaaagtaatgatcttgtgactaataaaatgtcaaaagttgtttttatttgatactttaaaatgtttagggtgggatatagagaagtaattaaatgtcttatacaccatttttgttttgtatgcggagatgatgtgagtgagatagaatgtgctgtgtcagcatgcccttctatggtttggaccatcattgctcaagatacaggatgaatttttttgctgcttttgcaaaactctcttttggtctttttagaatgaaattcccttgggcttgtgtgttttgtgttatcagaagttattttaagatactgatacagcttaacaaatctagtaataccttaagaatcagttttgaagattttatatcacattttttcttgaattgctaagtaatttgaaatcttcagtaccttatgaaagtgtttattagaacattgtgttccatgtaattttttggaaaaatacaatattttgtattttcagtatcactagtgttagtgaaaaagtattttatttatagttctttttatgatgtaagcatgaatacttagtcttcaagtatgttttgttcctgattaatttcctattctttcataaatatgtcagaatatagcccttcttt

SEQ ID NO: 117180 - DNA, 1330 bp, Homo sapiens
gtcattaatacaatggcaagacagtacttatttttgccattttccaacatatgggtttggttagtaaattgaggtgtgttttgggagtgggggaaatggacagtgtaggatagtggcgtgtttgttatttagagatttattacgcttttctaaaaagaaatgaagtgattatccattacactataagtctaaaattaatgctttgcctggctacatatcgtaatgtattttttgcaggggtactgaagatgcactgttaaaaaaccaaagacgggcgcaaagattgcttgaagaaatccatgccatgaaggtaaggacttgtgtgggtgtgtatgtgtgtatgtttctgagtatcctgttatcctgcattttgtttgtgtgtggtattgcttatttgaatattcccgagagttgcgtaagacatcttgtatcagtctgtttggtgaagaatgtagcacatttagaaaattgtaacatttaagcttgcatttttctgtttttgactgaatttgttaaagtgctaggctaatttgagtcaaaattgtgccaaactaaattcatctatgtttaataatgcctcctgcctcaggtttttatttttactgtaactttagcacgaagtcagttcaagaattaaagtcttcatgctatttgggaatgtggatggtgatattggtggctgacatcatgctttccttgttgccagctcaataaatttttatgtattggtatcggcattttattcagttctgtagtaacttcaaataaaattagtgttagaccaatgtgatcccatatttttgttttttttttcagtcagactcttcactagcataatttttaggtcttcttgctgctcttactttgaggaaactttcatttaccaaatgacatgacattaaatgtctgggagactgttttactgtagaacttaaaaacaacatttggtcccagcaattttcttaattgcagggtcattttgcatgcatgtttgcctattatattttggtataactttcaagttttgaattaagtaaaagagaaataaaactctctaactattttaattgagttaagttatcaaagattctcagcctttcttccttttaaacggatagtaaagtgtttaataggacaaagttatcccagttaatctgaataaaaacatctaggaaacgactctttgatatgaagtatatttgtttcttgtgttcttccttccctctgctgcacactattataaaattcatggaatccatctgatataacttttatttctcaaggttataattccctttttattcagtccttcaggaaaaaaaagtcttct

SEQ ID NO: 117181 - DNA, 1050 bp, Homo sapiens
ttactcaattaattgttcctaacacctagtaatgtgtctgatacatagtgaacgctgcttggctagctgactgagtgacttctactgcaattttttttttttacatgttggcacgtttacagtgttgaggttgttctgagtctctaaagataaatggaatactatggaactgttactaagaagaatctgtaatcagaagcttttctttttgcttattaagtatcagaaacaggaggaaaaaggttcttcattttatacagtcaccttagccaatgccctgagaccatataacttcaaatttaatgttttaaaaggtagaacttttgtttctaaaagagcaaacaagatgccctggtttgttagccttctgtacttaactgtgacctttaaaattataaacaggaaatcatagcgctattttaaaagatcagtatataatgctctcctcacactcatgaaacagcatttagtaacagatcatcatactgaaatcccagtttgctttctggcatgtagtttctacagctttaagttactattttgtataggtcatattcctgaaattcttaacacttttgcatttttaatatataggagtcatgattttcattggaggccatatttatataaagtctatgattgccttaaaatatttttgtcttctaaataagaacatatgtgaaaaataacgatagtatgtattgtctgtttttgaaccgcttgcttctgtttgaaaacaaagagcaagttgcaggcctttgttggcaaaagagatgaaaatgctattactatttactgagtcatagtatacacctaagttttaaataaggaactgattctaaggagctgattctggaattcttcacctagataagcctacttcagaggctactgagtgtataaacaagattcagcagtatgaagggagaaagcagtataacatggctttttttttaatgtttcccatttatttttgttttgttttgattagatttttttgttttgtaattctggaaatttgaacctaaaccttagccaaacatttcctaa

SEQ ID NO: 117182 - DNA, 1088 bp, Homo sapiens
ccaaatgcttttctgtttacaataaatacccatatacccaaataaaaattttccattaaaaggtaaggtgttttcccttttttatttaatttatttgaaatggaagaaactggaggtacatgaaaaccacagtttccagagaattttccatggcaaacattatgtcaactttaaataaggaaagctgtggtttccttcatacctcccgatattgggaagactttttcatgcaggtgtaaaaactatttgttcattgagattacttagtagccttttaagcttcaaaataaatttatttaagatgcatcagtgtatttttattccctctataaatctccattttctatctcacctatgaagcctatcacattctgccttgtattagttatttgtgcatttgtcttagccttttaaattagagcaacattgtgagcttcaaaagttgatctgtgtgtcctcatgtgtaagacagtgtcttcacataataataagagttcagtaaatataaagagggaagaagttaagtgaggaaggaagatgggcaagagagaaatgaggagggaaagagtctgttctactcattcttgtgagtttctgcagtaacccagtgcagtaagcaaggtgcaaatattatctcagtgcaacagagacccaaaacactgccaagggaataaacctgagcccatctgcttcaccagctttcttttttaatgcttatatttcatttattttcaaaaacacatgaagggagctttacgcaatttatagtgtaaaaaacatctggagttgggtcatgaaatgtgaaagttatctcagagttgaaaacttgttgagaatactagaccgaattcagaaaacagattttgagttctagcttgttcctaattggctaggtaatcttgaaatcaagcctagaaggttagtctaattgattgataaaatctttggtccatttcccctttagatcttgttgaaatttgaattttaaaagttaaatgtaggattttctaagaataaaattcttaagaataaaattaaagatttaaaatgaaaattaggaataaaattagaagctaaaaatattaaat

SEQ ID NO: 117183 - DNA, 1050 bp, Homo sapiens
ggagttatgaagaacagtaaaaacatcacagaatacaaataaaagggaatggcaactttaatttatataataataatgcattattataaactgtgctttcagacataaaattcagtatcatgtgacaaaaaaatttcattttatagatatattttataataaacatatataaaattatgttcctaagtggcgaaaccaaaactaatgagttatgtcaatattttaaaaaaactattcaactttatcttgtatatattatatataaaaagatatatattacgtattatacgttcacatattagaatttactaaacaatacagatttggtttttcttcagagatcacactttctgtattttcagacaccttccacactggtaaatatttgaaagaaacttatatttataatagaacctcaagagttaaaataagtgaatagccattatccaaagtctacaaatacattaagtacatggcttaaaagtcatttaattcataccttttagcacatctatctttttcttcagaagaggatgtactgctagtctggcaattgctctttcagttgcagtagaatctggctgcaaatttaaaaatataataaacgtatgggaatgaaataaaaatgacactattgaaagtgaataaaataaaatctatcatagtctttaaaattagagttggagaatagaactagttaatattctccttagataagatatctgtataatcaatccatgctaaagacaaagatcatcctgacaaaaatattactgcctttgaacaactaaaattatcacttaatcattaataaatattctttggatacgatacttaatattctcagaattgtgataagcaccatgtgtaacatcaaaaaaagaacatagtttttactatcaaagagcttgaacaatctaattaagaagactaaattaatatcaaagaatcaaataacatattagtgctaaactgggtgagactactgtaatacttgaagttccatttaacagagacctagaaattatctaacgctctatatttctattt

SEQ ID NO: 117184 - DNA, 1714 bp, Homo sapiens
cgccacttaggaacataattttatatatgtttattataaaatatatctataaaatgaaatttttttgtcacatgatactgaattttatgtctgaaagcacagtttataataatgcattattattatataaattaaagttgccattcccttttatttgtattctgtgatgtttttactgttcttcataactccaagacatgaagaaaacattttcttttcattttcacaatttaaaatgaatacgtctgagcatatcttatgtttggtttttaagaagtcgaaagatttctttgtgaattcagaccgagtatatgtatttaatatcaattccaactgccctcttaaatcttttcaaataattttttaaaatactgtcctaaaacagtcatgttttatatgtttcagtgctaaaatgagtgatgcactgtttctcttgcagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaagaaaccaaaatattggcgaagaaaccaatacataattcaaaggaaaaaatagcaaagatggaacatggacctaaagcagtgactattgcaaattctccatcaaagccttcagaaaaggattctgtagtttcccttgagtcccagaagacacctgctgacccaaaactgaaaactctaagtcaaaccaaaaaaaacaaaggatctgatagctcactctctggtaacagtgatggcggagaagaattttgtgaagaggagaaggaatattttgatgatagcacagaagaaaggttttacaagcagtcttccatgtctgaagatagtgatagcggtgacgacttcttcattgggaaagtcagacggacacgaaagaaggaaagtagttgtcattcttcagttaaggaacaaaaaccactagaaaaagtgtttcttaaagaagatacaggtgaaactcatggggatacaagaaatgacaaaatcaagccaagtacagaaaccagaaagttagaatcagtgtttttccactctttatctggatctaaaagctctagaaggtaagattctttttctattctgaaataatcattagttcttttttaaaaagctataaatgtctacttgtccatacatgaagagactataattctagtttgtacaacccatcctgtttttagacatggccctctccaaggttgtagtggggtattaggtacagatacacatatggcaatgccacatttgcctagtttcatcagaaaatgagatgttatagccaaataatatgccagctaatttaaattttattccttcacttatcaaagttttgaaactttgaaatcttttttgatgaaaaacttttgaaaatgtttcatgtatctttctaaacagaactttctgaaaagaatatggtgttttttcttgatgatccaggaccattattgtaaacatcagtcattttactgtctagtaccatttcagtatataaggctgcttgcccttaaactgagtttctccatactgctttttatttgatgatgttgctgtctccatctctgttgctcaccacttttcatagctgttctgttataaaacagtaagtttaactttatttgta

SEQ ID NO: 117185 - DNA, 1032 bp, Homo sapiens
ttctgttgcccagactagagtacaatattgcaatcacagctcactgcagcctcaaactcctgggctcaagtgatcctcccacctctgcctcccaaagggctgggactgcaggtgcatgcactaccatgcccagctttctcaccccaggctctgcagctattacttaaactcgtatttgaataagtctcttggggagaattatagaatgtttgtttttgtatttttttttaaagtaaattcaacttacgcttatataagcctttcacaaatccaatatgtacttaaattgatttttaataatatccctcagactgtttcccttatgaagtaatttggggattttagtgatctcatattttctctttagtgcttatcatgaaatgtgcttcactggttcagctctgttgtttccttaaacataaatgtcaatatatatttaaaataataatggaaacataggaaatcagctatttaaaccagatcacccttgttaaaaatcattcttgttagcaaactaaaatagtaacttttattatggatgtacagataaatattaattttattatagttttaagtacttgtgatcatgtactttttgattctaaaatagttgtctaggacaattttgggattcttaattatattttagttaagaaaattgtttaaatatagcaatacaaccaataatttgttttatgtttcactgcatataaatatttccattaaatcaagaatgtatattatctagtttttactatacttattttaaaatttttgaggaatcatagattctaatttttaagaacaaattctgaaggtggtaggattaaaagaatatttccactgatggctaagcaaagaagttgtaagatgactcactgaggaagggactgctttatacatcacagtactgctatttaaaaggaaaacagaaatttttaaatcccttcaaatgtttcacttttgctatgctgggaaaaattttgaagttcttggtaaactgaataatgctaatccatgtttcctgcacat

SEQ ID NO: 117186 - DNA, 1381 bp, Homo sapiens
ggtgcttgtacttccctagatctctggctgcttggttttccgactaccacatctctttgttggattcaagaaaatttatgattttgtaattttttctattagaatttttagagtggaaataatgatcattccagcttactatattctatgccccagtttcatttttatggtgtcttttgtgctgtataagtgtttttatgtaaccaaatttatcaatcacttcaatttgccatctgtgttttatcttatgtaagagagcctacccttgttggacaatgcaatctaccataagccttgagcttccacaggttctcgctaagtataccaagacctcaaagccctgttcaccttttacctgggtcatttttcaggattttatttgcactgagcaagcttgaggaatgagtaacatctcctccaggacaaaaatcagtcaagttcaatactcctctcctacagtgaatctacaggtatcaaacaaacgatggtcctttgtgttttccccataggacttgggagaatacaagtatacaggaaggggttaactcagctggccagggttgctcaaactctgcacgttcccaagatatgcttgtcttgcagactggttcttggtcagctcctgggagatgagctctgaactaacaattctttctgataagagcatttttgtatgcataaggccttggaccttctgataccactttgatcagctagttttatctaagtgatttatggtgagtactcatctgtgctctgggagactggagtctgaatagctgaggtcaatcatacaggtgatttatatctatgtgactgacccccccattaaaaaccatagaccccaaggatcaggtgagcatcctagttggcaacattttgcacaagttgtcacacattgtgctgggagaaataagtacatcctgagaaaggcctgtctttgggactggctcttggacagctcctggaagatgacctctgagccttttgcgaacgtagtaccgatttgatcagacagtttatgttaacaatgtgatttatggtgaacatttctttctctgggaggctagagatggagtagctgagttcagtcctgtaagtgatttacgcctatgtgattgaccctgtgtaaaaaccttgagcaccaaggctcaatgtgagcttccctggttgacaacattagtacatgttttcacacatcatttttggagtgtgtccatatgacccaactgggagaggacacctggaagcttgcccctgcccctgttttgtcctaggttttgccccatgtaccttttccctttgctgattgtaatctatatcctttaatctgtgataaacgatgagtatgaatatagcagcattttctgactcctgtgag

SEQ ID NO: 117187 - DNA, 1386 bp, Homo sapiens
gcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaattttgacgatttttttttttcaattaggaagctaaaaatactactttattccttatatgaacattcatccccctcctggcacctctaaacacacccaaataactcacaagtactgatttaacactctgtattactgaacttctttgaactattttgaactttgaatctcttctctgaataactgccgaaactcaaagataataattagttgatgaaggttatcaattaataaaataacacagaccagtcttaccaaactctaaatacattttaaaaaataggaactggcaatgataaaaagaatgttgagtactgacaggagattggcttttacactaaaaaagacagaaaatggactaaataggaacataatttcagagtttatgagtcagtttacaatatgccatattagcgatctcatgatgattcagaccacagtctgggttaaagatgtcttgacctctgaggctagcataacatatatgagaatacaacttgcctatttccagaaaatctgtatatttttatagaataactttatttacaatttctatcatccaattactcactaggcattatttgtagtactttttttctctttgaaatctcataggatag

SEQ ID NO: 117188 - DNA, 1417 bp, Homo sapiens
tgcctctaaatgtgaagagtgtaggcatcaggcatctctgctgttgacatagtcactttcttcaaaccattattaaaatgatgtactactgcataatttcacaacatgattgctgcttaggtggagggaaactgttgcataaagtttttaaaaggttgactttaaatttgtctgttgtactcattcattatattatcaggttaataatttgtcttattttgtcttcttaatctaggtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatac

SEQ ID NO: 117189 - DNA, 1101 bp, Homo sapiens
caggatttatttatatcaggatttgcaagcacccttattgcatctgggtagatgatatggtctggctctgtgtccccacccaaatctcatcttgaattgtgattcccacaattcccgtgtgttgtgagcagaatctggtgggaggtgattgaattatggaggtgggtctttcctgcattgttcttgtaacagtgaatgagtctcacaagacctgatggctatttcaagggggagtttccctgcacaagctctcttctcttgtctgccaccctgtgagacatgcctttcaccttccaaggttgtgaggcttccccagccacatggaactgtaagtccagtaaaactctttctattgtaaattggccagtctcgggtatgtctttatcagcagcatgaaaacggatgaatatagtagatattgtgaaaattaagactcagaaacccatgaaattattatctgtttcagagtctcattcaaaatcatttggaactcaaaaatccaaaagcttacattggtctgtaatttatgtaccacatcctaggactaatgtttctctaagtgaagagtcactgtgtttatattgttctgcatttgcagcacctgccttgctgatggaataagaaacttccatgctatagaaattaggcctagaatatggatcgactatgtctttgatcaacagactcagatctctaacctgtgttggtcttaggtataggaagattaattagataggaataagtgtgacttggtcagtaagtattggtgatctaattacaccctgggacagggacagaattgaaactacagttccacatcttggttattgtgctggttactcaaactcttggtagtcatgttcaggctcatgaggggttacagagagattgatgcattacagttcacaacaaagaaagtcatcttatggctgatgatgtggggccaacacctccatacaacaatttgtagggcattctgacactattaattcagcacgaaatcagctttcccaaccaagtcttctatttccaactcataggaatctcaagtgtcccagcttcccttgctttgtagggcttccttctttagggaatgaaaag

SEQ ID NO: 117190 - DNA, 1035 bp, Homo sapiens
cagtcgttcgggtgagcgaagatggcggccgagagggaacctcctccgctgggggacgggaagcccaccgactttgaggatctggaggacggagaggacctgttcaccagcactgtctccaccctagaggtgagaccgcgtcgctgcgggtgctgcgctgcgtagctgccgcgcgtctcacctttcccctgccccgacttgtccctccccatcccccgtgtttgcaaggaccgtcttggggtgacacctgtgacgcgagccccacctccggtgcctgtcagagggatgtgcttgggctgagcgcagggcctcctcaggagagcagcctgcggcccgcgggtgccgacctaatcctcagaggggccagaaccgaaccgagcattgcagcggcgctttcccagctcagctggccttcctcggtgtctcttgcacgtcctcctcttcaagccggagaagggcttgctctgcatcccagtaaacctccaccgagctcttttgaaggggtgctcgcttttcctttccagagggagggtgtgccgctgccaggggagcgcaatgaagtgagcgctgaggggccgagggtctgtggggaacgaatgggtgcactttcccaggaatggcccttcacggactgctggttcctcttgagggagctgcttctgatttggactgttaaataggtaaatgcatttgcctctttttgtttgtctttagttcctagacttttaaaaggtcatagtatttataaaatgtaaagctgaaggcaggattagtccaggaaactgctgttgtgtgtgtgtgtgttttcgaagttaccaagggagaaatagaaacagatctccactcctttttcctcttttctcgcttgatcagcgatctctgaagctgtgtgttcctgtttttgtcaaaggaagcaccctctataaacttaactgtattgggccctccttatatccagttccatttgaattgctttgcgtttgatgagagcacccacacctcacagcctaattttaagtgtgtgtatgtgaatta

SEQ ID NO: 117191 - DNA, 1057 bp, Homo sapiens
caacccttgcttctcaagtagctaagacttcagacatgtgccactatacctggctaatttattcatgttttgttgagatgggatcttgctatgttgcccaggctggtcttgaactcctggcctcaaacagtcctcccacctgggtctcccaaagtattgggattacaggcgtgagccactgagcccagccagaaaaatcttcatagtgttttattctacctagcagtctatactaaattctgtgaatcaaatatggtgaatatcagtgtttgttttaaaaaaagagagagatgggaactaaagaacaataaacatagtcatctgtctcctttgttaacccaaaaatagaaacattttttatgctttagctttcatcttaaactcagctgtatttcataatgacatcattaagtgactgaagacctaatctgatcatttttgtatgaatgaatgagtattacacttggttcttatttataatacattttaacaggtgtagcattcctccttctatggaggagtatggttctaggaaactataatagggagcagcgtatgttactgggatggtgaaaactattgtccagtaatgagaaacctatactcgatttgtccctcctataccagaggagagaatatagatattgctgtagtgacattgacataatcagttcatacatgtctcaaagtatgtctccaaggaaaaattaatctttacagttagcacctatgaagcatcttcctgaacctttaggtctgctttaaattaaaccttatgaatttgtaatatattggtttacttaagctaaaaggtgtcatgaagaaaatttaagacagattatatatatatgttgaatctaaatcctacaatttttgaatgaagcagcctgttagtgtaaataacacaaaactcagtatcagtaaagtaaaatgtgattaaaaagtttaaatgactttatctgtactgatttcttaataaagttactatctctcacaatattttgcctgtgagtctgttgccaaagaacagtgcctctttcagattctggggtttttg

SEQ ID NO: 117192 - DNA, 1402 bp, Homo sapiens
ttttatttttgtcatcccaaagtaaagaattttaattattgctcatgagaaatgaaaatgttaattgagcttaaatttattgatttgaaattccattatgtatatcgggttagaaacacattttaatttaccaggagtataaaatacaacagataagggatctttttgatgtaagcttttctgtaaacaaaagcagtatgggtcagaaaactataaacattttatctgttctctcatgttttaagtatttaccaagtaaagatgttaacgtatcatgagatttaattcctcaaaacgtttttgctttttagataagataccagttacaagtttagggctgttaagttcaaattttgagtgtattttaaattatgaagaaatgattatgaaagactttcacagcaatataaagtcatcatgaatctcattcaacttcttcaaagggatgaccaaggtcaaagtgggtaaagaagactcatcatccactgagtttgtagaaaaacggagagcagctcttgaaaggtaattctagacagctatattttattactctcatgtttgtaccttaatataaatgtaattccattatatggcaaaactgtgttttaatgattaaattttttccaaagtaccacttggtggcttttaagactgctttaaacttttttaagaaaattacttctttcaacaaagtactgtataattgttctgtataatttttagtaatcctcatcaatagtctaacaaaataacacttgtttttctattatatgctacaagcaggagcatataatagaaaacatataaagacatgagttagctggggatagaattgtatcataggtagtcaccaagagttactaagaaactgctaaacttggaaaacatggaagttgtgaatggggggaaaaataaaaatttttggatgcaaataatcccactttggtcttatttaggtttctgggaagttataccacactcatgtactgtgttggatagtatagctaattatagttcatctaaattaacttttctgatgagtttttacttagtaagaacattattaaatacagtgagaagtacagtttgtgccccccttgtgtttgtataattgatttttacttgaatgtacaaaagtattagtctttgcttgagttgactatatacagttgaccctccatatctgtgggtgccttatttgtggattcaactaactatggatggaaaatatttgaaaaaaataattacatctatactaaacatgtgcagacatttttggtcattattgtctaaacaatacagcttaacaactgttttcatagtatttccattatattaggtattataagtctagagatgacttaaagtatatgagaggctgtccataggttattatgcaaac

SEQ ID NO: 117193 - DNA, 1026 bp, Homo sapiens
ccctcatcttaagtacccagggacacaaacactgcggaaggccgcagggtcctctgcctaggaaaaccagagacctttgttcacttgtttatctactgaccttccctccactattgtcctatgaccctgccaaatccccctctgcgagaaacacccaagaatgatcaattaaaaaaaaaaaaaaaaaaaaaagaataaaggtagataatggtctgccttgatttcgcttagtctttcctgaaaatgtaaccatgaccctttgagagacctttcaagtcttatttttctatgagtaaatttgaagtatttcagatggcatgcttgataaggaacttaatgaagatttactgtaccaaggacatataatttgattctacctttacgtttcttccaacttggctgcattgcatagtacttaccataccttcatgtactatgaaatgttgaggagagttttaagggatattgaaacttgaccctgtttgtataaagacactttctttactgataaatgctacttgttaaatggtaccatagtggaatttgcaatagtgaaaaaaagaaagaaacagtatagtatgagggaaaagttcattttcaattagaaaaaaatcactgaagaaaatataggcataaaggtgtagaagcaaaggaactggaatggtttcttttaatctaatcttaattcttctgtgcaagctaattttcctgtacacatttattttttaatctgtacaggattctaaaactgcatttttcttgccctttcatatagccagcttttctaaagtgatttttctgtgatatttcttaaactttaaacatcaaacaggtaccatctgtgggatacccaacccagttggatctggtgggttagggaagcatttttcttcgtattattttattcaatagtatgatatttacgtattcgttcaaacttagataatccagatgactaccttgaatgaaaggataaatatctggtattaaaggttaggaagagaaaaggagtggttaaatacccaa

SEQ ID NO: 117194 - DNA, 1389 bp, Homo sapiens
cgttccagcctgtcgacagagtgagactccgtctctaaataaataaataaataaataaataaataaataaaatgtagtgtgtcaggattgtgttcatttcaagcatctaaaaatccaactggcctaaacagttaatgtagattaattaatccactctttcaaatcaaagagtttggagtaggcagctgttcaggattatctaattcattaggaaattctattgcttctttctgatatctgataatacaaccttttctcaccagtctactgactgagtccaaaggtgttaattaactgcagtagcctcctaattggtgtccctgattccattcttggcacttctactttaatacagaactttacagtagtcattctaaaatataaatcagatcattttaacccctccccacgctggccccatgcccccattttactcaataaaagccagagtccttttaatggactacaagactttatatgacctgcacgcctcactctgttacccatttgatctcatatcctccgtgatcactcactctgctttaggccagactaaccttttgctgcttctcaaacaccctaggcattttcctaccttagtcttttcaactgcctgctccctctgcctagaatgctttgttcctaggtatctgcatagctaactcatttccttgttcaagttcgtatgttcaaataacatctttcaagtgaagcctattccagtcattggctttcttctgacctattctatttatattgccaccaaccacatcttaaatacttggtcccatttaccccattgttctgtctttttttcccatagcttttgccaccttgtcacatgctttatcatttgtatgtttattatgtttatagtttattgtctatcttgtactaaaatgtaagcttcaccagggaaagaatcttagtcccttttgctcactgatgtgttccaagtactcaaaacagtgcttaataggtagtaagagctcagtaagtatttgctgaatgaacaagtgaatgttatccaagacccaggctctttctacctttttattctcccattatgtgcatttgtgttttagtttcaagcaagataaatatttgtaactctgttgctctcaagcgttttatataacctgctttattttgttttgtttctggtaagtaaataagaatttgaaagccttgagtgatttttcatcagtaacttgaagtaaatttgaagaacaattactgagcacctcttattggatgtgatattgatcaattccattgtcttttatttctgacttttttcagtgtttctatttctccccatacctcttttcctgtcttcttcctacactcatttaccctttttgtcccgtgtctttcctttgtattaca

SEQ ID NO: 117195 - DNA, 1566 bp, Homo sapiens
gttcaaatgattctccttcctcggcctcctgagtagctgggactacaggcacctgccactgcgcccggctaattttttgtatttttagtagagatggggtttcaccatcttggccaggctggtcttgaactcctgacctcgtgatccacccgcctcggcctcccaaagtgctgggattacaggcgtgagccaccgcgcccagccgatagcagttgtttttaatgggattagatgagtaatcgagaatcatcaaatagttgaccttatttccttttatgaagtcatgattggtaatttattatgggtgacaggcacatgtgagcttttctaataaagggaaattgatttcatagtggtatttctaactttttcatttttattcattttatgtggtattcgtttatttgattttgtatggtatcaaattagataagacatttaccaaaaacagcaaaaccttaaaaatagaaatactgaataaatacctttgaagaggtatggggaaaatactgaagaaaatttagttcttgtcaagtgaggactaaagctaattgtgatcatttaaatatgctgacacgcaaaaaagtattggtagactcttccccattctgatgataatagcagtttaaaacttggttgagtggaatatatatagtaatattaatatgtttcttagaactctaaaattatagttgagaacatgactccacccaaagataaaatgatgcaacaaactcacatacccctttgcaacataatactttgcaatgagaagtttggtaagttatttaacctctccccactcccaccccttgccatttctctttttacgtaattatgaaaactggatagtatatcaattttcaaaagatgaacaaaaacctttttaattattaaattgctgtaagattctaagtaattacagtgagagtagtctaatacgaggtagtgaggacacttttttttcctagtatttctatttttttatcattttgttgaactgtaattcaagatgctactgataaaggagcaattttactcttaaatctaggtatcttcaaagaacagtaaaacatccaactttactacaggatcctgatttaaggcagttcttggaaagttcagaggtattatttctatattaaatgtttgtatatgaatgttctcgttatttgtcattgtaatgtatatgactatatatagtaaataattgagttaatagatggaataaagcaattattattattatgttttgcttagtgctttaattaccctgctaaattagtagcaaaatatctttgctttgatacttgtagggtgattagtccctttcttgaatacttaaaacaagatttaagagagtgatttataagtagtctaactctgaatgccctaagttgttcctcaggcatcatgttgaaataagtttattcagacttcattttagagaaagagaaagttgaatgtgtatttgcttgtctacattttggtatccttattaaggttttgaaatgcaaatttgtgacttgaaagagcctaaattctaaacatgatgctctttttatt

SEQ ID NO: 117196 - DNA, 1033 bp, Homo sapiens
gatttttcggcttgaataatgagatgaattaatgagcccaacaattgcattttaaagctgtacaagtggaaaataggatattaatttgcttattgagtttagttctcagccacatcagttggccaccatggttataaggttaatttgttgctttaaaacaaggaatttagcttgctattggtaacctaatttacaatggtttgttcttcctaaattagctccatttttcatttttttcttagtggtttgaagaaaagcagcagcaatttgagaatctggatcagcaacttaggaaacttcatgtcagtgttgaagccttggtctgtcatagaaaaggtttgtttgccttactacttacgtagttagcaccataaaactaatgaaaatattttatttaaattttatgaaaataaatattctgaagttattgcagaagagagaaaacaatcatttaagacaatgttttctagttcaactttattatgtaaattttttttgttctattttgctttactatctagtttagaagtagaaaaataacgagcttagaaaattatttgttaactggtacagatgtgagctaaaaaaaagaacaaagaaaactatatttgaattttggattaaaacttggtcacttgattaactttttgttaagtatagttacagttaaatggatgaagaggtcttatcaattagtaactttgattataataaaaaaacttgagatttgaaaattgctttttgaaaattttttggaaagtatttgttttgtgtgtctatttcctgtaaaaccctttgaagtattttcttcatttttgaactgcaatattgaaaaacctggaggttttgctaaaaattcatagaaaatttgagttgtaatattttaatccacagtgaaattatagttttttggttttttaaagaatccaacaatgtaaatatcaattgtctaagacatttaataagcaaataatatgtaacattaccagcaatacattttattaaaataattatagaaacttattaatacatt

SEQ ID NO: 117197 - DNA, 2261 bp, Homo sapiens
gggaaaatttccagtgtaggtatgacactagcattttcctattaaagacatcttcaaagcataaaacgctgttataaatcttataaaccatatttaaagccctaaaggctagtgatgaaatgggttttgaatgtagtttttattctgaacatgtttcatccagtgacagggtttttttgttttaagcaaatgaatatggagattattttctttgatattggcatacttactttcagtatcttagtatattagaatagaacttaaatacttggttttattgttttcagtattataacacttctagtgttaagaaagtattttaaatgttactcttacttaatagcattatgtcattcacttatagggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagaggtgattactaaatgctttaatctctttacttaagttttgcatgagtcattcatatatacataatttttcataattttttgtaaaccattcaacacgtagctatttttgcatatttttatgaactgtgttagaattactttaacattttgatcattattattaaaatctccagagcccttcattacttatggaatggataaagaagcatacaaggaaaacagctaaaattaacctttacattaataattacacatttttattagatggttaattttatttcagattattattttgtgtctaaaaatggttttagagctagatctctcccacatttagctgtccaggcaacattatcccccatatatatgtattatatatggtattttagtgaatttgtataagtttattataatttatacacttttcttaccatgcttcaataaggaaattgaagaggtaggacaacctttatgttactaaaaataaatgtacctgccctttgaagagtatgtaccagtgttttggttacatagtgggaaaaatatcatttcattgcttaaatcttcagttattttagttgtttcattgttcactaatcacaacattttgttgtttctgtactgaatttaatatttattgatggtcttcagtagaccataattccacatttttttccaatctggtcattttaccattacaaaaatatttttaaaatgtttatcatgtaattttcctaatttaaaatatttccatcagcatataaattttgaagaacacatatccttggatttaacagtattgatatattctgaaataattattgatataaaaaagtaattaagaaaattacactatagcactgataatttattttgtggtgaattttatgcccaaaatctttcctcttagttatatttaattaagctttggacattgtagtttattaagtacagtattgaaatatcttaatattgagcaaatctgtggaatattaaaggaaattaagctaacatgcatttctattggttgacagttaaatgcaatttctgttgatgctaaattgtgcattgccaatattgagctttctcaggattttcaggcattgtgattaaattaagtgagtggtcttgacagtactatacttttttttgagataagcataaaatatttctttgtttttattagtgggaggcgaaagtgcaacaaggggaaagagattttgaacagatatctaaaacgattcgaaaagaagtgggaagatttgaggcatgtataataattttgcatttatcttaacaacatggtcacattttgctgcaattttgtggtaaagttgaatttagctttctactaacggactttttaaaatgtacttcaacagaaagaacgagtgaaggattttaaaaccgttatcatcaagtacttagaatcactagttcaaacacaacaacaggtaagccatttttgtttataacttaaacttctagaatttgtttttggtatactttcttattttaaaaagatgattaatgaactgggcatttaaactcaagaataagaaatggaagacagaaagccagtgatggtaaaggataaaagggtaaactaatcggaaactatctcacgtgttttttttttttttgcctctgcttaacactaaggcagagatagacttttcccagttttaggccatcagaaacctcatgggcaactttcccctttcactgtctttctagtttgttttccttgttgg

SEQ ID NO: 117198 - DNA, 1065 bp, Homo sapiens
tctcaaaatgcctttatttcattgttggtactcttttttattacccagatacaataaagttttccaagtttcattgtacacatgaaatgagtttactgtggaaatgaaaatgcagagtaagtccaacagctagtttatcatcctgaacccagtgaagaaatcaaagctgaataaaagcgactcctagttgttactctcaagggcaggtataatttatgtgcaagactttgtagcataatgttttgcaagtagtggatgttcaatatctacaataaatgaattgtagtactatattgcttgaaggaagtttataacctgtctagaacaactttctcaattttacaactaaactaggagatccagggcttaaatcatgattgaactgattattcctgttaaatttatgtgtgaaccatatgtgaacattctttgaaaatgtatgataagcatttcaagatttctgttttaattattaacatttagaattctaggaaatcttttgggatacagagaacttatttcttccaactgttgcttcagacgctgataagattgtagaagatagggaagctgtagtttactatctagttttttaatgcacatgaagtaatttaaaatgctcttcttcctttcttgtcacatacttttaaaaaattctctaaagattgaataattttaagtatttcttaactgggcaaaatggaaactttgtaactgaagccagtcaaggtgaatacacagaaaatcattttcttattaaggtcagttaatgggataaaccgttttaagagagttgagaaaaaataaagttctattttaaatttatacatgtaactttaataaaaactaagtcagacaaaatttaacaaaactaaattgccttcttactgcttccatagtcagtctcgagttatcttgattttaacctactcttattttctagatcttcatttcaaatattctcactatatatgtgtatacagtgtgtatatttgtgtgtagaagtgtgtgtgtgaatgcaacaggcttttaaaccaaacttaatttctaaattgtagttttaaa

SEQ ID NO: 117199 - DNA, 1030 bp, Homo sapiens
ggggtcccctcgttttctctcccctcccccggcccagaggaagggctgcgcccttggcgcggttgtcaaggaaacgggcgcccctcccgggcacggcggctgcgggcgcccctagcccctcggggtccaaccctctcctcccggacgagctgcagtcctcggacgcggcactagccattctccccgccgcccgccttcgggagcccaggatgggctgcgttcctttctggcacagctgccccctcagtccagacagtagtagcttcgcggcagattcacgctggcttccaagttctgtacaattagttcagctggaaaacctgttttttttttttaaatcataatttgcagctgtttattagccaaactaaacacgtgtattgattttagatgatttccaaagatttttctttttgagttgtgcagttccatgaaatggcaaaattacttgctgagcacctgtttcatacctaggactgtggtcaccgagaagtgtgaaacaggacccctgctctcaagagtgaaggggagggcagagaccagggcatgggccctttgagcaacacgtttactaagtgaattgttggtggagatttcccaatgaattcaaaacattctttcctggacagtcattgctagtgggagaaatgtctgagtgtgtgtacaccttggaagaatttacttccagttgttaaagaacctgtagggttgaagaaagattgcagggcagtctgaaagatttgttattttatttacatcaatcacacacttgctaaacaccagttacattactttgatggagaatattttaacccctctcccctcctctaaatattactggtatttggtgacagtctgtttgggccattgtgttttcttagttgggactaaattaccctctcaaaggaagatttagaatgaaaaacagtgattgaaaaaatagtccaggaagtcggtgggtttttagaattgagtagactgctggatccaagtgttctgaaacaagttgttaaagtgctttccttgggaa

SEQ ID NO: 117200 - DNA, 1085 bp, Homo sapiens
aaaatgaacattatatcatggacgatagaaagggagcagtgtcctgtgtgcaggaggtcagtggtggttagagagtggaaatattttggatacatggggcagagccacattgaggaggtccctgaggaggactacctttgttctttgtcctcctggagggtgggcatctgccattgttgaagctgtcaaagttaacccttagacttttgatgggcactggggagaggagggcacattctggtagggagaatgtatgagttgctttcaggggaggggtggagatgagagaatgccctgtcactgacattactcaagcagtgtcagtggggctgccaagggtatttctccgatctgcattaggtggggatagggccagaaactctgaaactcaataactgtgtgaagaaaacaaggctgtacagaagtttctgaacagcaaagtgatatgaaaatgaggaaaccaggctgattgaacttaccttggtatgcagaatgtttccaaagaggttaattgaaatcaggtatgggactatggctgtggtccaggatgaaggtgtggactgggacagtggcatgggatggacatgagagattctgaaaagaatatctgggctttagaaaactgtagttggtagctgaaataaaaagataaataaaaaataaaatttagtatcctctctctcatctctgcctcactctctactcagcacctctgaaccaacccacccactccccagcttcaggaggaccggggtgcccatgctctgtgtctcatgatcttctgcctacaggaagcctatcccatcccctacccgaagttggttaacttgtgttttttctttccaagctagttctagtttcacttccttctggtagccaatggtgagagttttgattctgcctgagtttgctcctttctccattggtggagtcttcaagccaataggccaatgaatgatgattcctcactggactcctctcttggtggtcctgctcctatggacaggagccctcaggccatgctttgaaagatggccactacacatgccggatgtccactctgttcagatgatgcttgagactca

SEQ ID NO: 117201 - DNA, 1071 bp, Homo sapiens
caaatgagcttttacaataaccagatagctggatcacatcactaagtgaggatgcatgaacctgcctgcctgcttatgtccagctcaacccttctaactgagtgcaaagttgattgttgcctataaaagtggaaaatggacctgataaaaatgtttagtctgcaaggcttcattttatttatcatatcagaaaagaacaatgttttgtgttgtggtcaaaatagaagccgaccttgcttgttcacaaaagctcaaatcctagagataaagggggcaaaataatagagtacaatagaaggagtagggtgtaattatttgtagcttgtcaagtgaagccctttcaagccccaggtgattcaaatctgggaactctgcacaattctgtaaactaaccacaaccagcatcagagaaatctcccctggcccacagacagcaccgaaattgcatccgtttgtcatgcactgagcatgccagcctcacacaatatcatttggttgcaaatgggcctgcccccaaagccctgaaacacattctgtggtatctgactcttggcctgcgatttgtcatgtccctgctgctatcagtgtgcagtaattttaatagattctgatggtttccttgtagaaactcaggatgcagctggtttggacatgggacacaggagagactcttctggccaaagacagcaggagtgtgtgcagaaaaattggagaatcatttaatttcattaaaaatttgttataggatatatggagttatgttttatgattttttttaaaaaacatttcacagtttaatatatggaaatatgttgttcattttatctttaaaatagttgcctttttagagatatattactgacagtatacttactcaactttcagaagtgacagctgtatgaatgaagttagtctaatataatggtttatttggtcccttactgttcaaaatgtggtatggatcagcagcattggtgagagtgtgttagaaatgcagattgtcaggccctatcccagacctgcaaaatcggaccaggggattcatacgcacatttaagtttgagaagctca

SEQ ID NO: 117202 - DNA, 1031 bp, Homo sapiens
ttttcttctgtttgagaagtcacatggcaaaatattaggagtctgtctgacttaatgatctctattccagacatgtactaatttatactttgcggtcatttatctacactggcaatgaatgggaagtagttgaaattgttatctttataactgaagggaacaatttgtatgcagaggggcttgatctggtatcttagttcttagaaacacctaaattctcctgtttataaggaaaattgaattgtatctcaagttatcaatttttattttcctgataatggcacaagaattaaaaatctattgaaacttcttaacaccgtggtataaaatttcaatttaaaagtataactgggcagttatagctcactgaatggtaatttttttttttttttaattttcttttaaggacagcacaattagattttggtaagattgagacttcagtgtcttctggtatatttgtcaggacagattcacaagtagtttgcaagtgttcacgaacaaatcaggttagtaatacattgaaaccagcacaaatagattgtcctcatcaccacatagacaaaacagtcaggagatgggtttggtgctgtaagcacaagtggcacgatataatgaagttgtattccattaagctcttgtgtacggggagcaaaatgtcatcacctgaatgtggctgcatttctgtgatacaacctcatctgttccgtcaactagttttgctctgatcaataagcagttttctgtggcctttcactgctgtcagatgtcattgagtgatgtaaatgcacgtcagaaactagaaacttgacagctcacccagagagggaagggagagaggagagggaaatcactacaatagacatggttgacagctgacatctccttggggtaactgattggatactgtagcagccggcacttttcccatataaacacgaagaaaaattatcctgttatgtgtaaaatacagtgcagatgttttaaaataacttaagggaaaaattattcttgtaaactgtagcatagtg

SEQ ID NO: 117203 - DNA, 1114 bp, Homo sapiens
tgaattgtaaagggccactttacaaaactgatgtttcagcactaggatacacttctttaaaagtcttagataaacgaaacagaaaggcaaaaggaagagctttggggagaaatggttattaaagcacagaagagtaaatgcttctttattttctacctaaatttaattttttctagattataagttattattggcatgctgaaattattttaatatctagaaatacctcatgaaattgcccagaaaaatcccgttaacaggataaacttataaacgttaacaggatattagtgagagattagtgagactgtttccttctcttttcttttaaaggggagctctaagttattggtacacttttctgttaggacggcaagggataatccacatctagttctctggttagcactttttcaatccaggttgacttggaaaataaacagtacaggtgaacacagatttagaccagatgttgccagtgactttacaaaagcaccaaccccagggtgctccaaagagaaacaaacctggagtctggggctcacttccttcccagggaagtgtgtttttgtttatgtgttttgggaggaaacagatcctagtgaggtttcttctgggtacctgatgaaataagtccctactgtgggattaaaaccagcaccccctgccttgcccagcctctgttgaccagtctagaggaggcagcctgtcacatgcaggccccttgctaacctcccaagtcaacacctaggactccatgaccctagcacagcccagctgtactctccggatactcaggaaccagctccacaccaggcacagctgggtgactgccaattaagcctgcccagagcacgaggctgcccgtgcttctggaggcgaggcttgttcaccctgttctctgctctagtagagtttattttcttctgcagaggaggaccctctccccagtgagtttggacagttcttagctattcatggtcaaaaaaaatcctagattttccaggattctctcttctctcagtttctgcagctctattaataattttacctattcttataattatataatgaggtctactagcattaatagaatagaaattcacaaatctct

SEQ ID NO: 117204 - DNA, 1052 bp, Homo sapiens
aaatacttatttaatacctaatatgtgcccaagactctactagacactctaacagtgtgaaagatatgaaagacaggacatggtccctacttttaaaaaagtaccttctaattagataaaatttagggataacagttttatctcatatgtttccaaaatttaagcagaaatctgtattctaaatggacaggagttctaagaacaaagagattagggaagaaagggagctaacatggaaaaaggagaacttgcaatgtcttggtttgaatagatcagaacacacaggaaaagacattcgacatggcaaagataggtgggtagccatttttacctcatataatgaggtaatgggagatattggctcagctgtcactgaagagctcttaggaggagtgaaaaataaagtcggccagtaaaggtgttagtagtagacagaataatggttccctcaaagatgcccaagtcctaatccccagaatctgtgaatgtattcgcttacatgggaaagggggctttgcagatgtgattaaattaaggattctgaaaaggggggttatcctggattatctgtgtgggctcagtgttatcatgagagggaaggacaaggaaaaggggattgagtttatggtgtcatagcatctggtacttatctgcatgaatcagaaaggctgtttacacaaggtgtcaagtcagaggagaggtgatgaaaggagatgttatgatggacacaagctgaagtggagtgactgctagctttgaagatgaaagaggccacgagacgaggaatggtggaaaaggcaaggaaacagattctcttctagaacccagaaaagactcagctacagtcaggtaataaattttaaggctggatgtagtggctcacgcctgtaatcccaacactttgggaggccaaggcaggtggatgtcctgaggtcaagagttcgagaccagcctggccaacatggtgaaaccctgtttctactaaaaatacaaaaaaatagctgagcatggtggtacatgcctgtaatcttagctactcgggaggctgggga

SEQ ID NO: 117205 - DNA, 1032 bp, Homo sapiens
agtaagtaatttggctgttgggcttttatttgtaccgatagtgctagctagtgttgtcatttgttttgtctggaccttcggaaatctaatcaaggagacaatggtgtaaaaaaaatcaacaacacttttccaaattgttcttaattactagagtacaaagtgaactaaatgctgtgatgtttccaattaaagaacctgtttcaagcaagcgctattaaatctatctttcccaatctgataaataagctatcaaagagtggagccagattaatggagagcaattagttctagatttcttataatagggaatgtgaaccaacattgttaatgaatcttgcggtttatggcatggtaactgtgtcatttgtacctctggcatatcaaaaaggaaaattgattaaatgttatcgtatttcctatgatttttagtgccaaaaactgtttttttccaaaatctacagttatataagaaggacatttgccatattctgaatcagagttgacccttgtatttggaaaagaggaaatgattaaattaaaaagaagtacatattgtccctctaataggaagggatagacttgcaaacacaagaatgtctagactaggcagaagttagcaaactttttcttttttttattattatactttaagttctagggtacatgtgcacaacgtgtaggtttgatacataggtatacatgtgccatgttggttgaagttagcaaactttttctgtgaaagattcgatagtaaatattttaggccatgtgagccatatggctgtgttgcaattactccactctgccattgtagtgcaaaagctaccatagatgatacataaagaaaagagatggactgtgttgaaacataactttatttacaaaggcagcagccagacctaatttggctgttaggctgtaattgacccctagactagaggctggtggcagtttgggcagataggcaatagtaaggacttgaatggaaaagcaaggcccagcataaggaagatgtggattcagagccctgag

SEQ ID NO: 117206 - DNA, 1075 bp, Homo sapiens
atataagtaacaaaaaatttatcatgaagctgtttgcccataatagcagaactctgcagatctactttactgggttcttctcacaaccaacctgttagaacaaataattgttttaaaagcatttcagtaactgttattccttataatggaaatgttttattgtatgctatttttcttgtttgtggaggagagaggcaagttcactttgcttgatcccaagtaaatgttagctttgtctcttcccaatatccactcctactctggcaataaagagtttggggttgaaatttaatttactttcttctataacaaaatgaagttgcatttcatatttttgaccttctcttcttctagtagtagaaaactcaactaatttctcaaggttttcacataagagacagtcttgacaagcagaaggagtttaaggtgcaagaggcacacttgaaatgctggtgtgctcagtcgggtgtgtgccttgactaatttacttactctgtgccccttccagtatctagtgtgacagagaatacctactccatgctttgcccctgaaatatgagctttcatttccaaggtgggaaaagagtatttggcatcagccttgtcagactcaaaaggaagttgaaaagaaagaagaccttcactctacaggttgctgttggtggaagaccagttcaagtatgggaacagagagccattgcctctgaaattgccggtgctcatgctttgtcccatacaaatgagagctgtgtccatgaggtcaaagggaatccgtaagcttaaagtgcagatgatatcgtggggaatatacttgaatacttctaaaccaagctcccagcactccatttgcatgccaaagtattgattgtgaaaatattaaagcaaaattattaaggttagaacttgtcttaattcatgcaaaacatatgttatttgtgccaatttagtatgtttttagtagataagtagtatttctaccctgacataaaattagatatatttaaagtggtatgcttaattagcttttcatcagaaaaagtcctccccattctcttgacaacaccctacactgagt

SEQ ID NO: 117207 - DNA, 1037 bp, Homo sapiens
gaagtgatttagcaactcaaaagcaacctgtggccatggcaagctgaggatggtggaagccgaagccaatttgcagagcatgaaagagtgaatgaactggagataagaaagggaaacagcatcggttgaacactcttgaaaacttttgccatgaagagcagagaaatgggctatagcctctaagggattttttttttcctgttgttttatagtgagagtgcatgtttatgtgctgataggaatgattcagcagagatggaaaggtgaagagacagataggtaaatgcatgggtgggtgggtgggtgggtggatggatggatggatggagggatggatgggactagtgaataactaggagaaagaagagcaaaataactaaagaaatgaatatttgagaaagtcaaggagtggattgagagccagagcagagatataggaattggcttctgatggaaggagggacgttttctccgctatagcaggaggaggagaagatcgatggaagtgcagtataggtagagttgttgggataaagatgaggaggatcaagccaggtggcttctgcattctctgaagtgtgaagcgtggttatcagctgggagagagggtggaggaagggatgagggagataaaaggagaagaggataagttttgaaaatgggtaaaggctgattcttctagagcaatagttttcgagtgtggttcctggatcagtagcttcggcatcacctagaaacttggtaacttatttgaaatgaaaattcttaggccccacccaagaccagctagatcagaaactctctgggttggaccaagcaaactgttttaacaagccctctaggcgattctgattagtttgagaactactgttctagagaaaagtaacaagatttctggacaatattttgaggataagagcttaaatttaaagtgaaaccagtcttttttgtattctgtgatttttctcagtgtttagcagcttgggtagaggcatgaatgagagattgctgggattcagccagaactgagctgtccc

SEQ ID NO: 117208 - DNA, 1050 bp, Homo sapiens
gctaaatgtttaatcacctacgatgtgtttcaagttatgtttttcttaagaacctttgtttggaaattggttttaagattataaatatttgatagggaattacaggagtaaccagttagaattaagagtggaggaataagagccctacattgtttcatgcaagtaatcagaatgttttatcaacaatcgtattacaagatttttaggaaatcacgtttcagcaatgatttattgtatagattgtatatttgcttcaaattccacaaagaaatgtttagaagatgagagcagtgcccatttgttcactcttactctgcgtgctattattcacccacactgttagaacataaaccttgagacgtccccgcacagcagtttgatcccctcaaagctagtttgtagtgttttctgtttaccatcgtcccctgatgctgacatgcctgttcttgacctttccagcaaactgtcccaccagcctgtgctgctgttcctcagggatccatatgtcttgcctgcagccagcggtaatcaaacctgtcatctgctaacagctctttactgatctgaccctgcaccacataaaccacgtttttaatacaggtctaacagagtgacattggtcccgggcttaataatctgccaataaaccagtgctcttggtataagcgacacttagaattttaattggggctggcctttcaggaggaaatgtaatttttctttctctcttaccagactattttgaattagagtaataaggaagaatggtatttatggtccttaatttttctgatcatgtcattttggcctctgcttgtttttgtccagatgccaaggttcaaattcaaggctctagtcctttttaaaaatgcctcttcccggccaggcatttttaaaatcccagcactttgggaggccaaggcgggtggatcatgaggtcaggagatggaaaccatcctggctaacacggtgaaaccccgtctctactaaaaatacaaaaaattagccgggcgtggtggccggcgcctataatcccagctactcgggaag

SEQ ID NO: 117209 - DNA, 1050 bp, Homo sapiens
aggaaacaggtgcacagccactaggatggctcaaacaccttttcatctggctttaggatgttttcctgcccttcagttccttctcacttcagagcgaagtcatggacctgcttgatcaaggtttggcccttggtatgaggccagagagtatcccactatcctgtgccatatttaaggctttctttgttcattttaggccctagtgccctgttcccttaaggagttaattttattccctccttcatgtctgcttatgtttgaacatgtcttccccatccctacctcctatagggttctagtaattgattcctctaaggccttatgtttccctttgaagagctgacttttggaagacatctgttgactttcttccttgttttgtctcaggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatggtaaattgatacatttttttcctttcaaagctttatatttttattgagagtactttcagtgatttattttaatcttaaaatatgcttgttagagatccattatatagctgactggcctcttcaaaggtgaataaattatatatggtatggcattttaattcttagggtcattggcgcagcagctagggacttgacaaggagaaattaaggactaagttgatttattttactacttgatataaatgtaaagccctttttaatggaaccaatatataccaggaccccatatatacacacaatggaatattattcagtctccaaaaggaaagacattctgaggacattatgctaagtgaaataaaccagtcgtaggaagacaaatactatatgacttcatttatataaaatatctaaagtggtcacattgatagaaacagaaagtagaatggtagttgccaggggctggggatggggtaaa

SEQ ID NO: 117210 - DNA, 1574 bp, Homo sapiens
ttgtcctgccaagattagagagcattactttctaagagagcaatattttccattctactcttcatccataaagccaggaaatgggaagtagcagcagcgtttgtctggggtatgggaagagaagaattattgaagacttcattggccaacactgacagagttgagtcagcctttaaactcaatacctggtacagtgcctggcccatgggtggtgcttaataaatgtttcttgaaagaatatttgtgagtgaaatgcacccacacaatagttttaaagtacctttaattgatgtcatgctcctttacaaaatactgatgggcagggcttttgtatgtgggtcaattctcagattttaattttgacttaccttgtatttgtgcttttccaccttataaccttccactttgcctttcaactgcacacaggtcttctttgatgtgaggattggagacaaagatgttggcagaattgtgattggcctctttggaaaagttgtgcccaagacagtggaaaattttgttgctctagcaacaggagaggtatgtctcaattttatttcctttaaattgggtcttctttctttgaagccaaatataaagatgtcatctgagaaaataagtattaaattagtatgtcagatgaaccttaccacatttgactttattttccaattaaatatgtattatttgggcactcagtgcccttaggcttctggaaattgggagaaaatcatcatcaagtgaaaatatggtttgctctcttttaacttattcacattaatactctacttccataacatatttattttttggtcagctaatgataaatttctctcagtaaaccatagctgggatagaatcaagttctgtaggcattttgtttaattttctcagtttgtcctttctagatcaacactgagtttatctttcagtatggcctctgttacttgttattcaactgaagtaatctctttagaaaggatatggatataaaggaagcaagtttcatcgtgtcatcaaggatttcatgattcaaggaggtgacatcaccactggagatggcactgggggtaacgtctttgcatttttcctttcccatttaccaaaccgaaatctaaggttaagccagtatatgaacccagtctgttgaaatccagagctaaggaacacagttgtaaagacgactgtacctctttgagaaggatggagttttggggactcatctagcagcatctcgacaggtatgagggaggcgtccttattttaagcaggattgttttggtgtttattgtctttccgtaattgagatgtattcattttgcagttattaaaataccagactactagtcagtagccatacagaaaaatatctttcataggaaggaaaaggtgtggaacatgaagctgcgttcccctgggatggcagcgtgcggcagaggtgggcgttgcaggaggaagacgggcctcatgccaggagattgagactagagttagcagcagggtcacagcgcactttcctccttctttcaaaatctttcatcatattgacaaaacagtgaaaaacaagtccaaga

SEQ ID NO: 117211 - DNA, 1744 bp, Homo sapiens
ccaatgccgagtaattttcaaatgactttcaagggcagccttgagggaaaaaacaagtgactgaggtgctcaccccaaagtctagcatggaatccaatatcacctttcccaggaagcccacacttatctccacagataatcaccaccccttaccatgacaccttatctgtacttgtcttataaaatctgacttctcattatattatagcattcatatatgtgttttctgttggactgaagctccttgagggtaggagctttgtagccccaccccacccctggcccagcactgggttttgttcccagaggcactcagcaacatcagagatgaatccagtggtgagagggtttagagtgagagtgtttgctggcagctgtctcacctcctgtctaggaatgtgtgtgcccaggtcctccttgagtatcatttgacattgaatcttttaacatttcttgactgcctcctcctgctgacctttagctggccactggggaactaaaaacactgtttctactccttagggtttccctggctcgacccggagagccctattaacaataaaccagtttagctagaggcagccttgaaattctggctctcacactcatagtagggaaaccttggtaaatcacttaacctccctaattcccacttttctcatttgtaaattagtgataatagttcctgtcccacctttcccagtgtggtgaggatgaattatataagatgatgtgggttacccacactgagaccaccactaagtcatgtttgcttccttccctctttcttcctgctcctcctccagtgtctgcccctttgtttaaacgcctctcctggctgggcgctgtggctcatgcctgtaatcccagcactttgggaggccaagatgggcggatcacttacggtcaggagttcgagaccagcctggccaatatggcgaaaccccgtctctagtaaaaatacaaaaattagccaggtgtggtggtacacacctgtaatcccagctactctggaggctgaggcacaagagtcacttgaacctgggaggcaggggttgcagtgagccaagattgtgccactgcactccagcctagacgacagaatgagattctgtctcagtaaataagtaaataaataaatgccttttctgtctccctcgtacatttccttctgccaccaccccagtgcaggccattatgaccttattcttcaactggtataagagccccagattctctttctctccgtttgagtaacattcccagagcctcgcttgaccttattctttgtcttctctcttttgcctaacaaaactcatgcttacgtcagcatctctcctctgccttctggaactggtgggcagcttctttcctggccccccacccactctaacccctagttgtggtcagaagggcagctttgcttctctgcacacaggtcacatttcctgcctaggtgcattggttccagaaagaagtctgccaggcaaggctcacccccatccttgtttggggagatggctcccctcctcccaggcctgcctcccttcaagccttcctccttagcctcaccgttcctgcaggcctgggcatacagtgtttggggggcatttgtcacacactgccctgtactgtggttatgggtttgcctatcctatctctttattttaaactgccttaggacagggactctcttatacagtttgtgccctcacattgccttttacataaccttgcataaata

SEQ ID NO: 117212 - DNA, 1493 bp, Homo sapiens
ggaggctgctcccaaggcggcagcaatcacaccgggaccggctgcagagttcccagtcccgcggagcgctagctgccgggcggacgcggaagcccgagagtcctggtcttcccgtccaagtttaatccgcgcctacgcggtaaattcctggaggtgctcccagcctagcccgctgcgcccggctccgcgcctgggcaacccgggctccctcccgtccctggcgccctccgcacccgcctaaggcgcggcggtcgagccctggctgcgccctgtgggcgcgctcctccgaatcccaagttcgggtcgcgagtctgaacttgggaggaacgcgccccgggtccccgcccttcccggactgcccgatccccatcccccgcaaccgggagcgcgcaggcgcagccggccggcagtcccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtgaccgagagcggcgggctgcaacttcccctgttgcgggcggggccctgggggcgctttggatactgggacctcggtgtcagggcgggcgaggtggaggcttcccgggcgcagggggactggaggcggccgcgggactgggtgggagggggctgctcgcgtgctgggaggccggcgctccgggggagaccctgggggagctgggctgaggccagcctacctccgccgcagtctgcttggacttcttgtcccgggtcggtagtccgaggtgaccagcctgggggtaggagaggcttccggaaccggcgggcccgttctccaggaaagagactgcccaagtacttccttcagcgtggcctgggctcgggagcagaacgagaggaatgcggggaggggggcgggacccgcacaggagaggcgctcggagcccagggcttgcagccgcccgcccgctgcgtggtctccacgctggccgcggtggcttcaggcaggcattaaagcgcctggttcagatgagagactaccctccgcctcttttggggaaccgtcgtccttcccgggaaggggaggtgcgccttcaacttcggcgggcgggcggcccctgctgtgggctacgcgaggccgggcgaaggcggcacctgtagacctggggcagcctccactgcggggaaagggggcggggggctgccagaaagtgcgtctttaaggcttcctcgtacttaactccgcttcagttcttttttcagcgtatttaaccaagggtagacgataatgggagaatgcagggagagggaggggataatttggtgcccatgatcaccacttctagaaaacccactggcaatagtgtcttcgaagctgaagctggagggggcgggctgcagctg

SEQ ID NO: 117213 - DNA, 1034 bp, Homo sapiens
caaaatttctgctacaataaagagttaaatagtactccataagacgtgttgcacgaggcatatggagatttcaagtgtgcatcgcagtgtgagcattaacttaaatgtgtcattttatagttctctagtgcagaactatttggtgtacgattgtatgtaacatgcaaatcccatcagttcacactactattatttgtaggattattttaacaaaataatagttccatttcctgtttggtataaaactaaggctttatttttaaaagtggaggaagatgttaatacaaatttctctgtggtttattttccaaaattgatactttctcatatgtagcatgttgttgttgttgttgtttccaaaatccatctttcactgacacgacaagggatgctgagtagctcttcacatttgctagccacagtctgagattatttgcaaggcaggattctctgatgccaagggctgaggtctagtttactgatccccttccatctcagcaaaagtgtatatgagagagaagagagagaaaagccagaataggagggaagctggaaactgtggtgcttactcgttcatctcaggatatggatacaaacgtggtaataatgaaagctgccctttgtttacaatacacacagtttgtggcagcaatctttataagcccccaaatggcacttaataaataaaagaagatacaggttttcttgattagttagatataaatgtttactcaagctttcatgagagttttctttatttttacagagctctctctgctcaaatgaacgcgtgaacgaatgtctgtttttttaatgtgaactcactatatacaaaataagttttcgcaggatccaaattcatttcatttgtaaattatttaatagatgtcaagaattcttgttgactgctttaattaaagatagatttttaaagactggatttaagcaatttttaaatgggtagattgtgtcaaagaattttgcagtctgtgaaatacattaacactgatactaaaaagagagagagagagaga

SEQ ID NO: 117214 - DNA, 1267 bp, Homo sapiens
taataataaaagtttgctttaaattcatagatgcagaaagtagactagcggtttccaggggctggaaggaactaggggaaaagaggaagggggaattactgttcaataggtccagagtttctgtttgggatgtgaaaaagctctggatatggataatggaaatagttgcacagcattgtgaataattccactgaatagtacacttaaaaataattaagatggtgcattttatgttctgtatattttaccacaatttaaaagtttgcttcaaactgtgcctcaaatctgcctacccagtgttcttatgctgaaagttttctgcacaagagtcacttgtcaagtcatttctgaagataacatcttgtcatttcttgattgtggaaatggatcaaaaatgcttcattaaatgcttatagcacctttaccaaaatctgaaatgagtgaaaactaatggctacatttatatcctgagttctaaagataaattggagactccttgaaacttagaattgtaatgccttcatgttttataagattatgtcttgttattcttaatgacaatttagaaaaaaaaatggtttttaaaatttaacagatagtccagaccatggatgtaaattggagagagaattaaaaaaaaaaaaaaaacccaacacatattactagtaccctaaagtaggcttagtatctttttttggaggtaggttctcttactgttggttcatggtcttattaacgaataaagtggtttgtgtaagagtgttaaagtctggctgagtaattttaaattatgacttgaaaatttaaatccatctttgacgtttgtgttttggcaattgtattaacagcatatcccttggagcctagacgtttcgtcgtacactttttctgccacttgttctagtgtacaatcatgcttcttcctagctaatgcgccctctgcttctaggtctcggagacacgcaatccatccatattggcataaatggggaaacagagacagaattactgaagcacctaaatgttctactgaaaccaaaagaactagattgctcactgattttgttacataacctctgtttggcatcaaattagaatctgctgttgttaggaatgtaaccgtagaaaggctgctatatacttaattcccattttatttgcttctctgggggttgtcttagtgttttcatttgaaatgtttttacagatgtaggctcttcagatatgaagttgctgaagtggagactcctcagaagtttagctttca

SEQ ID NO: 117215 - DNA, 1092 bp, Homo sapiens
caaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctgagttcttgagcagcctgttacttctgtttctaaacagagtgggcatagtgttcgggttttcctatttcaaatgactgtctttttttctcaagtgtttacatactattttttgtcttacaactaggggagtctgaaatattaacactgttttgtagtccttttagcaatacccattccatttgtaagtggcatcgaatgtttttacactgattttgcctaggagttaatgagtatgaccacagtagataaatcagtgagtgggtgcaggcatgggtgggtgaataagtttcctagtaacaggaaaatatcaaatattttagggtaaaatcagatttacctttaaaatttctgtggtttttcatggagaaagtctagtttccatgtttaatgcgggcatgtactgcataggaggggtgtgtaatctaccaggtatatctaataccatgtctgtataaacataggagttcccttgcagataaatcctagtaatttctatctggacccgaattcctgttgcttcaagcagatgtgggggtttga

SEQ ID NO: 117216 - DNA, 1038 bp, Homo sapiens
tatcaagagtagaaatagggagattggaaaccggtgaattttaatctatgctttgagttttcctagcctctgaatggactgtaggtcctgagctgagtttttctttcaggagtatataacttggcttatggtctattacctcagtcatgaccaagaaaacctgaagaaaaatataagtacaaaggtttccagaagtttaaatctacttacagtaagggctcttaagaacccaagtctttgaatgccttgaaattatatcaaaattttagttgtgtatattttttctgggaattgggtccatatatttctttagaatcacagagacatctatatcttaaaaaaaataagttaggaatcgttgatttggggataggaatgaattagaagaatgaggtttgtgtctcagatttacttagctacaggattgtattaagaataaagaaattatatctataactatacatgtgttttaagttagtgtgttttaagttagtgtgactatgcaaatacaaattattttaataattatggcagaacagatataacctatccacaattttttctgatggtgcattgagtataagtaatccctctaggttcatctctggcctaaccctcattcttgggctcatctaatatactagaccttctctccaagacccatggacatgattgcttgtataattgaatactatcctcttatcccacagtgataaaaatatttttttcttttcttctgaggtatggcctcttgttaaattaccaagtagtaggtatacatctttggggcataagtagaagagatcatcttcaataatctcagcagtattattcaacttaagatgcttgagtctagttgtgaaatgtcaacacatttaaatccaagcactagggatttgtaaagcagaaaagaccttgactccatgtagtcatatattactgcagaagatgttctgcacttttgtgaagggaatttgaccatctgtttttcctttcattttattttcatatatttatgggaaaaactagacttgatat

SEQ ID NO: 117217 - DNA, 1059 bp, Homo sapiens
tttttatgcttagtttatttgcattctagtaataagagaaatagttcactaactactaaaaagtggtaaaattcatagtaatttagactattaatcatattattgcactgagattcaaatatactttaagttggatctttttctaactattttgtatgaaattgtgcatatttcaggtcatttccaacttaaatctttttctgataagtcttctttaagcaaatatagatattcttcatgtagcactgaaccaaattcagttaaggaccaaatttagttaagatccaaatttcatgagagaattgtctctgttcctatttcctctcctcatactcagtaaaactgattggtatcatcaacactgttgtccttgtttttgtattttctcttctcaacttccacatcaccactctcccttgtttttctctacctttctggccaccctcaggctcttttgcaggcttgtcttcctttagccgttacatgttggacttcctccaagctcaggacttactttctgcaaaaacaatcttattcgtgatttcatgcccatgatttcagagacagtctacatctgggactttcacatgcagggtcatatccaagaccttacctttgccctctagacccatatatctgattggctttttggcatctctgttcagatgtcttaaaggcatttaaaacccactgtggtccttctctccatacttgaccttctacctgtaaatgttctttgtttcagtgatgggcccctctaatctgctcctcatgttgtagccagaatgatatttttgaaattgggaatcttgatactctcctctttaaaacctttcagcattgtcttgttgctcataggaaaaagatcagaatcattgccttgtcctgcaggcctctgcatagatcagagcctgtctctctgacttcatctcccactcttgtgcctgtgctgtgtactctctgcccgtgcttgtctgccctcaagttctcaggcatgccatgctcacttcaaccacaggatcttcatgtttgctgcattatctgggcctggtgtactct

SEQ ID NO: 117218 - DNA, 1505 bp, Homo sapiens
ggttcttgttctgccctctggagcaactgagatatactctgtcttacatatgactgcctgtcagatagctgaagatagtcattacccacagagaaggaagacatcagttctacataaggaagtgttctgtagataagatcatgctttcactttggtgaagattagtggatattgccaggtagactcaaagggtattccggacacagccccttgaggaaaaggcaaagaagtttgaaatacactctgcattaagaaaattatatgtagtttgatgttggaagaggggaggaaagagtgtgcctcaagaaataaggtaagagaggttgataccctggagaataaatgatctcgtaaatccattatgtagagtttagactagatactgtaggcttttcttagccaggccttcctgagagaatgaagcccttaataccctaagtgatccattattggtaataaattaactttatcctatgcatctaaaatggtagttatgtaccattttaggagaggatggagaaaataattaaatcattttctgtgttttgtggttcagatgataaaccctggttgagaacggtagaaatatcagaaattttttaaatgaagatttttatataaaataattaggttttcattctataacaataattctgatggaggtacagtggctagaatagaggaatgtgaaactaaagtccaggagaccaggaaagcaatatgtataaaaaacgaaagccaaaaactaatagtagtgaaaggttatggagaaaagatgggtggtaaagagatgattttaaggaggtttaggacctcaagcgctaagacgtcctcacggctgctcacaatcctactgctttccctagtcaattcattttctcactcgccagaacagttagtttttgtcttaacaaacaatccttcctcatccttacccggtttatctctgtctttgaaacacttcctctatttggcttctttgactatattttttttttggactacacttttctactgttgtgttccgctgtcttcactggtctctctttcctaattttcatgctagattctcctcatgttggctttattggcttgtcccacagcccagtcctcaaataccatcctttcttctctctgtatactcactccttggatgatgtcattcactctcttggcattatatacaccaagacacccaccacacgcacccccatccctgacttcttccctggactccacacttggctatttagttgcttacactacatatgcgtttcaaatttagcagtcttttgtttccatcctctgtaaatttagattaagtctaacatactagaggatgtggaaatcataatatgtgaataacagttaaaatttgtgtttatcttggagaagaaaaaagaccaagaggaggaaatatgaccatcaccagtctcaaattcataaaagcacatttttttctttgaattggcggatgtaatttgtgactttcctattcttaggtc

SEQ ID NO: 117219 - DNA, 1045 bp, Homo sapiens
taaaaatttaaaatttaacttaacattatatatcatatgccctttatcattaaagataagactaaaaaaaagagaaacaaggctcagtgaaattttagctctaaaagtattgaaatgtctttccttattcctcaccattcatggccattttgtttcaactcctattattgaagaatctttcttaaaaattagcatttttttgtcgtaagtagaagataataaaatcactaataattgaagctattttaatgctgcccgtttgttatgaatattaacttttattgccatactttgtagacagaaagttttaggagatttacttaagtgagaaccttagatactctcaggagtttctgtcagatacagtagtgcttcatttaactttattcatttcttctgaaatctgtgagattagaagaagaaaatacaaaagttggttaattaagagttctaattgtgtgagaaccattcattcaagttttgtttgaccagagtatatttgatttagacaaaaccatggttttgtattactagcattttattttcttctaatattttatcttgttctcatttggttaatgacaaatgctgcatgcagttgtatgatacaaagaggtgctcattatgctcatactaacatataattatcctagaagcattgcttatgtgccaattaggcctagaggcattgcttatgtctagtaaaatatttatgagtatgtacatcccaggaaaagtagaaaaaagaattcagaataaccaatataatcaagagtaggggaattgttaagtatattttactacataaattcatttgtatattttacaggcagtaaaaaaaaaatcacatttttaaattaatgttatgatgtgagaaaatgcccctgatgtaaataggaaaacaagacaaaactgtatgaagtcagcatgcatgtgtgcatgtatatctatatataaataaaacaggagggaaataaactacatattagcaataattacctgtgggcagtaagattttaaatttcacctttataccttttaaagc

SEQ ID NO: 117220 - DNA, 1084 bp, Homo sapiens
tgttctatattaagaattttatataatatatatgtcagttaagtagttttacacaataatttgtttttaatgatgttacatttttatagtcttttgtgcccgagatataaattaaatataatacaataatgtatttagtttggggtagttagcatctcctcataaattttttgggaacaagcattagcatttgcaaaagttgaggaaataaattgttacagtccacttaacactcttcatagaattcatttgatacggactaatagttcggtctttgaatcattttaaggcactttaaaaatgctggccacttaactttttctgttgataaattttcataccatgctctgtattggtatgaaattgtagtttgcagctgtgtcatggaattggttaggtaacactggtatttgaaaagtttcttatctgcatgacttcctttatttatttttcttttaatcactaaatcctgtagtgtggtggtaagcatagggagctgaaactctagggcatttaactttcctcggaaatgacatgatttaaatggatatataattatataggaattgggtgactacatagaattcttcttgttggaaagcagtttttactaatagtgtttaaattttagttctcatatatgaataacaagatacaggattaaatttaaatgaacattataatatctttatatttggctttaaatacaaattaagttcagcagtagtcaggcattcttccatttaatctagcatggctttgtgatgaaagggagaaacagtgttgttatgtcactctcttgattcatccataatacattcgaattgtttgcatccttgcaagattaccataattaccagattaccatgaatgcatccttttggagttgactaagggctttttatcccataaaaaatcaggatactattgtataaaataaaccaggtttacaaataaatttaggaagcatttcttgaatatttatatatggcagaaactgcctgtgtccctgggagtgcagagataaaaaaggtaggacatgtgccgtcaaggaacttcttacacagatgacagattgctatgt

SEQ ID NO: 117221 - DNA, 1033 bp, Homo sapiens
ttaagtttatgatatttaggagaaaggagaaagtataaagccctattttgatttttccctttcatattagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccaggcaagtagtggccctccttcattcccctggcttcactagtcccatgcatgattacttacaaaagttgaatttcagaagagttaccttcataaggatatatttattaatcttaattagtgacctttgttatatgatacctcctttctgaaaagtgctgtgacttctgttatggtttataagtgattctacccagagccctcttagcctttgagacagtctttttgtgtagtggaaacccacttatggtctcccccacccccaactccagaaaaggaactccagtgaaagagaacatttttagacctagtttctgggaatctgcattactgatatctttttggttaatgcaacctgagccaaaataaaatccttggttccttagtgctttgtagtcctcatactctctttagtcagttttcatgacacagatgatcatttatttggccgtgtattttttttattgtatctattcccagaaatcaactttatcttgttctttcaaaaagctgatctttatgcaggttgtgaattaaagatagaagaaccgaaatgagtgtttaaaagatacatatacatatatttttagtggggagtggaataaaggagagaaggaaagtcatactagacatgtgttttttctctttaggagtatagttctccattgtactgccttggtaggaataaccattcccggggacacctatgcctgacttcttttctcaaatatcccttctt

SEQ ID NO: 117222 - DNA, 1094 bp, Homo sapiens
actacacatgtaagggatctaggttgcgtgctccttatgagaatccaatgcctaatgatctgaggtagaacagtttcctcctgtaactattccccctataccctcctgtttgtggaagaattgtcttccacgaaaccagtccctggtgccaaaatggttagggactggtgtcttagataactttcatgttaatgtgttattatttagcagccatggtgtatgataattatatgtaagccatctcctattgatcaacacattaaatgtttatagcttattgtttaacagtatgctagtgaacattaaaggtctgttagaaaatatattttgtaggacaagaatcccatctcttagtcatatgtagccatgaaactagcaactctgaaaagtaacactcatagtacaaaaggtatttttttggtgttattttcataggcctctaaatttcgacagaatagctaaaaactttatcggagacctcaactaagatgttatatgttagatagcctggattaaatttctttaaaacctttcctcattcataacatagagcctctgatggctgaggaagtatgagatgaaataaaatatgtgaaaataaggaaagctcagtttgaaatatttaatctctttcttctaagtagaactttcacatattctttcatggaccagttgaatgcaatgaaaactttaaaacaacataaatctataaagtcttttagactctgcttttctaagacgactcttttttaaaaaaatagtaatttggtagtaatttggcagaaattcagaaattttatttgagcggttaagacatcaaataaaaaaacattttagcaaatgtttttggaatgtaatagatacactaagcatgttcagtagtttagaaagtaataactgttttctttttcctgaaatgtttagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgt

SEQ ID NO: 117223 - DNA, 2490 bp, Homo sapiens
tatatgtatatgtatgtatttatgtgtatatatatgtatatatatgatatctgaattgatgctgctctatatatatgtatatagacgcttcagtatatatattgtcaattcagattgacaccttcaattccattccagcaccgcaagattctagttttcatcttcaccctatttgtaactcccttccctgtcagtgagaacatgtcatacttattttaacttctaagctctattggccttattgtatgacggctgcctttattaaagtgcttaatgggtcagagtctgtgctaaatgctttgctttcattatttgatttgatctttcaacaactctataaaagctttctagaaaaaaaaaaatggagactaaaagagatggatatgggttccctgtgcaacaagtcaaggacagaactgggattggaaccttggtctatgcgacttagatatctgtgctcttaattattatactgttttcagccactgctactgtaagcacaactctttaggattaactcctagaagaaggattgctcgtttatagggtatgcacatgtaaaattttgataggccctgatatatcaccctctaattggttattctagcatgtacctgccaacattgagagcattcactttcctgcgttctcctcaacattggatattatcaattattttagttgtgtatgttttttgttttttaaatcaatttgaaaaaccttgtccctcttcagtctcctcatactaaagcctatttgattatgtcagttttcttctcaaaactagtttcatgattttctcttattcttagaaaactatccaaaaatgtttctggatagcatacagaaggactgtatgatatggcctctgcttatccagccccacctccctctgtatgtcggttctcactctgtgatctggcaccctatgcctgtgtcagttttctcacacatgctttctcttgcttctgtgtttttgtacatactgtcccttctgtctagaacactcttttttttactcccccattccctgttcagctgcccttttcttcttagccatatctagcttattcactttccagtttagattcactgtaaaacctatgttagatgccttttctatgtggtttattaccttaaggttttaaaaatgttactccagaattttacttttacatacagaaagacaatgctggttaagtaaggtttctttggtgagtatgtaagagagtaaaggaaaccttattagatattaactgtattcatgaaaattaccaagcaaattacaaaatataatcagttttaaaaatcttataatggtttatgacaaactacaatgtagtttaatcgtgtttttctctgtaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacaggtgagacttttcatgagattggtgacttacgaataatttgaaaactatgtaaaacattttacctttcaggtattaaaaagacttgcaagtagactttttttttttaacttttgaaaaatgagttcaaaacatgttttctttcatactggaaagaaaacttcttaatttagaaaaaatagattttgatgatcttgattgtaagagaataaatctctcaggatttaggagaatggccatcagttaacattgttttccattgtactgtgtggcattgtaaggactgacatggaaggatttttaaatttgtgaacgatttactttttggagaaacttacaatgtcaggaatactttctgccactaatacttaatgcctatagagttttgggttctattttatcttgtttataaactaataaattaagctgttactgtcatggatgctagcagaagacacaggttcttggatcagaaacaaaagaatttattacccttagtagcagagcaagaacatgaatattggtatatttccttcagttgcccttaccccaggtcccatggggactacacagaggggcccaggtggttgctctacacatagtgggttttatcacagctgaggaaactgaatttggggaacctgccactttcattgtaagcagtaagcaggcctagtctttgtccaggaagacacattaccttatctctcaagctgcttaaacaaccctgggaaatgggctgagtaaaagagtggtctgggccttgcagtcttgccatactctgcaagaatgtccagggatgctcagggctcatggtagattgccttcccaacagcggctcaacacaaaactagctgttattccactgtccctctcaagtccacttccctttttttttccctcctctgccatcaacttggttttacagatctacttttcttgacattatgttgttctgtagtagctgaaatgaatta

SEQ ID NO: 117224 - DNA, 1011 bp, Homo sapiens
tgactagccgtagccccagagaatctagagaaaacgattttcatccaaagcagcacgtcgatggcttttatatatgagctgaacgtggtcctgagaagcgcgttctgatcagcggttcccaataatagcacttgtaagagctttgacttgaatacaggcttcctgcgattccagaagtgttccggaggcaattccctttacacgtcttgctggaggactcaggggactacagttcttaagagggtgtattatacattccttaaaaggtgtgttttggatgaatgacattggtttattgggactcattgagtgtcagacactgtgctgggaatgtaagaatgaaacagtcctgattctaaaaagctaaggatgtagcaaggagagtgtgtcagcaaataattcatcaggatgtggaagaccctaatgaatgaccacctctgtctaaggaaactgcggaagtttcactagaggaggtggcattttttggggtcctacagatgattaggaatttgtcaggtgaaaaaaggaagggcattccaggcaaagagaagagcagggagcacttaaagtatggaaaagcaagacacgttttgccttgcttaattaaattcactcagtaaacattggttaaattcagtgtggttggagaacagatttgcaagaaagtggagggcataggagataacaggtgaattgaggacactttacgaatagtatgttaagaaggagtcatcttgagccagagcagaagcctggctgcattttttcccccatgggagagtgttttataaaggcctggcactgtgtgagggatgagagcaaaggaaacattgtaatcctaatctttgaattttggaacaagagactgaccagaaaagccataaagatttggagcactattaactgttagtttacttattgtttaaaaacataggactgaaataaccttaaaatttggttaacaacagtttttagacttataactgaccatgctatgaggaaacaaatacc

SEQ ID NO: 117225 - DNA, 1242 bp, Homo sapiens
ttttttgagctgtacttagtgtattttgtaattatttacaaactttgctccagttgtatcttaggataaattgtcttattcttttgtatagttaacctttatagttgcacaaaagataaaagataaaaattacctttatggacattggaagaaagatgttatcaaatacattgtgtggctttgacatacattcttagcagaatgtacagacacttctgctttatgtgaactggcatttctgaatatgcattaaatagaagtaattattgaaatgggagacagaaaggttaattttaatgttgttatgaatgacatttttttggggatcttgagaaacgattgtctttactgatgatttattatagtcatccacccccttctgccattcatcagcttaaacattagtgtgttatgtaattattgacattttcatcattagatttagcaagcatttacaatatattaacaaaatcttcagtacatgaaaggcatttattacttccttgaaaataaaggactggaattagtggaatcaaggaatagtttaattcaaccaggaccacctttactctgtggcaaggatggaacagtgggtagaatatgaagatgaatgagactcagtactgccttcaagggagaagcagacatacacagaggtaattcacagattcctgtgggttttgttggaggtgtattggaagcatggggtgtgtgtgtgtgagatactaatttttgactgggaaattttgaatggatgtagagctggtaacactccatctgggccttaacatagtttaataggcaaaatggggactgagggggtgatggtgggggtagttttctcggtgaagggaacagcctgaggaaaggcatgtgattgtgttatagggcttgttgaactggacataaggctgttttgccaggaggtctttgtgggagaagctatgaaagtaggtggagatcaggccatggaagttcagcttgtatttaaagatgagtcagtttgaggcatgaaggtccaaatgtacagatcgtaggctgacagtaggtaggcaaataacgatagtaagtttaaggaaacaagttataataaaatagtcaattttctatcattggcactactgaaggaaagcagaaaagtatataatccaaaacaatctatatatagtttcgttaaatttctttatttgcatttaaatatgggtgtgtctggtaatctagtaattggttatacatgaaatc

SEQ ID NO: 117226 - DNA, 1628 bp, Homo sapiens
agagttaccctgttattctgccattatattcttcatcaaaatggaggaaattcatatgaagtgccaaggactatgtgatgcctgccacatagtaggcactgtgtaaatcttctgtccttcatttcagaagttgccgataagaattttagagggtggattggtgggtagacaagcaaagactctcgggaacaccctattacaggaaaatctctcatacctgacctctgcttaacccactcgtgagattaaatgatagtcttcattctctctgtagaatttgctgactgatgctcatgctacattgaatgacagtagactattctttagttttatcttgaacttttattccccccagttactgtagacttaccaagaaacatttgtgtttgtacccaacacactgttatggcacttgatgttgtaatcacatagtttaatgaattattattcagtgaactctgaagataaaaaggcgtttgtatgagaaccaattggctactttgaaatcaagtgagtagccaaaatcaattatggttgaaatagatgagggttaaataattttaaatgattagggaaaaaaaaacaaaaaacacctaacgatctaaaaaaatctgcaataatattatttttcacgtttgtaaaatgtctttctgtgtttaagaaacagaaactggaaatcacaggtgttgttttatgggggtagtttttgcaagaaaaaggaaatagaactttcttcgatagacccacactggaagaaaaggccatagctctgtattataagattgtcttgtgaatggacatttttgttttagttgtaataaaatgtatagagtttgtagatgttgagaaatgatttcctttttaggctaacttcagaaccatttattaattgtaatatattaaagaagtctgcttctaaaacatcatctttcctagtttacactactgcttagagatttatttaataacatcctctttaagaaaaaaaaaaaaaaaaaggaagatcctgttattcccagaggttcattccttagagtgaattgtttatctagtcaggtgatcaatctatggttctcacatatttcccagtatggtccctaatctgatttcataagctacctttcaacttttatgtactgtcagggttgaaggggtaagccttcttatagttccaacatctccatccaattaggaatgctggggtagaggagattgttctttgaaggaggaaatgtgacacccttgatatataccaggagcacttgagcctcctatctcacctagctcagtccaaatggaaaggagaactttcagttgaaggagcaggaagtccaggttggagaaggagtggtatatgtggtatgctatttattttggtgtaaccacattgcttgctgaattacagtagatgctgaaatggcacattgaagtatgaaggtagggtgggtggctccaagctagtacttgagagctctggtctgcccctctgtgattttcttggctgtttgtcttctgtgtgttggagtcatcctaaggccagcagcaagatcacatctagacatgcactggccagaggatggaatggatctctctctctctttctgtctgtgtctctggaaaagcaaata

SEQ ID NO: 117227 - DNA, 1244 bp, Homo sapiens
tttaataaaattctaatttggagtacaaaaatagtctagtattgttttggagatgaaactagtaggtgtcagttttagatgaccttgaaaaaaagtgtttatagatgcatattttttacaaaacattattttcttttctacatttattttagggaatctgacaacagtctgactctccctactccaaaaatgtaaatctttaaatcttaaagatgtggaatcttgtgatgccagtttttattttaaaaaaaggatctttactgagtactttttctgtcatacgagtatcaggatatattgttgctgatgtgtctttatataattgagattctgcaaatgtttgtagttaataaagtatcaaaatataatcagctccttaagataattgttttgagtattttctgatatctattgaaagtcgataactagaatgcatattgtgagtttgcttattattgtatgctttgctgtttaccttaatacctactaatgaaggtggtttttttaagactgaaaaagaaatcctgagcatttgggaatgagaatatccaataagctaaaattaattttactatacacacttgtttaaaaatttccagttgaaaattagtaatttttcttctgtgacagagtaaatgaaagaagaaaaatggacaattttaaagatagttcatgcagtccttgctatgggctgggaatgctaacatttaactaaatagatgagaggagggaaggatttgtggagaaagtttttactagtggttcttggcccgagttcatattacagttttcttgggagcttaaaaaaaaaagacagatgttgggattctacccatgctaatttatattccataaataatcagtagggcctggaaagggctagggcattgatatattttaggatttctacagacgattccagtgtcctgcagggttgaaaataactaatttctccttctttttacactctcagccctttaaaaaaatggctttcttttattttccaactgtctttttaaaatttgaggtggaggtatgaagatgacacagaagaaaatgcaaagaaaatattagcaagagaatcaagttaaagtagtggcttctgctcatagcttcatacagttcctcagattcgttccaggacccctcatggctatcaaaatccaaggatgggctgggtgctgtggctcaccccagcacttagggaggcagaggcaggcggatcacgaggtcaggagattgag

SEQ ID NO: 117228 - DNA, 1024 bp, Homo sapiens
ctgaagcttggaaagtttgttatggggaaatttatcaaatataaattaaggcatcaattcagttgtttctggaaatcttaggagacctaagtgatatctctaaagttattataaattataagaggggaagaagtgttactaataaaaagttattcattttaggttatatttatcatatttacaatatcattgagctgtattttttatggaacatcaggatggaagggacttcaaagattatttagtataactgcacttctgctttcttcttttttataccactgttgatgaggaacggtctctgtttattcccgctcagtgaaaaaattttaccttagttatagtatattgtgtttattgcatatagtttatattgtttatattgcatatagtctggaaatatatacacataaatacactatgataatagggttttatagggttattgtatcttgatatttaggacaaaattagggtccttttagtgactgatttgatgttgcttcctgggtcaggaacaccctcagcagttacagtgtttttttctgtgacaaaatgagagcaagccattttaggatgagttcaatatattcaattcaatgaacattttttgtgtggtggcaaaattggatttggcagttctataaattgcaagggttagatttctgaaaactgccctgataggagaatgtggtacagaaatttagcaccgggtagagtttagaggacgtgttatgtgaaccagtaggagacttttagaattattctggattcaccaaaatgccacaataaaattggtacatgataaagagtaatgagtaccgttctataggacctaattccttttcaacagttctaacatccacagcactctgaaacccaaaactttttctgtgtgtttggtacaaattgattttttcacaaaatctgttctgaactgttctctttatttcatatatttaaaggtttcattgtggaaatagcaaatgtttgattatagtgtgctgtcctaggcttctctgta

SEQ ID NO: 117229 - DNA, 1249 bp, Homo sapiens
tcagattatgtctaatgttttctgtatttagcagctcatttttatctttattagtagatattactatatcaaaattgtaattgtttgtgaaagcaaataaattatttatattcattctcaaagataatttttaaaagctttcttttgaagaattccttttgaatgtagatatttcaataagttagtaaactgagaataattacagatttgaagttgtaaatattttattaccatttattcacacatgtagttttatgctacattaaatgtatatctgttatttttagtagtagatggattaaggtttcagttaaagaggcaatatctcttgtaaaaataaaaatgtagagcagtacaagtaactatgttacaaaaaattgtaagcagggggtatttctgtgagtcttctctcagtagtttttattttaatgggtgcctaatttttaagttttcaagatgcatttttccattctcttcctgtaatttttgaatctaaagcttctgtgagggaaattttcagtttttaccattgactgcatctgcaggtataatacaatattaagattactcttaatttttaagaatatttaggtatttttagcaactggtgtaatagtaaggtatttttagcaacgggtataattttaatgtacactctgaattttgtagctaattctatttctaatcatatttttgtttttgcctgactactataaagtgcaaaaatacatttgctttgaatgggtactgaaactcatggtatattagtattacatagttttatttctaagatcattttacttctctgctgatttttttatgtaaatcttttcttcatcctttttgtagtgcatgtattacaaactgccctaaataattttttataacaaggttggcttttaaataaagtgctgatattacttaagtttttaggatagattgcttctaagaatatatttataaagcaattcagtgagaaaataacagtattcttttcagtggttcttaacttttttttaagatcacataatcttttgatatcaaacctgttgaaaactgtggttttctctttagaaaattctcaggaagtgtatggatttcatgttaagaactccacagctgtctccactattattgatggcgtctgttttcattaaaagtaagcaaacaaaagcaaaaactgatttgtagaggcacttaatactttgtactgttaaattttttgaaatattcttctcaaatttcacag

SEQ ID NO: 117230 - DNA, 1277 bp, Homo sapiens
tgaacatggggaatatatttttattaaggtattttatttttataattcattctctttctacttttaaattgaaaatcttatgttgacttactggaattttttgagtactttttgtctaattgaggtaattttaagttgggaggtttatattagtgaatgtatgttgatttatgaaacagtataattttgttcctttaatttttaagaagtaattgaatccctgatatctttgtttcgtatctttgttattaaggtatataaataaagggtagtggttaatttaaaagtatactgtggtttgatttcaatgggcatcaatagatagcagtaattcttgcctaagcttttgttatgttatctaatttcccagacatatattttaaaattcttagttgactaatttccttttcttaatattctagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattaggtaagactattttgtttattccattatgttagaaacattttaaaaattggaagatactttttaatgaaaatgatttagttatttaattgtttagttgtttaatggttgtggtaattttaaagaataaagatgttggaaatttcttttgtagttgtattttcatgtgtaaggaattccctagtataggagtgtctactttagccatccagagattgactatccagattatgagaaaacaaacaattaaattaaaatagcccagtaggctgaaatagctgccagtaaagcctttgcaatgttctttaggaatgatatttaggccactttttcagattcaaaaatgtttagtaattgataacttttggggcataggtatggcttaaagtcaagttaatatactgaaactgcatacaattaatgaaatttacat

SEQ ID NO: 117231 - DNA, 1126 bp, Homo sapiens
gattctataagcagttaggatctggaggtaaagtcttatattaatttttaaatttgaaataaagtggattgtcatgactttttagtttcaaggaatggtattttaagtttggttaaggaaatcactttgcaaggctatgtttactatacgttttcttactatggtcttaggatcccttttttattttatgacaaatttggagctttttatgtttatgctgatatgagtagagaacattgtgaaaaaatttaatttgcaaatataaaatgcatacttcttccatattcttagtctttttggaggcactattatagctgttgaagtgacttacaatatagtggtaggctgaaaaatggccacatagaagttatctgtatcataatccctagaacctctacatgttactgtatgacaaagactttgcaagtatgataaattaaggattttgagatggagagattattctggattatctggtgggggcagagggacatttacacacacagaaaaggagtaggcattgtgactgtggagcagagtggagagaacctggaagaggcttctagtactttcgcctagagtctctagagggagtgtggccttgcgaagacattgattcagaccaatgaaactgatttcagactcttacctccataactgtaaaaaaataaatttctgttgttgtaagccaccaaatttgtagtaatttgttacagcagccgtaggcaactaatatgggtatgtttttagataaactctaaattcaagtgagattatttcatgccactagagaaaattcatggaaaaaatttctattgtttgttacatttcctttatgttaaaaggttctcacagcacttttctgtatacttctattcaattaattgtaagaattttacttgtatagcttcttgtataatacaggtagaggaattttgtttctccagatttaataaaatggaatttcttcatgtatctttttgtaagcatgtttacattctagtgggtagagctgtccatttcatactgatatcagttttacattctgttttttctaagagcacactttgcaaatgagtagtcattgtaggggcaataagttttaaatgttgtagtaatgtgttca

SEQ ID NO: 117232 - DNA, 1034 bp, Homo sapiens
acaaggatcattaacaagaatggcctcagtctgaagttggacaggcagttcctgggcagatgtcctcacagagtaattttttgtaaagttgtggtggcttttgttccaggttgtggtttttgcagtcttttgtggtagttcttcttatcaggcatatatatatatatgtgtgagaaccctcccttcatctccttccctagctctgtttgtcagggttttaatacaagtgactctgttttgattctgacaacttccatataaagtaaattgatcacttacatttcagtttattgggagtctgttagttctgaaaataaaatacagatgacttcatatttggagtttgtattattcagacttcatatttggagtttgtattattctatatagcttcataatgaattattactatctcttactggcttaagatgaaagactttattatctcacaatttctatgggtcaggaatacgggcatggctttgctgggtcttctgtttagagtcttaccatgtggaaattaaggtgtaagcctggactgcaatcttacatgagcctcagtgctctcttccaagttcactgattcttgtcagaattcaattcctcatggcaatagaactgtgtggcccttacttcctcaaggattcctatctggcatgtggctccctccactgcatggtggtttgctactttaaggccagcaggagagtttctctgctgtttccaatatctctgacttctagactatctttttaaagtctcacctgaataggtcaggtccaccaggattctcttccttctgatcaacttacagtcaactgataggagccttaattacatttgccgtataagttagcctggtcacaatagtgagatcccaggaatcatgctcacgttcaaagggaggggtttatacaaggtgtataagccagaggatgggaatcttgacagtggtgatcttagcagtatgcctatcacatggttattaaagccagtagtgactctcttttcagtagaactggaatctctcctat

SEQ ID NO: 117233 - DNA, 1033 bp, Homo sapiens
atcacttgagcccaggagttcaagatcaatctgggcaacatagtgtgactctgtctctacaaaaataaaaataaaaaaaaaaataagccaggtgtggtggtgtgcttgtgtagtcccaactgctgaggaggttgaggcaagaggattgcttgagcccggaggttaaaggttgaagctgcaatgagctatgcgttccatcctgggtggcagagtgagaccctgtccctgcccccacacacaaaacatcaaaaaaccaaccaactgcccccaaacaaaacaaagaatatttcatgactttgcaaatgctcatatcattaattaagaatatatagacatagaatattgtacattatatgctgcaaagtttgttaaacaaactagaatggcctgtgtagccatatgtttacattgcattgttaaccatgattatcactaaatgaagcagttttattttcttatttgtaatactctattttatgacagtttgtacaatgaacattgagaatctgtaaaataattaacaaaaatgagctatattattaatattagagttggatttcagacttttctagctttatgatctttctagcttcaagattaatcatttttaaatgtttaatacctaggaaaaagtaaaggaaacatgttatgaaaaagaaaaagatactgaatagtgctgttgtttttacttaatagtttagactcttaagtttctttaatatacttgtaaaagttgcttggttattgaactgataaggaagattatattgcaatgttttgcatatgtctgcttatacttttgggttcaaggtcttatatcaatgtggctttttgattttatgaagtagcatcctctgaaagtgttcattgaatcaggcttgctgatatgaaaggaattcataaaattcaaatactctcgtttagcagtgaccataacagtaaaggcaaagattttaaattgcaatttgctatgtgaagaatgataggctgacatcattttacttttaaagggttgaaacaatttctgatttat

SEQ ID NO: 117234 - DNA, 1044 bp, Homo sapiens
attaattcttatcttatttaatgtaatgtattgaatgcattatcattatttattctgatagccaaagggttccagatttggccacccgttgctccttcaagctggcttctctgtccttttgacatgttctcatgaatctttgagtactttctttcttttggtgcagcaagttcttataaacaaactcatcttgtagtttctcttctgcagccccataatcagtccttttctccaagaagttctgaatccttttattggataatggtatttagaaaccaagatttggccactggatatgctcattactgtggtatgttgttactgccaggccctttctgcagcagaactaggaaatgtttgtgcatatatgtatatacatacacacatagaaatatgcctacatatatacgtatgtatacacacacacagagacatacgttaatatctgttaaaaattttgagtttatactgatacacttttaatttcagtctgtcagtacaaaatagtatttcccttttctatatttgtaattccatcccttttccatatttgtatctttttttttaacagtgagaaatctggctatcactacttacaatatatttacttgtttttaaaagctgaggatactcagaaagtagtttcagattgccaaatgataccactttatatagcaagtctaatagaattataacatttgtaattcttattttattgaagagttttttttttattgaagtaaaatttacattgggtaaaatatacaacatttgattatataatttgtgagtattgatgaatgtgcatactatgtaacccacacactatcaagatttagaacactatcattatcctatagacttccattttacccatcttagtcattcccctccttttctagaagcaatcactgatctgatttctatcacaacagatgagttttgctgattctattacttaatataaatagaaccatccaacttcttttggtgggtataatgtctttaagattcatttatgttgttgcaagtatcagtagttta

SEQ ID NO: 117235 - DNA, 1653 bp, Homo sapiens
aagatcagttggagaaggttaggatggatatctttatctaaataaatttggagacaattttatttatactttgtaatagattctctttttgttttttgggtttgttttttttttttttttttttggccttcacctgtgttgtcccttactttttgatagtgtgtgtagtatagctactgctggcaacactttgcttttctctacctttgatttacttcttttgaccttgtcaccaaacttacaagaattatgtctaaattaagagaactagatttcaagagaactttaggaattaagtgaatgcatgtactgggttcagttgcacagaaaactttttctaagttttgtttatattactagattaggtgtttagattagtgaactgttcctgtgtattgtcttgcataattgtgttttgttcttttcctttttaggtttgttttctctttttttaaaaaaaaaatccttgttatataattttgaaaactgagctcaatgaatcttgaggaagaggtatttttgttttttttagggtagtgccaactaaagtaacttttaatatttaagaaggaaatatagtgaaccttttcttccttgtagtagataatttttatcttttttttacttataagaaatgatttaaactttattcagggagaatttttgttgtttgagctgtcttggctttgtcttctcatgtctgtgctttgcttagccaacatgtcttttggcctcattgtttttcattatggtagaaaatgcagtagtaagtttatttttgcaaatatatgcatgtatcatagaaaacttcctgcttctgtgtgaggcatcgataaatttgagttaacgaaaaagggaattttttttgttgaaaattgaattgaaatttcaattgaaatggaaacagtgttaggcaagtgaggaatgaaatctgatttaaagaaaaataaataatgttgagatataagagtagaatttttaaatagaaaagcattgcagaaggtttccaatcaacattgattaagtgatgaaatgctttccaaaatgaaaaaaatgcagacaagtgggctgaaatcttgccctccacttattaggtacctagttttgaagtagtcacttaatctttctgagctttactttccttatttgggattacaaataactgttttcagtgtagctgtaattttgaaagatagtatatatgaaacatggacacagactcttaatacgtgttgattattttttatggtacatatattcctgaagaggaaaattttaatggactatgtacctttttaattggtttcaagacctatttaaaataatctttaatgatacctattttaaagaaaaataatcactttctggtttccttaggtgctcatagcaagagttcttataatgattcttggccttgtggaaaaacattcgctttcaaacaggcctttgtagttaagtgctttaaaaaatgtgaacaggctttaataggggccagattactgttgggagacttttttcatgtaaaagaactgttaaagaccctagggggtgttctttagttactgtgtttcaaagagaaagccttcctgtgatttctgtaacttactacatggtaaaatttatttccagatatgtcagttggtgaaagaacac

SEQ ID NO: 117236 - DNA, 1038 bp, Homo sapiens
atcttaggagtgtcttttatcatttaagaattatgttagttgacatttttcgtagttgttgtcaggatgaagttggcttgtaattcctagtttgctgagatttttttaaaaatcattaatacgtgttggattttgtcaagtactttttctgtatctgagatgacaatatgatttatattttattctattaatttggcgaattacattgattgatttttaaaagttaaaccaaacctacattcctagaatgaaccttacttagtcatgaggtattatctttttaaggatttcatgtttgtgtttatgaggaatatttcttatagtttcctttaattgtaatgtctttatctgttgttggtaacagggtaatgcagtgagttgggaactcttccaatcctgggtttatgtagaattggtattattctttaactgtttaataggattcagtagcgatgctatctggattgtattttgggaagtttttaaataataaatttaatttctttaattgatgcagagctattcacattttcttcttgaggcagttttagttattagtagctttcaagatatttgtccatttcatgtaagttgtttaatttacatgtaagttgtttcgtagtattcttttatcattcttttaatatctgtgggatctgttctgatgcctcttctgtttcttctgttattggtaatttgtgtttctttcttttagcctgctgagaggattaatgattttattgaactttccaatccagcttttgttttcattggttttcattactgattgtccattggtcattgatttcctcatttgtcattattttgtccttctgtttattttgggtggtattgatatgaaggcagatacagataagttggtcagaatacagagtctgaaatagacttatacatagatggccgattgatttttgagaatggtgcaaaagcaactcgaggggaaaggatagttttgccaagaaactatatgagagtagctagatattagtattgaaaaaaatatatctaaatccttac

SEQ ID NO: 117237 - DNA, 1831 bp, Homo sapiens
ttgttttatatattatgaggataaaatgtttaacatattgggtttttcttcttccatgcatgccatatgcattaaataaatggcagtcggcagaccacagggcagcttgggactcccagcaggcaaatccccaccatttgagagctcaccttgcagcagacagacatggtggctcggtacaggtattttctgatttttgcatgagtgattattacccagatttatacaactaacccttttttttggaactcatggcatgatttcatatcttaatggaaaatttgttgctgaactactctatccataattctattcctttgttatttaaccagaaaaaccaaaattaacgtggtctagaaagaccatcaggaataccaagatttttcctttgttcatttttgcaactatatgctacaatatttaagtcatatagcagattagaaaaacaaacggtattatgcttgaaataggtattaaacttgactttccaataataagatcagtctttttaatgcttaaattaatagaacatttttgtattttttcccattcattgactttgcctccttcaaacataatcagttaaatatcttttttcatccttagtactcagaatgtactttctgattaattgttcaaacgaacatgaccctaatttttataatacatgttttgtttgtacttatagaaaatatcagatggaaattttaataagaagtgtttattaaatactcccctcaataaattgtatggctttttagataaattcaaagcagtcccttatttatgatttgtttcttttcaccttttttatacacttagagaccgctactatatatattctgccctccgttgccccataaattttaatcatttatgtatattgtagaaatagggaaagattgctgagtctcgtattgtcttttaaaatatcggtttaaggtaatctaaaagccagcttaaagtaagtgagataacaaatgttatcccagtacatttcaatttagaattttttttacattttcatttttttctttacatattttcacttgaataatttgccattttatcaaatttgcatttttcttagtgtatatatttaatcaactgattctgtactctgggtgctattctttcttgatttgagttctaaaaattaaattatgattaaatcttatgagccctcacgtttttctcatcattaaattttagaggtaatttaaattatataatggagtacttttgtagaattttgcagtttatggaattttcagtaatgtgtggtagacttatttgagtagatctataaaagtctagggtgaagaacttagaggcaagagtgtctaaattgtaaaaatttttatgacttcaattcatatagttagaaaagctaattcagcaaatatattctatttgcataacacaaactatattttgtatgtatctgtatatgtttacatgtttttaagtttgtgtgtatgtgtgcaagtgtttttgctcagtgtaacaattaaggcactattagaaaattttcctaccatttctgtaccattaccagatttattttcttagcctcttcttactcttatgtgattccttgaggtggctcgtgggattcctttggactgtcaaagggtgaatgaatttcattattcattcattatttcactacttcacgtttattgtttcacatgttttcacagagatgtttgaacattgctcgtttctcattatttctaagagttttcagcgtactgagactacatctgacttcatcctaatattcaataagtgattaacttaataggtttctagtaatatggaaatacat

SEQ ID NO: 117238 - DNA, 2132 bp, Homo sapiens
catgaatactgataaatactgtacaaataatttaaaatagggtgtaacataatttctgtgctgtgtcagcatagaaatttttagctgtgtgatagaaaaggcctgtctcagagatgctgtttgagaatctgaaagatgagaagtcagctaataagtaggaagagaattctaggcagtgacaataggtaatgccaaggcctttaagtgggaagaatctcgacatattggatggaggctagtgagcttcagagaagatggtgtaagctcagagaggtaggcaggcatcacatcatgtgggactttgtcaatttgtgtaaggaatatagattttttattctaagtgaaacgggaagccaacagttggagagttttaagcagagagctatacatgatgtgatttgcatcttaaaaggagcaccctgattgctgtgtggataatacatttgagtgggggacaaagctgaagactagataataggtttttgctcttaatcacataagagatcatagtggcttggactggagtccttgtagtaatagagatggtgagaattgattagatatgggatatgtttggagaaggatttaacaggatctgccatttatggattagatgtgggttttaagttaaagaggaatcacagtgacccctacgtttgaacaactgggtgaatgaatggtgttgtctctatttaaatgggcagtttgaaatggagacttgagcataattgcagattgaagtgaaggatccattagaaggagtaatattgaagtttttcaatattcaaggaaagtaattcatgatatagcaaggtgccagaggacatagacacacaagaggaaactgattgagacatacatgcaggagttagccttaaaaaccagagggaaggagacagaagacacagatttcaataaggaaaggaagtaagttgaaaagcgcatattagatgactttaatctttaataaaatgctagaccaattactgtatttagttatgaacagctacatattgttttgtgttcctcacattaactttctaattgaaatactttaacaattatgtttatccttgtataacctatttaatatgtatgtatatttatgagcatgtgtgtgtacatatacatatataaaaaatttttttttcaaacaggttgtaagttctacaaatggagagttaaacacagatgaccccaccgcaggacgttcaaatgcacccatcacagcccctactgaagtagaagtgatggatgaaaccaagtatgtgtttgttttacttgttttagtaactttttgttcttaaattatgcatgcttgagatttatagttacatacaattatttcaggaaatttttttcagggaataggtgcatgcaaaacaagtggtatgcttaattattttaatcactagaatgagtttaaaatagtgctattccagtaaacattttaataatacaaaatatttaagaactgtgttcaaattcttatttggaattaacaacatatttttagcttttgagttttaggagtgttgatgcatgaaagttattgatgtactatcaatcttttttctgtaagcataagaaattaattttataaaatgcatgttttaatattttgaattagttttttcaaaacataaattataacaacattgcttggaaaaaattaagcatgaaaaacaatgtgataatttcaatgtgagctgtttctgattctctctctctcttttttttccttgtatttttttttttgtgtgtgcgtatagctgccagaaagtgttgaacatgtggtgagtctcaagtgtaggcaggcagaaatagctccattgactgtaatttcaaagatttagcatcattttgtgtcttttgaaaacaaaactctcaacacagtgattataattggtaaaagttattcaaaagtatttgatatcattaagatagctctgaaaagcaagaaataattgtttgaggagctcttttgcctgctgcaacttttttactttaagtgacatagatttggggccactttttaattgcatagatgatacaccaaccctgcttgtgcttgtgcatttgttttataatagtttttatttgctatttaaatagaaagatagatttttgca

SEQ ID NO: 117239 - DNA, 1069 bp, Homo sapiens
agtatagtcttacttgtgtgtttttaaatcaaatataaaaacaacagcttatgtttgggaattttaggtacaatcctaagacaggaaagtagggtggtggtgtggcagattcgactgcacatgtcctttgcagttagacataggttatagaatcctgtttctgccacttatttgttaccttcaagaaagcttgtttctttttctgtaaaatgaagctaataatacctacttcataggttgagaaaattaaatgtgataaagccctggtattttgtctggcacacggcaggtactcaatagctattatcacccctatttatttcttctcttccaactgctggtgacgtttctcatctctgttcttgggcttgtgcctcttttatctgtgtcctatatttttacttccatacacacactcttcactgaaactggctgttctgtgtttacatcctcctggagacttgcttttaataaaatctattacatttatccatttattcattcagcagttacactgctgaggtttctgacatacctgatgctgtccttgttcttaagtagattacaagccagcaggaagattgcagttgtactagtatatgtcagtatgtgattaatacgataaaaaaggtattttaaaaaatggttagagcttgtaaagataaagattacttcctgacctggatgatcagagaatacttgatggaggtggctctgaagaatggcacagttatttagttgggatgagtgtgggtgtgtgtttgggtccctatctgtagacactggaggatgtgaaagaagaaagtggtgggaaggctattgctataggaagggttctccattgcctgccacatcatgtccagatttcttggcatggcaccaaggcttctcatacctgtcatagtctggcccatctatttttgcagctccgttttccattctgaactttatatagcattggttccttaaatctgcatttgctatgttatcctctgtatgtacttcccacttcttgaaacttactgaatttcttgaaaacaggtattttttcatcctcagattcctagtg

SEQ ID NO: 117240 - DNA, 3474 bp, Homo sapiens
atggaatcacctcaattgtgctactttaaatattaagcatagtttttaccttaactaaactttcaataagcttgaccttctttaacccttaaagaattcaaaattgccagtcttggtattctatataatgtattttctgtctttcacttttttaatatgatggaaaatgttgactagtgtatattggagtgtctttttatttttggagtctaaactgattattggtgagaataaactccccaatgttaggatcattattgccttcctaatggcttcaacagtcacatataaatatcagggagaaagggtgagaatgcatagaatgaaattcttaattactcttagtgaaaaaccttttgaatttaatggctcctttttatgttgcatagaatgtcttgctattcttaaaaggcatgtgaatgaaacataatagtaatagctctgccatattttcactaatacgtatgcttcattggtgtaatcactgtttatcttgcactagcctgttgctttttatgatcatttaagttaaagtgatacagtcaactttgtgatattttagtgcttttaaaataaaaagagtgtttccctcatctgcaggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaacttgctctttcccatttcctctaaagatgggtaaaataatgtcactccctaatttaagataggaattataaaaatttggtttatttagtctgttatatatgagaagcagagctaaaggaatatgcttttgttattttatgttttgttttgctttcttgaaatccagtggtaaaaagcacacactaggaaggatctaagctttctttaatataaaaaaaattatacttctctgaactgtttaatagagcaataattaaatacatcttctgataaattaagggaaatagcatcatttttcctttttgagaatggaatcatactattatgttcacagaaattaagcattattccagttttaagtgaatgactttaaaatcattgtagatggggagcccatatttctaacagtatctcatagttcatcattgtgctaggtgctttaag

SEQ ID NO: 117241 - DNA, 1100 bp, Homo sapiens
ctttgaattgcttgaattctctattcaagaagcttgcctgagaggaaaggagatagagaaataactggagggaggagcagaatcaagggagagtgttttgcttgtgtttttaggattggagaagcttgacttttttttactgagggaagaatctatcagtgaggatagactaagctcctggggagagagagaatgtggaggaaaataaaaccttgggaagatgagctaggattccaaagaaaggggaaagtgaaatgaagaaggggctgcccagatttaggctttgtagagatggtgtgtatgagggaggtaagaaagggattggctgtggtgtttttgtttgattgagatgtaagtgagtctgagaggaggctgcccacaagttgctgtttatctgagagaaaacggaaccatcaagagactaagggtggttctcaaaaatttcgaagagcaagcataattatttcaaacttaattttgttatagtatttgctacccatggccttcagttttccttcgggcaatgtataaagttactgacttaaaaatgattgaattataaacttgtgttgaaatgaagaactctttcctcctctgccatggtaagaattcatttttaaaaatatcttcatatacataagaaatgtttcataagcaaattgctcttttaaagagttcttggaaatattagatgcattatgcatgtactgacctttcatgaatgttccatattaatcatcttacattgttttttgtatagatgtagaaatctagttagttcaagatctaaaaattcagtatcaatccaacacatcattttgctgtcagataggtatacagcacatatacccctaaacttaaaataaaattaaaaaaaacaaaataagggacaaaaacaaaaactcccactagttttatatatttacattatgaagattatatacaaaggaaaaggctttcctaaatcaggtgttagccaaaataaaaacaaagaaaatacacaaaattctattgctttgaactgatttcattaatggaaataaataaggaatgtaattaagtagaacaggaaaatgatttcagatttctttgttgtacat

SEQ ID NO: 117242 - DNA, 1024 bp, Homo sapiens
tttagtctattgcacttgccaagttgcctcttatgctactgtgtgaatagaaagtaagataatatgtttgaaggtgtttccaaaactgggaagtgatatacaaatgtgaaggggtcatttttatttattcaggtctttttagttgatgtcatctagtagtgttaaaagagagctttcctatttcttaaacaatttgtattgagtgtaataagaacttggaagagaaagaggttttatttctagtctaacacattatatctatatataaataaagtatatatgagaagaaaacaattgtctcttttaagataatattattgttattgtactgtcttaagttacctctgggaaaagaaaatatatccaaataaaagacctagaaggagacagtaatcttccctaggtttgcatttgtttactctatttttccccaggactgtcttctatagaatttaaaagaattctctgttaggcaacatcatgccatttggagctattacagtctctgactgctacctttgtcttgcagggtgaaagttaagagcatttctaagtttgatttactgattctgtgtatcttatgggatgcattgtgttcagtcactggggaaaatgttaaagtgataacaattattatgaaagtattgtattctaggcaaatagcatgccgcttctgtaattcactgtgacttttgattcctgttgttacctggtatctgttatttctcctgagcttcctattcagggaatgcatgcaaaccatttagcaccatgcagagccggagagatggaatgctgtatctccttcgaatagctattaagaaaactgcagagtattcaagaaaggatagatagcagatagaccaaatggtttgtactgtgtccttgctgcatgaaacagttcatgtgtgtgtttaggagaggacaccatgctgctactaggtctgcggcccttctccactgggcctgtatctactcttatccttctaaagatcacagacactctacattttttccccattag

SEQ ID NO: 117243 - DNA, 1355 bp, Homo sapiens
taccgcagcaagtctcctgctgtaagcctccttttgttgttatttaaaagtactgtgatttggggagaaaggggaacaagctagagaacagtcttgaaatataaatggtttcggaacccagctgtgatttcaggatgctgttttatcctaatacgtaaagaatggagcgttcaaaagtaagacgctttcacacatgagagaaaattgttaaagcacgtatggcagtagcaagcttttctgttgcaaaatctagtataccttgcttacccaggaggatggttgttaggtggaaatttaaattcataggaaccaacttttggtgcaaaatatgtttgataagacattgaggaattaggtaacagaggagtatattttatataattttggtaagtaagtagttcagaggctacaaactgttgactttttgggcaaatcaagcttttcaaaaaatgttttcttgcaggataccttttaaaaatcagacattttacatgcaagttcagatcacctctttctcttaagacaatagaaaatctgggccgggagtgagccactgcctgtaatcccagcactttgggaggccgaggcgggcagatcacctgaggtcaggaattcgagaccagcctggccaatatggtgaaactccgtctctactaaaaatacaaaaagtagcctagtggtagtgggcacctgtaatccaagttactcagaaggctgaggcaggagatttgcttgagcccgagaggcagaggttgcagtgagcagagattgtgccactgcactctagcgtgggcgacagagcaaggctctgtctcaaaaaaaaaaaaaaaaaaaaaaaagacaatagaaaatctggttcaaaatgacatggcagtaactgatgggaactagtagccccatctaggcagatgtgctgctccccatcaatgtgcatggatataaatagaagctccctaatctgcatcacttatctttgttgttaacttgacttctggagagatttgaggtttctgctacttgtattgacccttcatattcacatcatcagtgttcatggttgggggttcatcacgagcaaagctgagtgcccgtgacatgtaataaggcacaaatttgagccttgtacagtgtgaggctcatttgcaagagtaagtcatgtggcttaggagtgagagctgtgtctgctgttttctggccttgactctttgtcatgtccctttaactctgctgaagtaatacaatgtctgtgaaagatggctcttccccaaaaaaggtgactgctctagtcctagagactgttgtgaagagagactaaacaaaaataggatggtgcttggctaggaaagagtttaaag

SEQ ID NO: 117244 - DNA, 1129 bp, Homo sapiens
caaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagtaagattgtggagcgtggccccaacagggagagagcagtctgagacttgtattatacatgtctgggcttgatctggttagacttctgacacaggaaagaaacccatattagttttttcctctgctcttgaaaaatatcttaagattctcaggagttactatgtagctctaaaatgtacattatcagtattttcttgtcatggtgtatagtaaaaggaactgtggatgggtgctttgcagatttgtgtttcatgccactaacttgctctgtgactctgatgaggtccattaatttctttttttaaattttttaaattttttgagacggaatctctctctgtcacccaggctggagtgcagtggtgcaatcttggctctctgcaacctccgcctccgttcaagcgattctcctgcgtcagcctcctgagtagctgggactacaggcacgtgccaccatgcccggctaattttttgtatttttagtagagatggggtttcaccgtgttagcgagatggtctcgatctcctgacctcatgatccgcccaccc

SEQ ID NO: 117245 - DNA, 1082 bp, Homo sapiens
cagctggatattgaccacctgtcttcatgggaaagaaatagatggcagtgaataagcgagagtctagttttccaaagaagctcaatgattttcccaaatcaatacagctcatcaggcctcagaacaaaggctgcaggggaggtgacagtgatggaagtggctctgtgttcttttgtgtattaaaccataaggcccatggggaaacaaggtttctttagctgtgtgtgtgtgtgtgtgtgtgtgtgtgtgtgtgtgtgtgtgtgtgtgtgtgtttagggcttattctgtgtatttagggggaaaatcctttcagattttttttttaaaaaaggatttccatagattgtataccaatgaccaaatgtacttttgaaagagataagtacagtcaagtaagaaagattatcatgttttaaaatgcagagtagaacagcatttttccattgcttttgttattgcttaaggtttcattttttgttgtcgttgtatgtggattgggtttagatgaaccaaaaacaagtctgtgttcagattaacctctggcaaaccaagaatcgtaactaccctcccataaacaaaccctgttcctaatgccctgaaaataacaccaaaccctaataggaatgctcaactgtcatctgagaggttataattaacgcagatagagtgatgccaacatattccagccgctgacagagaagatctatccaaaccagcaatttttagcccttcagtcctttaatctttaagctcactgtgctttcataaagtagtacattaacaccagagcagtgtgtctctggggtttatgactggggtggcggcacactagggcataaagtgtttcattacacttccttttgttagtactgccctatctcccaagctccattgccatacactatttgttcagataaagccctatgttcagggtgactaatcgcagcactgtgttccagatggtttgattacaggatgtgtttaaagtgactcttcaaacattcagcccagcggtagggctctttaaaaaaaaaacatactgcattttatggtcatgtgacaacacttacttttcctgtcct

SEQ ID NO: 117246 - DNA, 1065 bp, Homo sapiens
gacttctcaaattcagagcattttacacccttctacgcccttttagtcctagagtactcgtcttttggtgagtggcatggagggggagtttttgcctgaaggatgatttatttttgtctggcttgctgttctctttacctgtttttttctagtcgaagtaatggcatcgtggagagcttgggtatctgagttgttaacttaaaaaaaaaaaaatcctgtaattaatattaagtgcaggaaaggactgggaccaatgatttgaatggctgcactctttcagttgcttatcttcagtgacctcctgagtctgacagtgggagtaagtgaaagctgtttccctctcattttgacagaccctggccctgtgctatgtgcccagggccacttgtaatagccgtcttctaaaataacactcttaggaaaggaatgaccattaggaggtaataccacaagatctgtgtcattattatggctcatagtaggcctagttcaataattacaaaatacctttcccaaactttttaacacttttatttaaaagaagaaaaatgtgtcctaacaagctaatgatacaagcttgtgagactggattggggaggggagtcaattctgttacagtgggcattgaacctttgtcttcccacaaagagagggaggaggaagagaaggagaaagcattctgctactctaatgaggaaatttggctttaaaaaaggagagggtttgagaaacctgccccacactagaaatcgtcatccaaactcatcagatttcagaccaaccagtggtgcctgacaaggagcaggagaaaaattaagtttcaaacttggcattagaaatcagagtgatgctgttgcttagtttggtggcactaagcctcaaaggaggcagctacttactaggaagtttaatcaaagacaagaaataaaaccccttggtacaaatgtatacagacacacactctatacatgtacatattcagtttatgcatttgaattgctccaaatgtctgtctcagaagactgtatttttttatttgattctatcttcctgtcctcctttgtc

SEQ ID NO: 117247 - DNA, 1019 bp, Homo sapiens
aactttacaagctgaaggggctgacttacgggcagcatttgaacaaacttctagtcaccataatttagtaagggttggctgccaaaagccatgtaaggctttatttgatccatttatgaattaagagcctgcagtaaattaattaccatatattggggctaataaaatctagcaggatgagaacgcctttgggttcatctgcagagaggaataaggactgagagctgcttcctggtgtctgagtgtttctggctcggggccttctgcagtgctgggcaagggtggtgttcgtgctctgtgtccaccaaagaggcatttgagctagcttttggctttgcaactgctggaaggctttgctctattgatcataataagctgttctgtcttattaaagttgcatcatggagtctggtttttaggagccctattgagaattagttgcagaagaagcgatttgcttgtattttccgacagttaacaggccaagcagatgggagagcagacctgaaatagttgggttggctgcctgccactgttctatgaattttgatttgcacggatatgtaatagttgtatttttcccttttttggaagtacttgcctgtgagccttgggaaaattaatccttggtttcctgtaaagtatacccttgtacgcgaatgttgctgcagtgttccttacagaccctgtgctgtgtcctatgtcaaacagatcaggacaccatagactgtgtgttcagttgaagaggagaagaggagagttctcgctccagtttcccatggctcctcagggaaaaactgttttcattcacaatttactttgtgttttaagatgttttccctttcaaagggggggattatttttcttttccttcaggctgtgttcaccaaaatattgaataaatgcaagaaaggatgttaaatttaagcttaagaaaaggaatttatagacaaatgtgaaacaagcatgaatgtatctgggtgaagatctgagttcttcctaaatcagttaaaatcttg

SEQ ID NO: 117248 - DNA, 1051 bp, Homo sapiens
catagctgttatttattccatgacctgaaatagagataatttcagtcaatatggaatgtgccatcataattatccttctacggagatctagtcatttaatttatcattattgtggtttgcttggcctatttttttttcaaatgtggcttcagcgatgcttggttttcagaagactataagcttgggacttaaaacagcagcatatgaatggccagagtccccctaacccagccctacctccctcccttataggtccttgccagatcattatgttgggcttgagctctgtttttatctttacttatcaacatgagctgttcgccaagctggtttttcacaaattctttcaatgttgaccagccctttaatatctgcacttctaagaatcaaagtcctaggaaaagacagatctcataagcactttccttctacaagggacagatgcatggaagacacctccttaaaaccaaggtacactgctatgttctgtggtaacaccaagccacggggcagggtgtattccccagagctccaaagcactctgctatcttaaccaaagcacattcagtcacctgtattttcaagtttttcttctcagcctagaaaggtgctttttcctttagtctacctacttcagaataataacaggtacttgcttgccttccttgagtggagactgtaaaaggtgattttaaatatcacattgatatcttactctgaggcagggatttttctctctcttgtccatgtatgtagccccggtgcccagcacattggctgttaccaataaatatgtgttgtctgaaggaaggaaggacagaaggaaggaaggaaggaaggaaggagggagggagggaggaaaagaaggaaggaagaaaggaaagaaggaaggagggagggaaggaaggaaggaagggaagggaaggaaggagaagtcaagtgaactcatgacttgacttcaacctgactgaaaacaatcttcccacttctgtccccgctccctcccatgttgctcaagtcctacacaggcacccagagggagcttgttgca

SEQ ID NO: 117249 - DNA, 1048 bp, Homo sapiens
atttgagtccttgggtgtcagaaatgtggctgtttcctttatgtgacacaagacacatttggtgcatctgaacaattaaacacttttgcctggagaaccttctgttgctctgtcaacaccatctagttagcattttctcatttacggagatgagtcccataattaggcccattattcttatggaaaaactgagatacagaccatccaaagaaaatgactgtgggaagtatgttctttctggatttctagttttatctaatattattagtctttcctagttttgagtctgtttacgtgtgtatgaatataactagctatttaaaaaatatgctgtgagggaaataaatacacatttgcttgtccgtttgaggttttgactgaaatgtggaaacttaattcagcttattaagtgaaatgtttttaaaatttgatattcaccaaatatttttacaaaaacaccccaagtgtagtttccaactatatatttcataacaaggaaaaaaaattgcccaccacttcctgtgcctcagagagtcaatgccttgtattctcctggcccagtgggcagttttgatcctgccagctcttcgaggacttacttgtacctttgcacagtttgtatactgtcttgtggatgtcttcctcatatccatgttgacagacaacttttgaagtaactcaagttgacagagctgactgagaacatttaatgtgtcttatttcacttgagcagcagcagaggccaacttgtttaaagagaacctgcaaaagctgctttccactgttttcctcagcttcatgagaagacctagtcacttttcagaatacaaaaagccagccagttccagacagtgcacacagtgcacatataaaattatttattgtccagacaaacatgtgtggctgggtaccagaaacacagaagagccacaactgggactggggcattggcttggctccctcttgaagctggctgcagtaagcaagtgtgtgagagtcactttcagttcaaaaagtctgaatactcaagggcagacacattaggagg

SEQ ID NO: 117250 - DNA, 1143 bp, Homo sapiens
cttgcagtgagccgagatcgcgccactgcactctagcctgggcaacagagcgagactctctctcaaaaaaaaaaaaaaaaaaagattaatgaaatgttaccagcttcacagaaaaatacagaaggtaaaaaaaaatggaagacaggtcttcacataggcgtacaatagacagtcaacaaaggcgtactgaatggagagaaaggaaggaattgtccggggttttgtgccattttcctggatttgctttactcttggacctacttgttttatgctttcccgatgagggaatgcagccaaatttggatatgatgagtgattgtgtattttgttggaaagcaacaacatagaccgtcactttaactcttgtcaatgtgaaaaataagctgctgttgagtaggattcagtttaatgtttttagatcaaatatttgttttttggtgtcatttgtgtatatattttcgtggtgacattaggtgctaagtaatgaaccaataggtttaaaactcactgtgtaaagacattgttacctctttttttgtgttggttgatattgtagccaggtttattattatatgtgaatatataatggaaaactttaaaactttttttcttaggacttagttatagtaaaagatgtaagcgctatcttgtaatatttgtgtgtatatgtggtattgttctgctttttaatcttcttcctgtaaagaaggaattagtaagaaaatcttgagtgtcttaatattatagtgactgagctgaagatgtattttctaattacaaaatggagatggtctcattggctgcaaagaatagcttgtaatcataggtaggcatttgattaaagtattccactgacatttaaaaaataagttctcacagcagctttattgagatataattcacataacttaaaatctacgcacttaaggtgtataattcagtgtttttttctgtgtgtattcagaggtgtaccaccatcaccgcaattcatttcagaacattttttatcaccctagaggaaaccctgtaaccctcaacagtcattaccacttactccaatccccccattttgttgacttttacatcattgtccttgattctttgttgtttttatgtgtaaacatgtatgttttgtagacaata

SEQ ID NO: 117251 - DNA, 1035 bp, Homo sapiens
aacagctgtaaagcttgggttatttttcactttgcttagaagtctgcttagttttgacttttaaccttagcctcttctcaaagataagattatttaggaaaaaaatctgggtttaaaaactatagcagtacataagttggtgtggaattctgggcatatgcttaaagagctgtaaggtattattactgttgttattatttgatagtgatatacataaagcctcaccagttccactctgtcctctgaaaaactggtctcctgagtccaactgcctttatacgtgctctgttccatccatttctgtgaatatctttgtacattcgtacagcggactgatagctttagaaggttttcaggctgttggcagccccagccttctctttactgcctcacattttccaggatttggaatgtgtggatgtttactgtggtgacaagaaggagctggagctgttaatagagttattcttgctgaataaactaaacttctgacctccaaagaatttaagaactcatcttagtaaaggcctgggtcataagatgtatgtttaatgtgcaaccatttgcaagagcgttccatttgcatttttctcactatagtgtgtttaaagctcttgtaccaatttaaaaattaaacccacttgaccattaattttttccttttgggagaaacaaagagagacacagaacaaacacattgggagccagttatttggcagagctgaaagagagggattccaggagaaggggaggggagagtaagctacaatagttttgtagtgtgaggtttcactaacaaagagcttcaagttgagcatttataaaactgtcaggtgcctttgactaatgtcctgtagatggagttgaataaaaccccgtccctggtattttcacttggagagagagtattgtgtaactggtagtgttttccacaaacctaatttgttacgtgcgttcatatgtctgtgaaggtcatatatgtgtgtgtgttttaagatcctagaattttaagagttcatgcctgcactctttggg

SEQ ID NO: 117252 - DNA, 1091 bp, Homo sapiens
ttaatcatagctgtgcatctgaattatccgaagagtgcttaattgttttcatttccacaaatattcagtctcaggcttcctaacccctattctgattctccaactctaaaggttggctcctttgtatgcatttagcaaaagcttcagatagcttatttgaagatatcttctccaaccctcaacccccacctccctgccctttctcaaaagggagatgttaggaatagttattagaatttcttgcgtgtgtgtgtgtgtgtgtgtgtgtgtgtgtgtgtgtgtgtgtgtattttaagggtttatttatagaaaaatcatcacagtattgctttaaatatgacttcattaaggtgttttacaggtggttaattagtgtacttggtcaaatgggaggcaaaaggactaatgatttgcagctccagccctaggaatatttacagccggtaaatacacttactgatgtttcccggaatcttagggcagaaacatccctgcacaaatgaattgcttaagtagtaaagatgagccatagctttgcttagttagccattttggtttagtagaatgtagataattgccatggaggcagggggaaacgttttgggagtgtataaagcatgaagttgtaagtattactgctataggtctgatctatgcaggtcatctcttctagtcagctgggcttcagaaaattgccatgttgctcttgtgctctcagtgtggaggtagccagtaagtcctgctgatgttggccacatgtggcctttaggtagattgttccctcctgcagaccttttactcttgatttctacctgggtcatgatccagggagagaagctctagaactgggaattgggggactggtcccacttgatgatttggctttgagttctttttttttttttttttttttttttttttttgagacagagtctcattctgtcgcccaggctggagtgcagtggtacgatctcggctcactgtaacctcggcttccttggttcaagcaattctcctgctacagccttccttccgagtagctgggatgacaggcgcccgccacctcgcctgggtaatttttgtatttttaa

SEQ ID NO: 117253 - DNA, 1104 bp, Homo sapiens
tgaaattttctattgaaaatcctggcacatttagaacacagtggagaagaaatttactggaggagatttgcccacttgttgcaaaactctgttgctgtcactgtaagacctttggtgctaggaactataggtaaagggatgaagttgaagtgtaggatctcactgtgattttgaagctctgttacagggtagaggcctgtgttaagtacaagcttgagatgggagagaaagagcagatacagcaactgatgctgaattgagagaggatccaaagcccggaatcccagttggttggatgtttgcactttttttttgtctggagatgcttcctagtctgtttcttgaccgactgcacatgctgttaaatccactcaggtaacacatatgtgttgggcgcacagcccatgtccagattggactcggagttgggcagaggccaggtcatgcagggccttgtaggccatggtaaggaatttggattttagcttgaatgcgatgagaaaccatttcagaattttgagcaaggcagtgacttttttttttttttttttttttaaacaaatcttactgttgactgttgtatagagaattgactgtagagaggcaagaagaggacaagggaaatcagttgcaagactttttcagtggtcctggtgagagaagataggcttctttggtaggcatggaagtggtgggaagtggcaagaaatggtcacgttgtcctgagataatgaggatatggatatatgtggagttgtgaaagaatgagaattaaggaaaatacctggattttggaggtggatggaatcaagagttgtgactcatttttgatatatcctgtggctgccaagtgattatggtccttccacaggaaggccagggctggagacacctatgggcaaataggtgggctttaaagttattgggctggaagaggtcacctctagagttagttccaatggaaaagactagggcccagaggtgggctatggagcagtaggagccagcgccgtgtccattgagggggaagaaaacccagccagtctggtgtttctggaaagcaatggaagaaattctagcaaggaaggtgtgatcagctgtgtc

SEQ ID NO: 117254 - DNA, 1827 bp, Homo sapiens
ttagagagtaagtaatatgtgtatgatattggtgccctgtaactggtatgtcataggtgtgtgtatataaatgttgtaactgcatatacagatgttggattgggagtatttagttagtatgggttttattctttaaaaaatgttcactgttggttttacgttccactctgttgcagaatatatggacctctccctctgtgtctaattctttctcccaactgcagtttcactagtgactacttgctccctgtcacaagttctttttaatttaagctcaaggttttggcaatgggaacaaagcctttgcaactgaatgaaaggttgttaaactattcatagttgattgaccagcagttgggctgtttgtaatgttattttgagagctcaaaggatatgcaacctcttgcatatccaaagtgagactttgctcctaaagctgaattttgcatatttgctaaatttttcttggaaatacctttgggaatgtagtagaaaagatgatgggttttgccttaagaactgaaatgatcacaaagcaaatacttatattttgctaggtctgtgggccttgaaccacagggatcccatctggtattcagaaggcttttccccccagtgaaactaaatgaaaacttaaaggtatatattgtaactgtaataaagaactcaaaggaaaaggtgtttcggttagaacaaataggtttgaaatgatgaacaaatacttctgtggatttttcaaagccacttactcttctttctcatttccaccccccgacctagtttgaatatcattcactgtgactattccaacccaactactgagctttctgcctcctgggaatcctcattgtcagctagcaccttaagaaaaatgtgtctgcagggacatttaggcatattccaataatgccacatgaatgtagcttttacagtttaaaaagcaagtaaaaatatattgattatattttgtgttgtacataatgatttcagaaagcagatatttaggttgtggaattggcttattatgctaaccagagagcagatggcatggtgccacagacgtataattttacttaaagggacttttaaggttttgatgtgttttcttttcctcttatttccctgatggcttcttttcattgaagggtaacttaaggagacctggtagcaattttactgccttcccctgacagtttgaaataatagcttggtctttggttgcactgatcttctaccagtcaactcgattctggtttttgtcatgtggcagagaatttttaaaaaaagtgttagtagtatgttttaagaagtggactcttttatatgcctcaattagcaacagacgacaaagttccaattggtcacactttcataaactcctggaagtcactgtttgtccttttgattaaagaaaactcctggtttagtttcttaggaaaagcacatctggccctctggccgcttttggtatacctttttgtccttcgcattagtcactgaaggttcaaaggttgtgtctaagttgttcctagttaggttagaaaattttccccatgctggaggaaatgtacttttttttttttaaactacactcatcatgtgtttggattcagctggcataaaagtaccttttgtttttgtacctagattttacagttttatccattattcacctcacacatcatcaggatgagttggaaagcatcttctaacttttttttccaaagcgtgcatagccagaccagtttacttctggatttcctgtcacttccttggctgattttatggatggctcatgttaaaaacaacaaaaatgtttgaactgga

SEQ ID NO: 117255 - DNA, 1040 bp, Homo sapiens
gtctacaaatggacctgtccataaaggatatcattcattttattttattcttttgtagagtcctttttatacttcaccagggaattctggcacattttctaagtgagtgtgagcagtttaagaacatattttgattaatgagttttgtggacattatgctttttttttttttcaaatatagtgtcccatatgaattctgcctagagtgtagtgtatctactgtgaaataaaagggcagaggggtcacttgctataattaaagaacagagtccattgttgtcggacagcaaactgttttgaaagctacataagaggtttagctgttaaagacgttggtaactaagggtggcgtccaaatcagcattgatccagctccttacttttctataggcctcctcacagggtgacagggctttttgagggagggggctgccctttccccaagaacacatggaacttaggtatttgtgtaatcagacccatcactgaattctgactttggtgtgtgaaatccgtttgctttgctggagagagaaggaatatgcataactgatcaagattgtcctataggagataaataatgttttgcaacttttaataactttgcaaatagtctgtaaaaaacggtggggggagggattgatagtccaaatgtcgtgaggttaagaatgctcttcaagtgaaattgcttggctgcaagatggttttaattagactgttataaagacttatttttcctaagcagcattttatagttagtaaatgaaatgtatgccgaaagtgctaagcagaaatctccctaaccacagaggtgttcaataaccagattcgaacaacatggaaagtaccatctgttcttcgttttcagcgtgaaaaagagggattgaatggctgcgatttgctccagtttcgacggtgtctgtgtgtgcgcgtgtattcttttttaatttaaaaaagttcacctggtacttcatagaaacttgaaattgcagtaatatgagcaacactgtgaaaacacatgttcctgcatttattttaac

SEQ ID NO: 117256 - DNA, 1033 bp, Homo sapiens
attttccccaccccaccgccccaagccccccgccccccgccccgagcgaatgctgttataactggtttatcagctcactgaatcatctgctgtctcctcctccacacctttctttttctcctcttgcccagtttctcatcccaccctttcttctcctcctcctccctctactccccccctccttttctcttaagttagttcaagaaatcaaatctgtcaggacgggcggaaaaatgccacttcccgactaacaggcggaatccagcccagattttcagtcctttcttcttattctttcttccctttcactaatttatcccgatgttagcacattctgtctcgttactagcggacgcctgtaggtttgctacatgggatcattactgatcacggtgactctgaagtctggaactgaaggcggaatgagaagttgggaaaacttttttctctaaactctctgttttttaaaaaactattattctcgatgcttgttaagaggaaaaaaaaacctttggtgcttctgttgtgaatgtgaaacattattttccagctgtacagtgacacattttttttaaggagaaaaggactgattcgtttgccaaaaggggggtggggaggtggaataatgttatcgagtgattattctggctgagatgtgttatttggtttcttccttcttgatcatttggtgtttaagtaaaatgaggcacaggcttgtttgccgagtggagtgggaaaggcattttgatttgctggcctaattaaaaaatgataaaggattaaaaggtaagcaatgtctgtgtgtgtgtatgtgtgtgtgtatgtatatttatttatttttttcttgacaatcaactgttaaaaaggggctgatccctttaaaaaccgttttaactgctctttgtcaaacacactcatttgcggtcattgaggccaccttggcgcagatcacttaaagtgtatgtcttaatcagttttctgtacagtcagtagcaccgtatttaagagagtgagcaattctctgacctaggaa

SEQ ID NO: 117257 - DNA, 1122 bp, Homo sapiens
acacacacacacacacacacacacacacacacatatatatacacacatacatatatatacacatgtatgtatatactccgaaagtcagaaaaactagactcagccagttcatctgtctactgaaagcaggcagcagctcctccttgcttcttccagatgaccctcaaatctctggttaaacattttaacttttttaattttttattttattattataattttttttgagaaagccagctgactttttattgctttgggggcagggactcaggagttcttggtggggcgggtccgcttcctcttcaccattacaggcttccggctgtgcagggcgctggccctgcggatggcagccatgcgcaggtcagggcatacttgttcttcagtatcgtgtgtctgatgctgctgagcgtggcgcgagcattcttgttgatggtggtccgcacataggaggtggcaggcttccgctggctggatctccgcttcatgaccaccacacctctgctgtcggctgcaggctccacgcccacagtcttgcggtgaatcagccctttttagcgaaggagttgcgggccttcaagttattgggctctgtgctgtctgtctacttcttcctcttgatcaggaaactggagcagttcctcacgaccatccattgcagatgcgcagacatggcggcggcttctctcgcagcggcctcaggggcaatttaaaaggtaacacagattactttgttcaacgatttgaattccgaaacattctttaatataacaatatatatctatctgttttattataactattattcactggataataatattaataataaccaacatgcattgtgtgactgctatgttccgggcactgttttaggcgcttgatgtgtattaattcatttcatcctcccaacaattctatgcaattattattattaatgttattatacataaaaggtaatgtaattcacagtagggccggaattttaaccctcatatttgggtctagagcttctgagcttgaccttgatgctacattgcctcagaattggatgacattcttcctctaaggctacacagaattgataaccagatttcctgctatgtcagttaactcctagct

SEQ ID NO: 117258 - DNA, 1060 bp, Homo sapiens
ctaattggccagttatatttctctattaattgcatatatatatatatatatatatatatatatatatatattctttacccactttttagtttagggattaagatatattttaaaaataagtatttgtgtgtcatgctgctatagcaagctcctccaggagaatagatgttgaagctacaatgtgtatcaaatttcttatggctatataaaccactcagctttttaatgtgtcaaattatcatcttttaattttatggaaatcacaaaaggactaagttaagtttgattaggcttatgttacagaatcttatttcactatacgagtggcaaaaaatgctttaattcactgttttttaagagtataaaatacaggtaataccttcataaagtacataatggggctaaatgatagagattatacctctaaaagcagtttacagcttggacaatattagaaaatttaagttacgcttctcatgtagcatattcctgttaattataaaaagtccaaatgatttagtgaaattgggcaatttagggtatatacaagatacaaacaatgtctaaattttgaaggaaaccttggatagacaaggaatatacacagtatttgtgtaacattttacctttctcccaattgtatagtcatttttattgcagtcctccatgttatatataagtgtatgtatctacacacacacatacacacacacacacacacacgcacacgtaaaagaacagcataaatttattcaacagcatcacctctctgtttggcataatgaaaaagacctttttgtttaaaggccagagctttaaaatcagacacatccttttaaagtcactgtaaatatgtagaattgtataggcagctaggcttataattttggaaataataacaatttgcactgattagctgtaaatctcagttattaatgtggcctcacataaagaacaaattgtgtactcttttttgtattggcacttggcttctagaacatattcatctaagcaaaatgcatgctatttcagcatttcaagggaaaagttgttattaatt

SEQ ID NO: 117259 - DNA, 1093 bp, Homo sapiens
ctgattttaaaacattcactgcttctcttatctacaatgcctagcttcattagtcatgtagaaaatgtttacattccccaagcttttaaaaattaaaaaaaaaaaaaaaaaaaacctatgtgttctcaatttgagtaaggtgtgacggagagcagctctgtgacacaggctgagggaggaggatttggtgtggaggcgaggaaactggggcccttactaagacactgaaatatgataaacatccttatgaagatgccactcccagaaactgggacttgagctactcttaggaagccacagaccatggaatacagattcttctcctggaaacttctccatttccaagaaggcataaaatgaaggaaagcaatcctctttcctttccgtttcttggaatctaatatctaagcattaccctttacactctagcaaagtaaagcaaactaaggcatgacggcccctcccagcagtaattatgagatcatttggcctcagtaactaggcagactccactacctttcacctagtttcgtgggaagaaatggtaaagctccctcgatggaaatgttccttctttcgccataaccttcacaggatccatctgtctaatctttgtctgaaggaattggaagggcaggcggttgcctcaccaaaagcaccctcagtactttagtctactgaattatggggggttgttccagaagaggatccaaaccccagcagaaaactcctggcctttcccatgccagttttcccaagcccaggaattccaagtgaagtacatccattcctattgctatttatactgtctggtgtagccaaaatgggccctgggctagaaatcagaaagcctaggccgggcgcagtggctcacgcctgtaatcccagcactttgggaggccaaggcgggcagatcatgaggtcagaagattgagaccatcctcgataacacggtgaaaccccgtctctactaaaaaaatacaaaaaattagccgggcgtggtggcgggcgcctgtagtcccagctactcaggaggctgaggcaggagaatggcgtgaacccgggaggcggagcttgcagtgagccgagatcg

SEQ ID NO: 117260 - DNA, 1340 bp, Homo sapiens
actagagaatataattttgtgttttgtaatgtgtttgtgtacattatgaggctgtgtgagctcttgagcaaattagtctctgtaggcctcagttgcccaatctgtaaattgggaggtagtaggaaacctgtgttataggatgaggattaaataactaaatgcatgttaagtgcttagattggtgtgttacacacgtaagagctcaatagatattagctattatatgtagtagcttgaatgaaaggaagaatgtgttaatatttgtttctgataattaggggaaaaatcccaaaattttttacttattatcaatgatctgaattataagagaaacagagtgagtaaacttgactctttggtttccttttgtacactgaaattatactggtacacttcaggaaatgagtttaatgtcagtgaactttgacttgaacactataacatcttacagcttccaatgtctctccttttagaatgaagaagaggtctttgcatggaataatgaagtaaaacagggactttcaagtagcatctttaccaaagatctgggcagaatctttcgctggcttgggtacaactttgtctattttgaaaatttatataagtctgatttatgtggtgagtggacttaaaaaaactgctgtagtctaaaatcagtttttcagtattgaaagcctttgagctttggtttagattttttatttatttttgtttgtttttaatttcctgttcattgctctcaccatgcctccctttttacacagacctaaaggatcagactgtggcattgtaaatgtcaacattccaacaagtggggctgagattggaggtgcctttggtacgtagagaatcatttctccttttccatgttgggcagcaaagaaaaaccagtagtagcttttagaaaaggctgaccaagagactgaaacactccttatattctgaaataaccttatgtgatctaacatatctgaaaaagcttacattctgtattcaaagttatcgcatagagtcctgcgtcatctcctcagaggcagcatcaggttagagcagaggcccttaacttgaaatgtgtgaacccctgaaatggtggcatttgttttctggggagaagtttccagacccaaaaaagattaagaatccctgcttcaaagccagaaaattttatatgaaatattctggtttttatttgcaaagtaggcatataaatgttaaacatactctttttcactagatggaatacaaagttgtttcttttcactgggccctgctcctgtttcctcttaataagccatacattattaatgctgaaacttggtagtagtttttccttaaaaact

SEQ ID NO: 117261 - DNA, 1048 bp, Homo sapiens
cgcgcgtgcacgcacacgtacacacacacacacacacacacacacacactctgtgggtgcatattattgttgaactgtttggagtaagtcaaagatgtgtcccctttattactaaatattttggtgtgtttcctaagaatgtggacattttcttgtataaccacagtagttactaaaatcaggacatttgatattgatacaatagtaatgctactttataaattagaaaataagttgaaaaataattgggatagggtgtaatcaggataggctatatgattgggataggctatataaaaaataattggacaggctatataatttaataattgggattaggctgtgtagcagtgtgcagtaaatatggaagtaggcattaatttttatatataatttttttcttttaagggagaagtctgttggaacttggaggaaacaatgccattattggtaaggctgcctctttgtttttgtttgttttctgttcagtttccacagtcgccatcctgaatatatggaacttgtttgggatctcatttcgtccatgttgcatatgcctgagacctagttcctgtgtttaggaattttacttgggagacaggacacaagcttgttttgaaggcagaggtaactaggaaggaaaggtattcatgtttagaacatgttacctgggatgatctagaacctgtgaatgagacttccattgccattgtagtatggcattatttcttgttttttcttcttctgtttgctgaaaactggccacatttctctagaataacttaagtaactcttatgtgacttgatcatttctttagatttcaaaaacattattttgtctttagtggaatattgagtgtttttatattgggaaggaacatgtccttaaggcattaaaaaaatcacttacctataggcttagagattacttatgctcttttttaactgtttgagtttgtcacaaaaatgcttagatatttgtagttgacacacataagaagtatgtgtaagatataagaagtatatggtgaagtgtttgttctggatg

SEQ ID NO: 117262 - DNA, 1063 bp, Homo sapiens
tataaagaactcttaaaatgtaagaatataaaagacaacccaattaaaaatgggcattggatttgaatagccgtcttttttttttttttttttttttttttttgagatggaatctcacgctctgttgcccaggctggagtgcagtggggagatcctggctcactgcaacctctgcctcccaggttcaagtgattcttctgcctcagcctcccaagtagctgggattacaggcatgcgccaccatgtccgactaatttttgtatttttagtagagacagggtttcaccatcttggccaggctggtctcaaactccagaccttgtgatccgcccgccttggcctcccgaagtgctgggattacaggcataagccaccgcaccaggcctagaatagacatcttaaatggccgattagcacatgaaaagattctcaacatcattagtcccacgagcagatttcatcttctcacctttctccccttttccttactcaaggcggtagtttgttgttcttggctaagtagtaatagtagtagtagtagaattataatttttaaaatgtatctgcctgtcttaattataggtgcttttcttggaggagttggtggttaggagtatagtcagagagcgcctgatagagaactggaaggatgtagaaagtatagatccctcctcttctgccaaacatcacttgcagccaggcaggagaagctaatgtcaggcgtaaaagcttccgtttccttccttctcttcttaacacctagcatagcgctatgctatagccagcaagctgtcattaattcaatgattgcagcagagactagagttggtgtagcatttggtggcttttggtagtaacagccatgtcttcataattaatattcacttgatgcttacctgtttcagagcaatggaaatgagaagatactctgctgttgtcacatatgctcctgatatcacaaatgaataaaagttattcacatggaagctgattttaaagtgcacttaaggaaatcgatgatcaaaagatcagtaataaatgtatgtctaaggctgggcacagt

SEQ ID NO: 117263 - DNA, 1164 bp, Homo sapiens
ttgaatctctaaatttttaaaaattaggtaggtggagtttatgtgttttgtgaaattgattgtgtttcttttcacttgcagaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggtgagcatttgaattacaaataagtacttgaccagatggcttctatttacaggaaataaaatgaatgccaaatactttaatgatatgttcctttttttttttttttttttggagacagggtcttgctctgtcacccaggctggagtgcagttactcactgcaacctccgcctcctcgctcaagggattctcttacctcagcctcctgaatagctgggaccacaggtatgcacccccacgcccagctattctttgtatttttaatagagacagggtcttgccatgttgtccaagctactctcgaactccagagctcaagggatccacccgcctttgcctctcaaagtgctgagattacaggcgtgagccatgggctggcctaatctatttatttatttatttatttgagaaaggatctcactcttgcccaggctggagtgcagtgctgcaatcacacctcactggaacct

SEQ ID NO: 117264 - DNA, 1054 bp, Homo sapiens
aactctgtcaaaaacaaaacaaaatgaaacaaaacaaaaggtgtgtctcagccaggtgtggtggctcacacctataatcctagcactttgggaggttgaggcaggcagagtgcttgagctgaggagtttgagagcagcctgggcaacatggcaaagccccatctccaccagaaaaaaaaaaaattagccaggcatggtggcacatgcccataatcctacctgtttgggaggctgaggcaggaggatcgattgagcccaggagatcaaggctgcagtgagctgtgatcatgccactgcactccagctggggtaatagaacaatacactgtctgggaaaaaaaaaaagtgtgtatctcaaaccaaccaaggggcaacattatatttaatggggaaatgccagaaacattcccattattgccagcaaacaagacaagggtgagctccatgatcatctcccacaggagtctatagatttttttttcttttttgttggggtagaatgtggcagggaacaatttttatttcactaaaaccttgtgaatacaaacatgagcaaagtaagttgagtggccagtaaaatgccggaatcaagtcaaggagaatttaccataaactgagtcaaaggagctgcagcagaacttgataatatgtctgaaagagttgaacaaatgttcgtacccttgtctcagtggtttatttctggggatccagtctaagaaaataatcaggctaagaaaaaagacttgtgtgtaacgggaagaaaatttgcacctggcctcaatagaggacaagcagtctcttaagtaggaagctgttttatttttcttcttctcctacttccctcctcattctctcctattcccttctttcttcttcctcctcttccttcttttctttctcctcctcctttctctcccaccccccaatacctgcttttaattttttttttttttaagacagagtctcactctgtcacccaggctggtgtacagggcacaatcttggcttactgcaacctctgccttccaggttcaaacaattctcctgcctcagc

SEQ ID NO: 117265 - DNA, 2060 bp, Homo sapiens
cggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaagtgagtgctagctggcggccgcgttagcgccaaggaggggcgggggcgcaaccgcggcgaccagctcaccgggttctgccgtggggagggagcagaggccaggatgcacgcgtccttctgaaggaacagggtctcggtctccggaaaggagaaagaatctagagttcatagcggagcaggggtcgcggagggggctcgagctgtagcgctggggggccgtgatgcccatttctagattttggatacccgctgggacgtggtaagtgcgcgcctgggactgccgagaaggagctcccgctttcgcactcgaatccggggagccggcgcggagaggcggcccctcaggccccaggtgcggggagctggagcgcgagcgcgcgctcgcgtgcgcgccccagtttccggccggcgcgagacaaagcgtctagcggatttgcagtgccgggatgggcggccggggaggactggcagcccgcctctagaatgaatgagcttcgcgcgggcagagagaggaaggggagggaccttcccgcagcatccgcgtctcctgggggtgggtcccgctttggcgcgctcagtcttggccctgtgacgttttgcgaagattctacgcctgctttaggcgggagagagaggcggagcttgatccgtgcgcctccagccagccccgggcaagttaggtttgctagctggttagctttctctggggaaatgtgtcctgtcccagcggggatggtgcggtccctcgggtggttctgcgcagggaaggaaagctgggtttgtgcatgtcacggctaccgttcttagaattgcggttctcctacccctcaggcagcggccctctgtccccagcttttgcctcctcgtagtatagtcaggctttcgggtagagactgtgcttagtaccccttagtcgaccactgtgcagatagtagaccagggcaggtgacagggtgctgtgtaaatgctgagtgtttgagcgaaggagagtttgtaattcacctaagcgagtgcgagttttcattccagtgcacaaggatacatttgcagacctttgctggccttattttgactttctgataagcaaaatggcctgtcatcagtaggcaacaagtgttgatgtcatgctttagagatttgcaaaatttgggtctgaaattcatggtcgccattagcactgccagctgaaatttctggaggtaccttattctcactttgacaccctttgcccctggatgtctttctgtctgtatctgcgtgaatgtccctgtccgaagtctctgagattttgtgtatttttacttatccctcctatcatatgttttcggttcataaaaaagcatgtgcacgtggtaagaataaaatagtatag

SEQ ID NO: 117266 - DNA, 1634 bp, Homo sapiens
caaatatctgttgcgtaccagtcaccgttctatgttagaggatatgaagatttttttaaaaaaatgaattactgttctttgttgctgagagtgtagtgggggagctatatcccagcaagtaaagaaagattgtcttttgtctgatgtgaagcattttgatgctggcgcttttgtaatctttccaggagttagccacaggaggtttttcacacagtaacaaggctgccacctggctgacagtagttgtaaatgtatcgattctaaaatgcatgctggtttcagcggggttaaaaaatgagaataatgtgtattagaatcaatgaaataatgcatgtgatacaatttaggtaatagcagatgctaagggaataaaaataaagcggagtgaagggttagtgtgattaaggaaggcctgtctgaggagttgacagtacctattctctgagggttagtagtgttctgggattatatttttcttaagtctgtgctactgtatgtatattcctattgccaggattagatgactcttcttttccccccaacataccatcatttgctcaaaacatgccacattttagtttgctccttatttgaattaggactttttttatatggatttattcctcaatagcttttcatttttcttgttaagaaaaatttgccctcagtgtgtttgcagactttttgaagatatttaatcataatatctatcacatgaatctgctttcttccctagagttctctttgcttaaggtaggctgtgtactgatgtcctgtaacttattaaagacagcttcctggccaggcacggtggctcacacctgtaaagcactttgagaggcctaggcaggtggatcacctgaagtcaggagttcaagactagcctgtccaacatggcgagaccccgtctctactaaaaatacacaaattagccgcgtgtggtagtggacgcctgcaatcccagttactgtggaggctgaggcaggaggcattgcttgaaccggggaggcggaggttgcagtgagctgagatcacaccaccgcactccatcctgggtgtattttccttttccttggtttcttcatattttgttgaagaacatccttaagtaatttattcagaaaggatggcaggaggtaaactttctgagtcctgtatgtctgaaaatagctttgggctaggtatagaatactaggttaacatttttccagaacttggaaagtattattttgccctattgtcttctggcatctagggttgttaatgtctttcttttttttttgagacggagcttggctcactgcaacctccgcctcccaggttcaagcgatgctcttgacccagcctcccaagtagctgggattacaggtgtgcaccaccacacccggctaattttgtatttttagtagagacggggtttcaccgtgttggccaggctggtctccaactcctgacctcaggtgatccacccacctcggcctcccaaggtgctgggattataggcgtgagccaccatgcctggcctatatttaattttttatttggaactagagtgtttgtaattaagtataatcatcatttaggtagatttagattaagaaaacagctttgagagaattatagattccaggtta

SEQ ID NO: 117267 - DNA, 1003 bp, Homo sapiens
agccaggatggtctcgatctcctgacctcgtgatcctcctgccttggcctcccagagtgctgggattacaggcgtgagccaccgttcccggccagacattatcttttaagctcatgataactgctgatgagtaaggaaacttcaggctcagagagtttaagtattttgcctggtattacttagcaagtaatgaaagctagaaaggatggtagcctgacttctagcattgtgatagggtgttcacatacataaccttatttcatccatacaacagtgttctacaggtattactctggtttaccgacatgtagcaggctcacagagcatcattatctgtggttggtacttgaagtctcagataggatagttgattttcagatccctttgggtgctacttttggaaatgctactagttgcatgtttttcacgttgatagtttgtagccttcaagggaggtaattttggatttgtcagaagggtagtggtcagtagttgaaacagctgtttgaaatactgagggcttcatttgctaaagaaaggtgaagatgaattactgaaagagatcgcttttatcttttttctcttcttaaaaagctactttccaactttattccatgccttaataatttaaaagaaattaaaacctctaaataaatctttaatactcatgacagggtgttctttcattctttattcaagacacatttttgtggaacaggtactatatgccaggtcttgaaccagatgctgggaatagagaaatgggatactcagtccccattatcaagttacttacagtctagtggggaagacagaaaaccaacactacaggattgtgatactgtaagtgcagtatactaataaaatatattaagtgctgtgatgccagtatccaggtgttgctgtggagaaacaaggaccgctacctaaggcaggctaggagccgtgtgaaattttgaaagacatcccaggggaatctgagctaagtgcagggaggtaagta

SEQ ID NO: 117268 - DNA, 1109 bp, Homo sapiens
agtgcaatggagtgatcttgactcactgctacctccatctcctgggttcaagcgattctcctgcctcagcctcttgagtagctgggattacaggcatgagccaccacgcccagccaacttttgtatttttgtatttcaccatgttgaccagtctggtctctaactcctgacctcaggtgatctgcctgcctcggccccctatagtactgggattacaggagtgaaccaccgtgcctggccgagtttttgtgtattaagttatatttgttttaatttcggggaagttcattaattttcctttggaaaaatactgtggatcacatcctttttccctttggaagggaagttaacatgaggacagtgttgaagctgatgagtggctgttggagcaaatgcatgcttgataagcagtttgagcctgttacgaaataaaattatctagttttaggacaaggtttttatgtgggtatattttactttaaattgaaaataaggtttattttttctctaaaggtctggagcatggctagatataagagacatggcatgttgatgctgagctctgggtgtgaagagatccccagacacggatttgtgtgatagtcacttgagtactgcactagtgttgagtggtgttcaggggctaccagacagctgttcagaagaaccttacagtatatgaaagcaggaacagagcttagccagctaggcctaattggcctggctctgtatgtacagtgggtctgttttaagggatttaaaaatccttgttttgtggctttgattagaaataagaattttgtatagaatgatttctgttagctgattacaggtgaaaaactaaatggcttttctctttcatctcctgtaatatatttgtttttctaaataagaatgggcctgaggtgaaatgttagggataggtactgacacaaactgaccaagagaatgttaacaggtgggcaataatttgccgttaccaaattaattaaaactattttgtaatgagcttcagattatgttgtatttgtccctgcaagtttacttattgatttgtttcacactaattctttgttccctgtttaagtggacaatcttattttttcaag

SEQ ID NO: 117269 - DNA, 1870 bp, Homo sapiens
atcagcctctcaaagtgatgtgattacagacgtaagccactgcgctcagcatgatatcctgacttacagttcctgtatgttttggcttataatatgcattatatttaaaaaatgaattttcatttcttcaaaaatatcctgtgttagtgtgcctctttatagaacaagggggacatgcagtctcactcaaggacaagcaggattctggtacattggtctttaatatggacgtctttgacccatagttattagtaatcatgtgacattgaaagagaatgttagccaacaaaaactctagatccagtgcttgtgaattgcttctctaattttgataggtgatgggagcctttatttaaactacttcttttgtttgtcccttcagcagagagggagaagacctcaagtcatcagtatggtttgatgtcttatgctttttaaatctgttccagctatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccaggtaaggtcaagcctactcttgagccgtatgtgacaggttaattgcctcatctgccttaagccatagtttgattgattgattgattttcaaatgtattttatttttgaaattttatatatttgttttctgatggtttacttgaagaaaagtcttgaggtagctaacatgcaaaacattatcacctcccaggcattatatctggattggccagatcttgtggttcccttcttcttccctattgtgcacacactcattctgtctctgctctcaaagcctattttgttagttaggaaataagtaagaaaagagatgccaaaatgctgctctccacacaggaaaaaatgaaagtggttagctaaaataactagtttgatttttgaaatgtgagtgagtcatacgtctctgttctattccctgttgccaattaacaatttgactggtcgtttggtatgatactctgtgggtgggaccagcaaatgaatacccagttctgtgataaatgttaagatgaagtaattatacattgataaatatataggaattttaacacttgatttgatttgattcatagatatcttatgttcattattaaatgattgccatgtaatttttatcacaattctttttccttgtaatagttggaagcctccttagctgcagccaaaaaacagttagcagatgaaactttacttaaagtagatttggagaatcgttgtcagagccttactgaggacttggagtttcgcaaaagcatgtatgaagaggtaactatatataattttgctttgtaaaggaatggaggggttctagaatgactttgtcatagctaaacatgtaattatattttatttatgatttctttgccacaaaaatatatcagataaagaaataataaggtttggggatggggagaaattttgcaggtagattattcaagctactgctgctaaaagaccgcatttgagaactcaagctgttaccgtaaacagatatgatttcacttcatcttacttatttttgtttttttgtttttgtttttttgagacggagtcttgctctgccgccaggctggagtacagtggcacgatctcggctcctttcaacctctgcctcctgggttcaagcagttctcctgcctcagcctcccgagtagctggaactacaggcgtgcgccaccacgcccagctaatttttgtattcttagtagagacgggatttcaccatattggccagggtggtctcgatctcctgacctcgtgatccg

SEQ ID NO: 117270 - DNA, 3441 bp, Homo sapiens
ttttttttttgagacggagtccagctcagctgcccaggctggaatgcagtggtgcgatcttggctcactgcaaccaccgtctcccaggttcaagtgattctcccatctcagcctcctgagtagctgggattacaggcaccctccatcatggctgactaatttttgtattttagtagagacagggttttaccatattggccaggctggtcttgaactcctcacctcaggtgatctgattgccttggcctcccaaagtgctaggattacaggcgtgagccaccgcgcccagccttccattctaattttatttagacacttccttaaaacagagtaaaggaaaggatcatgacaactacttctattcttcaatggtaaatttttcataaatatttgagttagtcaactaatattgttaataagatcctgtgtcacttgataatgatagcttaataccggcttttaaagaagtcatgtaaattagcttgtgctgcctattattatgtctaagaaaatggttttatggctgggcaaggtggttcacacctgtaatcccagcaacttgagtggctgaggcagatggatcacctgaggtcaggagtttgagaccagtctggccaacatggggaaatctcatctctactaaaaatacaaaaattagctgggcatggtggtatgtgcctgtaatcccagttactagggaggctgatgcaggagaattgcttgaacccgggaggcggaggttgtagtgagctgagatcataccattgcacaacagcctgggcgacagagtgatactctatctcagaaaagaaaagaaaagaaaagaaaatagtttcatttcacataaatctttacatgaatttatcacaactgttaagtttaactttccatgtgctgttttttcagagatgttcttaagattatcaatgaaacaattcagaaaaataatttttgcttagtgtttagtatagtatactgtgtataaatccttgattgcagatagttttagtaggccatccaggcctttccttggcttcagaaaaataaatagctatgctcctgaaaaggaatagaaagttcctaaggcttgagatgctaccacttctgtcattagttccatttcaaaaacctcaactgaaaactaagaggcaaaaaagtgtttattcacatgaccgcctgaggacaaacaggaggaagttcgtgtgtaaaacttcagatggctgtgatgtcactcagatgtgtaccaatgcagccatggtaagtagcttggctttatgctttttgttttttccccaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaagtgagctctcttcagaagattcttttgaacacttaaaatcattacttcacaattcccatgatgaacatggctttatgtttattttgttctagtttttaaaaatgattcccctagtctccatgaaatatatagaaaattgattttttcaaaaaagtgcagttttctataaactaaatgttattaaaaattactagaagaatgtagggttgttgcaattttattagaggttaggttttgtctttttgtcccattgatcattcgtactatgccatagtagttgaacccaaaccatgtgaaataactttcttccaataacaagtactgatcatgctgtcctacataaacatccatttagtaatgaatgaatgtcagactgcattagatctcactttcatgtcatcattgtgcatagattgtgactaccacacttccggcttttttgcataagggccaaatggaaagtctctgctatttcttcttctgtcactattattcacttaaaaaaatattgtagaaacttcccacttatattagctgaccttacaagaattcataaaaatcaccaactagtacaggctttccctggtaaatgattttgccttgtgttttaaatgttacatgatttgattaaaaagacttttttgtggttgacttagaatattagagtcacagagttattgaaaattttcattgcatggctttaaactgttcatgttgctttttatctattgtatgaagtagcagttagtgaaagtgaaagatcttattataagcagtaacttcagttgtataacatttatctaatatcacacattgagctatacagtgaaggagctaaagtaaggatccgtcacagactgtggcctcacagggagccagggaggagacacaggagcatgtccctgagacacacatacacaatagtgttatgggatttgtattttactcaaggagttttttttgcttctgaaaggaagtgtttctatctggtttgaacgaatctataaactagtattttctgcttgttggtttacattctgtattggatttggtgggttagggatatgtgatgtttcttttcttacagacaccaccacagtcaagttgctattgcccagtcttcttattatcagtgttatcttagacattaaaggtttaatagatgaaatattgaagtaataagctttgggtaaaggcctaggtatattagcattcttaaagctcattatttaggaagtgactctaaaagtcacacagaattaccatcattcacaccatatcagcaaacttcatgatgcttttcctgtgtttcatctaccagttaccagcaggacttaggtttgaaatgccttgaggtgaatcatgcttccttttttgtttcagttctagataagactgactatgctttgcttcttcttttagcttgagaatgccagactgtcatcagagatgaatacttctactgtcaacagtgccagggaagaactgatggaaagccgcatgagaattgagagcctttcatcccagctttctaatctacagaaagaggtaaataatcatctttctgtaagaagttagacttgaaggctaccttcaccacgggcacctacctgctttgcttgggctgatgtcactcctccctctgtttgttacagaggatggtgtcatcctgtgctttcgtcttcacagtacttttctagattcgttcattttgcattgcataaacatcctgtgagcagatactattgttcctaattagtagattacacagagctaagggacttgcccttgaggaaggagcctgctagtttattcactgtacttaccctaggacccggatcttccgacctgtctaacagcttcatctctacagagttattctcaacaccttccttttttatatcatttgaaaaccaaaatgaagaaaaacatgcaaaaattctttgtgggtggtgaatgctttgtgtttctaga

SEQ ID NO: 117271 - DNA, 3419 bp, Homo sapiens
agaatgattcagcaattaactcgtcaccttaattattttggaaataacttccgcttctattttcctcaagggaggaaatcttgttttgaattttccacatgagaataaactttattttacttttttttttttttttttttttttctttttgagatggagtctcactctgtcgcccaggctggagtgcagtggtacgatctcggctcactgtgagctccgcctcccgggttcacgccattctcctgcctcagcctcccaagtagctgggactacaagtgcgtgccaccacgcccggctaatttttgtatttttagtagagacggggtttcaccgtgttagccaggatggtctcgatctcctgacctcatgatccacccgcctcggcttcccagagtgctgggattacaggcgtgagccaccgtgcccagcctattttactcttgattgggcttttcttccttcctttttctttttaccatttttagtaaaatatttttctaattataaaactgatgacctctgttgcaggaacttagaaataaagcagaaaatgagtcccataaaatggggtgatataaaataatttagttaacacaggggcttttacactgtctatcatgtgctttgttacttacggcacaaatttttaaattattttaaacctattttgtgctgatagtgttttgaagattttcatttaatagcagagctggaagcacctctgagttcattccatgtaaccacagatctaggtgagtttaatgatttgcccgttgcccagaggctgcagactgataaatgggtttctctactccttcccagtttttccttttataactcattttcttcaaagaagatttacttttagaaatttaacagataatctttttttccattgcaccatctgtcttagtccttttgggctgctataacaaactactattgacttggtagcttataaacaacagatatgtcagaaattatttctcacagttttggaggctgggaagtccaagatcaaggcactggcagattggatatctgcctggtgagggctgttccccgatttatagatggtgccttcttgctgtgtcctcacatggttaaagggtgaatgagcacccttggccctatattataagggcatgaatcccattcactagggctttcctctcatgatctaattaccactcaaaggccctacctcttaatatcatcaccttgagggttaggatttaaacatgaaatttgtgggaacacaaacacacagactgtatcactgtctttgtttttcttgttgtttttttttcttctgagacagaatttcgttcttgttgcccaggctgtagtgcaatggcgcaatctcggctcactgcaacctccgcctcccaggtttaagcaattcccctgccttagcttccctagtagctgggattaccggcatgcaccaccacaccctgctaattttgtatttttggtagagacagggtttctccatgttggtcaggccggtcttgaactcctgaccttaggtgatccgcccgcctcagcctcccaaagtgttgggattataggcgtgagccactgcacctggcctatatcaactgtcttaacaggtacttttccaaaaatgggcctctctgttcttgtactgagttggcatttactactcttttccatttactaatagtaagttgtctactagttactgtctatccctcaattttattttttcctactgtattattatttttttggctgctgcctaatccatttgatttacttagtacagatcttctcttgaggttgatcttcactgtgctttggatgaggagactgttattaataagtagtagtgggctctgaaacttagtagctatgtgttctaacctaggttcaaggctgtttccctgttaattgaattcccatttttgcaagttggtttttttttttttttgagacagaattttgcttttgttgcccaagctggagtgcaatggcactatctcagctcactgcaacttctgcttcccaggttcaagtgattctcctgcctcagcctcctgagtagctgggattacaggcacgcgctaccacgcccagctaattctttgtatttttagtagaaatggggtgcaccatgttagccaggttggtttcaaactcctgacttcaggtactctgcctaccttggcctcccaaaatggaagggattacaggcgtgagctgctgccttaaatgctgggattacaggtgtaagccactgtgcctggctgcaagttttttttgttaaccttatcttagtggtttttaagtaatgttaggcagtgcactgggggtttccaggagctaactccttagcagataggagacgagcaatccctttagccaaaatagtttttaatttctctggggtgaatctttcctctgttcattattggtaacagactttatggtaaacagtatattttgaggaatatttttattagttgataaattttagccttagaaaaatcatcaaaaataaaaatgttatctttttgaatattttcctattgtttgtcttaatagtgtttgttgctgagtcatatcagtttcatcatgctgcctattaggccataagaatttccttttggttaaataactcaggttagtgaagtacttcttaaattttacttaaaattgacatggctttaaaatactggttttacaagatatatttaaataatatatagatggtagcagtgttatgttttggaattagaaattttacattgcttatagcatctctagatttttgacttgggaccaaatgaattggttggttagagtctgcttgccttagagaagagtacagtatggtacttaaaaacacctctaacttttgtttttctaacacccagattctggagactttggttgcagctagaccttaataaaccagtacaattacattacatactataaaatatttaaaaaccccaagatcatcagaagtcataaaatttagggttagtggcaagatctgagagatcatctagatagttagagctcttcattttccttatgtggaaactggtttagtgagattagttacagcttgcttatagcctcataggtagtttcaatggcagaattagaaaggagaatctaggtctaacttctcatactgtgttccttatatttcactacacaggtgtaagtgcagctactgaaaatagaatttaaatatttctatttaaaatacagaatgattcagagtaactttaaaatttttatacctagattttgatttttccctcttaaagagctctacaacatcaaaggcagtcaaacagagacatcattgggtttataaatctcggctcaggttatctgtgaatcttgggtagtttatatctctcatcaactctccttta

SEQ ID NO: 117272 - DNA, 3137 bp, Homo sapiens
gcccccaaataggtttacagtgactcttgattattttttaaataaccttgttattttggcataattttagatttacagaaaagttggcaaagtactatagacagttcttgttttcctctcacccattttcccctgttgttagcatcttatgttaccatagtatatttgtcaaaactaagaaactgacattggtatattactgtgaactcgtctccagactatttggatttcaccagttcttctgttatcttctttctgttccaggtgccacatgcctcccctggtctgtgacagtttcttgggctttccttgttttttatgagcttgagtcttgagtaagattgtccaggtatcctgtagactgtcccccaatttggatttgtccggtgcttttcacgtgattagactggggttttgggttttaagtgcccgttttgtcacatcgtatcagggattgcacgtatgtgataaccacatgacatcactggtggtgtttggtttaagatagtgtttgtcaggtttctccactgtcaacagcgctactatttttccgttcccatacactgttcatggaaaacagctcactaagtccagcctaccctcaagggtgaaggacagggcaggacttaagcgccacattctggagggaaatctacatttattaaatggcattcttctgtaacgatttatccattccccgtttgtttggtttgtttgtttgtttgtttgtgtccgtatggaccatgggcatttactttatactttgggttgtaagctaatactgcagtatttacttttttggcttaaattgtttcatatttggccactgggagttctgtcagcttggccactatgtcccattgttttttgagcactttgttgctttctggtactataacatgctctaggctcatcttgcattttccctgccccagtcctagaattatccagtctccaaggagccctggttcttgttattggagaatggtatatagaaattaagatctgggcactgagtgtgctcactggtactgggtatcactgcttcttggccctctcaccgataaaagtgggtaacattttatgtatgctaacccatgtgtatgcacatatttataactttttctgtctaatcatttgtgttaagataaacatgaattcatacagatgtctctgacttgaatctagtaggacagcattcaattttggcttcctttctgacatacctgtatcttttctctctcagagtgagaaacctggtttttatcatccatttacttatctgttcagccccagtatatgttaaagcagtttcaaaattttgaacctgtactgctgtgaaaagtaaatttaccagcaagagtacagtttttatgtatttggtagctcctttttatctctagccttctagatttagtttttgcacattagatgccctttctctcctgctctgttgcaggtacttgtgattctgagggcctaagctatccatcagtctttttgagttgtcactttctgaggctactgagatgaattctgtcatggagaaacacagaagaataattacccagcgagccacaaggtttctaagatgaactttctggtgtaggatgtgtgatttttaatttttttatgccaaatatacagcttctatattcacagtaatactttacaaatcaccctatattgtgtgtcctttgtgtgctaactgaacatgagatagcccagcaatcctaaagggacactaggtagtgccttccacatagtaaccagagtccctttgccttggtttctgaatattcctcagcagtctgctaaaacgtacttttacccactcttaggtttattttgtcagtcagtgtttatatctttttttttttttttttgagacagagtctcgctctgttgcccaggttggagtgcaatggcgtgatcttggctcactgcaacctctgcctccggggttcaagcgattgtcctgcctcagcctcccaagtagctgggattacaggcgcccaccactacaacctgctaattttttttgtatttttagtagagacggggtttcgccatgttagtcaggctggtctcaaactcctgacctcaggtgatccacctgccccggcctcccaaagtgttgggattacaggcgtaagccaccacacccacccagtgttcttatctttttaagttctttatttaatttatacttttggaagtaaaggctttgtaagggagccagacttgacttttaccaaaaccacatcttaacatttttttggctaagtacagaaaaattatatgtatatttacagaacttacatttgtggaatatgtcttttattcttttatcagccaaaactatcctgaggtctgtgttttgtatttgaggaattttgggttttaatttcttaaaatctcttgaattctagtgagttagagattccatagggttgtactgttttccagtctaggaaatgatttaaaatagctgcctggtgctaatgttggaatgttcctagaaagtaaatatgtttccttgcatcttaagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggtaaggaacttaagggtcaccctaccttatggtccactttttgcctctcaccctttttattgaaataaaaataaatagcattttaaaaagaactttattttcttggtcatttctttgaacacctaggtatagaagtagtaatagatcatatttctacctcatcgcagaaaatgttgctcaagtactcttagtttatttattattattactttaaatgctgaactgcatcaggatggattagttcctttgagattttaagtgttttggtgatttaatatattgtaaaatgccaaactggctgaaagagactttacatattatttatttatttatttatttatttatttatttatttatttattttt

SEQ ID NO: 117273 - DNA, 3116 bp, Homo sapiens
ctgcctcccgggttcaagccattctcctgcctcagcctcctgagtagctagtattacaggcgcccaccaccacgcctggctaatttttgtatttttagtagagacggggtttcaccatgttggtcaggctgatcttgaactcctgacctcaagcaatccacctgccttggcctcccaaagtgctgttgggttacagacatgagcctctgtgcccagcccttgtttttttgttttttttttttttaaggcgagaagggcatatgtgttttaaaaatgaattgttttatttttcccatataggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggtaataaaatagacccttttttttctagcaaggctttgtggattgctagattctcttgcaattgtcatagctccttagtttttgtttggattcattacgtcttcatggaataagggtttatgtcctttttacttaaattcataaaataaaataaaaattaaaataggaggaggaagagttaggtacccttagtagtttaaagatttgcttcattaacccttctttagagggccagggcttttttgaaaagcatgttccttttatcacagtggttctgaggatgagttattattattctctgccctagccaaatttgtgaagaagttggagcaattggatgaaaatggtggatattctttcggtcattaacttaataaaaagcttactgaaagaaggagataagagcctggactcagatattaagggaatatttttccctgcaaataaatgaatgaacaaatgctaatactttacatgaaaaatagcatgaagccttattttgaaatatgtttaaaagtaaacatgaagtattcatagcagagatttctgaaatttagggctggggctttcgggagctctgtagtgtgggccttccctagctctgcatcaaggagctggaggccatgatgggttgtgagatgatactagaggaaggcatggtctgggagcgtgcaggcggcagtgggatggatgtcacatcttgaaacatatgttcagggcctgctaaaagtagttttgaaaattagtcttttctcaccacagttattaaaactatcttgcatgtggatgaatatgtaatttggatgagtgaaggagcactaatgagcaccaacagttttaatgctaaagagaataggctctaaggtctctttgtagccttttttttttttttgagtcttgctctgttgcccaggtcggagtgcagtggcatgatcttggctcctccacctcttgggttcaagagattctcctgcctcagcctcctgagtagctgggattacaggtgcacgcaagcacgcctgctgatttttgtatttttacacagggcttcaccatgttggccaggctggtctccaactcctgacctcaggtgatccacccgccttggcctcctaaagtgctgggattacaggcatgggccaccatgcccagccccactgaccctttttttgagccccttatgctttcatgtatgagagctgaatgtgggcagaagtgggacagatgcagaaggaaaatgacagattttcttctgtttctaagcttatgtgtctattttaaaagcttgaagtaatccaatacttgatgtttaaaaattgtgattatgacagctagatagtgctgtaaatttgaaagacccaccttatctagcagtgaatttgaccatttaatttggttcataccctgttcttccagttctgtcctctttaaagtcaagtaccttactaattaactcattgttgaagttactgtttgacaaaatgacagaatcgtgttttctttttatagtaggaaaacctgaaatgtgggaagatgaccataaagcggtcttagtttaactgcctgtatggattaatttatttgattattccacaactttctttatctttgaagtaacacccctcaccctcctttctgtgtgtaggatcaaccaatgggaggctgggagatgatcagaaaaattggagacacatcagtcagttataaatatacctcaagatatgtgctgaaggcaggccagactgttacagtaagtgaatctagtcatcatttaatttaacttcattgtgttaactaacaaagtaactcaaaaagttttttggctaaaagagaagcattttagaaatggccgttaaagtactttttatattattagggcattacaagtgctataaaagatttttaaaattctgtcttattgagagtagtgaagaatggacctttgaattatttttatcttgtctattccagtagatataaaagctatctctaggctgatacttatagcccagtgtcattcaggagacactgcttggcataaagaactgttaagaatttagcattaacatatgcctaaaacagcaatctctagccttgggtgagcttcagaatcatttgggtagtattttggtgttcaggccctacttcaccctttgctatctttagggttggggtaggagcctaggttttgaataaaagtccttagattataggcacccttgtaaattttcactaattggcattctgtgtcttgatttctaaatggctctctattggtatgttctgaaatactacatctttaatagttactgaattattattagcttactttttagagaagtatgtttcattgagtaatcaaagattcttttgcttttacttagtaggtagatttagctaacaataaaatatgttaactttgatacagatttcaaagaagtcactcttttcatcctaaaagaatgtagaggtgactgtctctttccttttatatattctttaaaaaatattaaacgcatgttttaaatgtgtttataattttatgttgatacaaaccttactgttgaagatcaaaggctcagacttctct

SEQ ID NO: 117274 - DNA, 1481 bp, Homo sapiens
ttattagagggagtcacagaaggctctaacatggaaggatggcctataaaacccacagagtaatagaacgctgaggctaccattcactgagttagccagccactgaatgtgggttatcacttgctcttttcaataatcgcacctgttacaggtgccatttctaccctgttttatggatgactaaagtaaggtaacttgctcagggtcagctggtgtgtaaaggaactaggatgtgagtgtaggcagttttacttcagggtcttatatattatcatcttcacttatcagatggggaagctgaggccttgagaagctctgtgagttctcctggccacatagctgtgtatagcactctgtagctggggcatagttctcagacttttagaatcaagtgtttgagtctcatcgcattgctgtcgttggcgtgtgggagaactgggttctgggtgtactgacatgctttggttttttacagatttgggctgcaaacgctggtgtcacagccagccccccaactgacctcatctggaagaaccagaactcgtggggcactggcgaagatgtgaaggttatattgaaaaattctcagggagaggtatggccagtttatcaggaccaccacaatgttaatttcacttaaagttcactgtgcaagtataatcaagatcagattgaaacgtgcaataaccgattgcataaacagaccaaagctgctaagttaattgaactgaagctgtctttaagttttaggaataaataggagtgtattatagagtactgattattagcacaggctccagaacagattttctgtgtcctgtttctgttttcactgcacattagctttgtgactttgggcaagttacttcacctctcttagatttgtcatttaaaaatggatattaatgacacaatatccatgagctaataataagaatgagacagtacttgggaaatgcttggaatagtatctggcatagtacctttatctagtaaatgcttaaattattaaccttgttactagctctcagaatgttcatgaaactgtgagtttgaagattgtggagtgtacatcttcttggagtgtgtgttttcagtgtgtcagtcttagaatccttgtcaaagtaccttaccttccccattgccacataaagacactgcatatacccctaccaatactagtcttagaaatactacttcctaataaagcggctaaagtgtgctttgaagctagtaaaacatggcttcctccttgtctttccctagcgaatcaccttatccaggtgctgtaccacgcatcactgagcctctgtttagaatttgagtccctcctttgttgctattgccataagcatgttaatggagcttttgttgtgagttcagcatggtttgttcttctcattttccttttagttgtaatactgctttttcatcctttgcctaccaggagagctgtaagttggcttgcaaggaagccattg

SEQ ID NO: 117275 - DNA, 1050 bp, Homo sapiens
cccaacagctttttggttctaaattattatttattatttttctacctagatttttagacattagctcacccattttttatacggctttctgtattagattaattggtttttgcatgttttcaaatgaagagtgcttaacagcagggttacacttaaagtagttatgttaaggtaattcataataatgaagacaggcaagttgctgttttctgaggttctcattgaggctaatagtcttaagctacatcatgagccttaagagccaatgtttgcatatgggatgtataccacgagcttctagaagctggaatgtggtaattttgttatagaagattttatttgactcgttcctcattttaagatgagttgagaaaagctgggtactctcaaagttttttaagaatttatttttctgctttatatgctgctatctcctagttgatagcttgaacggtggttgatctaaagaatcacattttttttattactaatttggttaaaacactgatatttgtgaaatggctatttctgtttgtaaagatagaccaatttcacagaattgaagttactggctaattgagaggctcaaaatggtccatcttccttggtcctgcaagagtaataaaaaatccccacaaaatactgttctgccaccttactttatttacaaaacacattattgggcatatttcaaatcgaagtctcatttctgtgacactgggttttgattttctttctctgccattgtaaactagctggtctgtgttagataagcttttactgaagtaatattgtgtcttcccctgtagcattctctttcttgagtgaccttaggacagggtacagaataaaattatatgctctgcagcactcttgaggacacactcatttacttgctgccagatcatcaggttagccttgtgcttaagcaaaaacactgctgcatttgtgccaagtcagcattttccacaggaaagtaatctgtatttgacctttttagtagaaaatggaaatagttgctttctgtcatacctttagtgaatgatagga

SEQ ID NO: 117276 - DNA, 1058 bp, Homo sapiens
gttttaattataattaaattggaattattaataactaatgagccttcagtttatattctcaagctgtttgagtccgatcattaatcaaagtgtctacccttatcctgataagactttgtttccatggctccagatttttagtcttaagtctgctttgcttcattagccctagtcctggtctaaataaacactgtctcatatatttaacccccagggttgagaaccacttgaggtgggttgcatgaagtagcatgaattttttacctggatgccttctcatacattttggaggaatattttaaaacacatatgttacacttaacttacaagaaacaagcacaagttccattttctgtgcttcaatgggaaccatcgtaattactagaagtaaaataattatgtaagagataactcaaggcaccagacaagagggtcagcatgagttatatagcatgtcagatgctagaggaggtactccaggccagcagagtagttgagaagaactctgtgaggtgatgcttgtccactaatttgaaggatgggtgattatttggttattggagagaaggcagatgatggtgctctgaggatgttggaattcaccattgcttcactaacagaccaccccaaagcttagtggcttaaaacagtgatttcttacttcccataattctgtggtttgactgggctcagctgggcagtgtttctgttccacatgctgcagactgaactcaatcgagcaggctgtgttcagctcagaggttggcctcggctggaatatcttttaggtctctttctgtgtggatttctatgatttaagagtttagtcaaagctttatagcatggcaattgtctaacagagtaagtggagggtacaggtttctttcttttttcttttttttttttgagatagagtcttgctgtgtcgccaggctggagcgcagtggcgcaatctcagctcaccgcaacctccacctcccaggttcaagagatacccctgcctcagtctcccaagtagctgggattacaggcatgcgccaccacgcctggctaatttt

SEQ ID NO: 117277 - DNA, 1234 bp, Homo sapiens
aggcatgagaatcgcttgaacccaggaggtagaggttgcagtgagccaagattgcaccactgcactccagcctgggcaacagagtgagactctatctcaaacaaacaaagaaaaagaaaaaaagaaaaggttagaaaagatgagagatgataaagggtccatttgaggttaggtaatatggtttggtatccctgtagttaaaagtttttgtcttattttagaatactgtgatctatttctttagtattaatttttccttctgttttcctcatcagggaaccccaagagcatccaatagaagctgtgcaattatgtaaaattttcaactgtcttcctcaaaataaagaagtatggtaatctttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattgatatactgtcctttttaacgctttaaaaacagattttgaggggagaaaagtattgtttcagttttgcttttgataaaaatataatttgacttctttgaactggatttttctttaaggctttgccagttgtggaagataagctattttgggggtctttcagta

SEQ ID NO: 117278 - DNA, 1001 bp, Homo sapiens
atatcttacccatcatccttttcatcatatcttaaattacaaagaaatttatttggatgccccttcttttcttgccaaaacacatgataaaatgagaaaaattgaaaagaatctttaaataatccataccctctggatcattggcttctaaacaaaatgcagattttttctttttaattccattgcttgaagtaacaacatggaattttaggaggtgccaccagaggggaatgtttcttagggttcaagcctttgagtccctgaagcaaggctctagtatctgtggtgtttacacaggaaaacccagaattctgaagttgggactgactgtccttccttgtctaccaaattaggggggggaaattccatgaaaaaaaggtattgaaggaagtagtttttagaattttgtgtttcttctatttggctgccttactgaaggggacattcagagccagattgatgaaaatgaggcaaatacgtggcaaaatacatgcaaaactcacagaagtcatatttcaagttctcagggagaggcgtcacattagcagtattgagtgggaagaggaattaacagggaacagtactgtaaatggatgctgctttgctgtcctggagggtcagagtgaggacagagaacaatcttagaggcagatcagtaaccagtttgccctggagccatgcatgggacccagagtgtaaaatccctcactgcctacgtcctcctacccctcacttccacaataatgcattttctttcacttttaacagcatggtaaatcctgtcctctcctgacatttctccagagacaaaatacacctctcaatttagggacacagcctgcctcagtagcttaattactttataacaataaaacacatattcacccagatttatgatgtgagtgcttcctccaccaatctgaattggaattctcagtttaaatgccagccaagtttgcttttagagaaatgccgcttctgttccattttgggtttttaaa

SEQ ID NO: 117279 - DNA, 1034 bp, Homo sapiens
gacagccagttcttttcttgaggaactcagtgtgatcacagttctattatccttgatgactatgcctattctgctatcccagggagctgtcaaaaaaaaaaataacatagccagtttactaatgaaaacggtgctattaattgttgaaatgaatgggaacaattccaactgtcggataatccccaaatccctatttaaaatctctgttgtttctaatgttcttcaaattaatggcaaatgtaataaacattgttttcatggtgaggtttagaaaatgctttcttgtatattagctgatttgcacctctcagcgtatgaagatggacttaggagcaggaacagctccagctcttgctcaatctgccttcctcccactatcgcatcgtaagctctcagataaggcagaaagccacagccctggtagaatgacctttcctaaactggctgtttcaggatgcactttccctgacatcagggaggtagttaagtgttctgatttaaaactctcctttggggggatagtcacctttaggtaagctaacacaccacccagcaagtaggtgaaagcagtttggaccccagtgatgcaatgtgttactgtatctaggaagtgttgaaaatgacccagagggtatgcaagtacatccaagttatcctgatgggggtagggtggggatgctgtgaataacaggaattattggaactggtgattcagctttgattggaaaggaaataaaataaatgattttttaatgatagagaattcaattatagtcatgggttatgtcccaaatttatactttcccacatagatgggtcttctccatagatagacttcacgtagaaagaataaacagcacattgtttttgcctttgaactaggtctgtgaatggaaaacccttgataagagaagtagttaatgacactaagttgctgtcacttagtgatgtaagtctaaaaaagctaacattcctgcatctcagtttccttatctgtaaattggaactaaagatcctgttacaaagagttgata

SEQ ID NO: 117280 - DNA, 1695 bp, Homo sapiens
ggtcattaggaaagaattgtctggtaggaggctgagtttcaaaggtgaagttctcgcctccgcagtcatgacaacagctccaaggttggggacgttaagggggaggttcaaattctttgacttctcgttaagacgatttgagcttattaaaaactggccatgatctctcagagcattagctaagggatacagctggtgatcctgatagggcattttgctctaaccttggaagaatccgtctagactccagccagaacttgattgcagacagaacagtggagaaagaggggccacagtcctgcagcctcagtctgtttccctggtgttcctgagtggtcctgggtactcacaggcacccgaactcaagggtccaggtcagtccagagtgctttcatggaaacggcaggctatgtgtgccgagaatgtcgctcagccaattgcatggaattcagagttcccctgaggttccctgagacttggttctccctgctctgatgggatttgggatagaaagtgggagtgcctggttaatttggagtttgagggcctagtgctttcaaagagagatccccacctgggagaatcataactcacatcctcttccaccctatacctacccggtttggacaagtaaaagcaacacttaaataagtggcaaaatctgcttttttcctgttgcaaattgaatattatatgagggacaatgactattcccagcttgatgctttggaaagtgcgtttggatttttccattttagacaaatgtcagctttcccccgaagtggcctccatcgtgcttgtttgttccaaatcatttttcaatgctgtgatttcccttctctttgctttaaacactcagtcacgtggcttgtctccaccgtgtggaggtgccgggtgcctggttgggtctctctgcatttctggcaggaagaaggcatttgtgaatactgtcagtacttgtgacaggttggtcacattggaacctttgcccctgttgtttaaaaccgaagaagactgtgactgtggaggtgccccgtgtgctcagcgctcaaatgggaaatggagaagattcccggaacgtgtttggcagtcacttctgagttttccattgagacccgaacatgaagaaaatcttctggctcctgccagttggccaacctctgtctgccttccccagctcacagggctgcacactgcattggggctgtcctccgctgctggaaaatcacgccggtgctcttcacaaacactgaacactggccctctgcttgatccatggaaccaagatgacaggatctcctgcctgttcttgataacagctgtagttttatttcagattttcatttaaacaaatagtttaaggcctcagctgggaaagaggattgaagtatccccaatggacaaagcctctggcacgccagaaagacatgtgactaagcctgagtgactttccttccttcccctcccaggttgctgggagaaataactatgggtttttgacaactctttcccaaaatgaatagtggaaggctgggaaacactgaattatgaaataaagcaaggcagttcattttgtcatccttggcacctgaatcctaaactacggtaatgagatcagccccttaacggagtactccagggtaccttgctcttaggcaatttgtttttctgtgtgtgctcttcaacagactctgc

SEQ ID NO: 117281 - DNA, 1088 bp, Homo sapiens
ccctgtaagcgtgacaatgagcacctagcagaaaataatgagacaacaaaaagagaagtattttttaaaattcattgggctggccagtgtttcactctgcagactcatcaagcgcctgatggacatgtttgtaaagacttggatggtcactttatttggaatgacaaattctgcgctccacataatgaggtcagtgaagcatccagaaaagaaatgtataatttggtagtgcagtctgtaagcacagccctgccacggctatttaagtttaatgaagcaactactttgccgctacacattcttagtgaatagcctccttggcatgtttttgaaaacttaaatgttgctggtaatcatgtcacagcaatctccttggagagcctttgtgtcctgttctcagaagaaatatgccgtttttccatgttaatggttttgaaattagtgatttgctctattttcattggaaaggaaggtcactttgtgatttcctaccttccctcattttctctgaacattcaggatactcttaagtcagttcatcagccatgcagtgcactgtctggttataacatgcctgaaaagccagaggaatgttctatcaaagagcggcatccctattctcagagactgttcttagaattcaaagtgtaaagatctaactcagagaggaaagttcctggacagaccattattgccattttttttcccgtttcagtcactgaccgccttgtattgtccattcattggtctcattagagaaggctgtgctccccacgtattaagcctctcacagaggacatttaaaaatcctttctgaagcagattcactcatgtaaaactaaggtcagacttatggatcctggaccagcattaatgacgcagaactctgtgggagcagaaagacgtctagccattctcagttcttcggtgtgggtccccaaacttagggcctcgggtggtttcccctgaatgagcaagcgcatgattgattgtggaaaagtgctaggtcctcatggctctgccaccccagtgagggtctggggaattctccagactatttggtggcctccacatttccttgggaaatg

SEQ ID NO: 117282 - DNA, 1047 bp, Homo sapiens
gtggcaggcgcctgtaatcccaccaacttgggagactgaggcaggagaatcgcttgaacccaggagaaggagattgcagtgagccaagatcacgccattgcactccagcctgggcaacaagagcaaaactccgtctcaaaaaaaaaaaaaaaaaaaaaaaaaagccatatatacattcgtactttttagattggctctttggtgttttctgctctgttagtgttctgcacagaaacagaaccaataggaacatatatatctatttctctagcaagctagagacccaagagagccactgatgtggttctagctcaaatgctggcaggctcaagacccaagaagagcccatgtttcagtttgagttcaaaggtaggaaaaactgatgtcccagctgaaaggcagtcaggcaggaggaattccttcttatttgggggagggtcagcatttttgttctgttcggaccttcacatgattgaaggaggcctacccacatgagggagggcaaactgtttgctcagcctatcaatttgaatgttaaatgttaaactcatccagaaacaccctcacagaaactcctagaataatatttgactaaatatctggacatcttatggcccagtcaagatgacacataaaattagccatcacacctataccactgtgccacttttgcctgcctatctatcccaaccaacagctacatgtgactatttgaaccagctcataaaagctcaatcacctaataatatttctgaatatggaagtaatgataccattccaactataaccagacattttattcccagtgggaaaatgtgtacatgagtttcaaatcggtgggggcagaaacacagctcccaccatgctcacacactgcctcacacagcaaatcgggacctgggcctggtagacaggatgagaagatttttgagcctgagatcctccttttctacactttcaacatgtcctgaattgatagaaaaatgggactattttggctctgtatccactcgtttcgtcatttattttttctttttctttcttccc

SEQ ID NO: 117283 - DNA, 1016 bp, Homo sapiens
gcacagctgaccccatactccctactccctccatgcgccactgcttctcctatcttttaagaaatgaaaacaacataaaatgctggggcccagctgtgcacctatgtcaggattagctgtaaggtccccagtatgctcagtcagctcagctattttgccttttatcaaaggagtcaccctaacctggaccttgtgggagacaaccacattagtggtataacaaaaacaattcagaacaaggcatatataccccaattcaactcccatctctgagctttgtactctactttgtacttcacatttgatctaattagtgctcagagtatttctgtgaaggtgcatttatcccattttacaaatgtgaaaatctagagtagagagttgatgtgccccagatgttacagctagccattagtagaccaaggttcaaacccaggtcttctgatgtgaaagcccttgcttgtcctactaccccttgctactgtggccatctagtagatcctaggactgtgcattaggtcatctgggactctgaaaataattaagtcagactctctgcagatggggcccagactgccttgggaagagctgcaaagcaggtcagcttcccctccagtagtgttgggacagcctccctcactgtcagtcatcccggggcccactgtgggtctaagcagaatcaccagctcccttgctgttccttccccatccctgccatcaagacagagccatttgctgctgtccatccatgttatggctcaagggttcagacatggtatagggaagatgggagcagggaaagacatgaactgctgtgctgtgtgacaaggccaggggtgtcactgaggatgcaacaggaagcaggcaggcaggtgagagaagctggggaggcgggagatagagagttattctagcacagcagtgaatgaattcagtttgaatgaagcacagaagtaaatgtttggacagcggaaccaggtttcatgatctttgagttgtcctcataacatgttgga

SEQ ID NO: 117284 - DNA, 1075 bp, Homo sapiens
agaaatgcttataatgaaaagccatggttcccttccaaggacaacatgtctctgtggtaatagatgctcactgatgtaatagtagtttacttgcctgatgtaatagtagtaataataataataagcttatactcttgcctttttgctatttgttcataatccttctcccttcctcaactgatagttattattttaacttttctagtgataatctttgtaccttaaaataatagttttaaacctcaatttcttgtcccaatttatgtagttaaatcttgactctcctgtctgttagatcaagatgttaataatccctgtgaaaacagagcatgagttctcttttaaacttctcttatgtggtctgaattgtctgtgtcttcaggagtcaggggccatgtttaattacttggcttttctctttggtgtttctgttttgtttttagatatgagtggtgaactttggttatccatctgtatttaagagcaaggggctgagttttatttttcttcacagatggtgtgggtttcccctgctcttatatatgtagatccggtttcctgttattgctgcctatgaataggaaatctgcatggaaccttgatgttgggtggggggcttgtctcctggaagtttcactttcagatcaagactgagaatgggctggattttagtcaggagtttatgtgtgtgtggtaaggggattcaaaggatttaaatacctggggatttgacgggggcggggtgtgctttactctagagtgtttgcatataatctggccctcctagttctttctagacagttttttttaactttttattttgaactaattttagacgtagagacaagttactaaaataatacagagtttctgtatgtccctcatgcggcttcccgtaatgttaatgttatctactatatccaggcagtttttcaatttctttatagatcaagagtcctctgatatttggcccccaagtaaaatcatgggtttctagtgcagtgcatggacctaaggcagggagtaggggaggagagtgaggggtacccacagtgtcccttaggcagacttcagt

SEQ ID NO: 117285 - DNA, 1011 bp, Homo sapiens
gtagcaggcaagcctaggttgaccaggtgtaccaaatgggcaatgagaattattatttatctaatgtaattttaaggggggaagagatttgcagaaaagcatagccttatcaaaaaaattaagtatgcagtcattttgagtaaactggaatttagaaaaataactgaatagatgattctactgtttctattagaaacaagatgtgaatctacaggacagactggcctgaggacccagtcctttcgaccttggggtatcagtgatagggagagatcgaaagcctatggattagagaggaagttctacctggtaagggggtccagcctccctcaggcagcattctgccatcccttttgagacaagtcctcaccaaattgacttcccttccatgtccgttgaaaagcccaccatgttttttcttgtcttctcattctgttgctctttctgtgtttcttctgcttcacccatccaaaccctaatccccacctccaccaagaagtcttctctgactacctggctttcccatgcattcacatcatatctgttacctttctctttgtattaacttgtccgtgtactctattgacagctgcttaaggattggacagtaacctactcagtaaccacttactaaattaaatgatttaatagttgttaaatttaacatctggtatctattggtccttttataacagtagttgcttgtcctcatactaaatttcaggtcagccctgggaagtactgtaagtattctttaatacttactcattgtcatcatatgagttgcttttaactatttgttaagggtataaattcaaaagtaaaatttttgctttctcttatcctcatttttcactccccagatataacaaatgttaacagtttgtatgcaccctcctagaagtttgtatatatatgcgaacataaatgggagcctattacatatactcttctgcgctctgatttttaaataatttatcctagagatctttctatctcttcacgcttatt

SEQ ID NO: 117286 - DNA, 1042 bp, Homo sapiens
tagatgatgcagaaaatgtgtccattttcttcctttttccagatggcagacttttttttcttacacaatacccatttgtatggcaattatgcccagaccagctttcaatgagtccattagagccggccagtccaacacaacttcctgcacagcctgtcccttggggacatggattctgttcacagggcaaagacctggatggcttgacccagctcccgttcctccaagctctagacttcatcattgttctctcaggctactctctccctgaccttcagatttgaccctcgttgttctatttctaggcctaaatttaccttccctccattacagcttcaccagccaatccagttgcattgcagtaatgtctctcagctgacttggtcgctggtattctggcacctggccactttaggggggcagagagatatattttcaaaacatgctatttgttaccagatggtcaactcctctaccaatcaaatacacatcatttatttgttcaacaaacaatgaacaccgattattataagactgttagtgctgaaggtacatcaaataagatactgtcatcctcagagcactcagccattactaatgtaccacactggatagaaatcagctaccccattgaatccatattatggaaacaaagcaaaatcatactaatacttcagagtcattctaaactttatagctttccagtagcttttctactagtgagactctgacttaaggttattaatattagaatatatattacatagaatatatattattctataaagtacattagaatatataagatcattaatattagaatatataatatagaatatatattattctgtaaagtatattaatgatcttaagtcagagtctcaagagcagattgaaagagatccttcatatcatttaaccaaccttcgtttgctatctctagccccctcccttttagcatggctccctgctaatcaacctccctctccctgtagcctcaataaaaatcttttggaaacatgtttctcagatctttttgaaa

SEQ ID NO: 117287 - DNA, 1093 bp, Homo sapiens
caatgagaacacttggacacagggtgtggaacatcacacaccggggcctgtcgtggggtgcggggagcagggagggatagcattaggagaaatacctaatgtaaatgactagttgatgggtgcagcaaaccaacatggcacatgtatacatgtgtaacaaaacggcacgttgtgcacatgtaccctagaacttaaagtataataaaaaggtataatatatataacatatataataaaagtataataacaaaatataggagaaagtgggaaaaaaataaaataaaataaataaaatctgccgacgatccatagtattctcaacagacttctctgctagatggtttatgagtgcaaacaatggacactaaaagttgtttgctcttcaggtggagaatttgtccaggaaacctattgttgacacttgtaatgagaaaacaggcggtgcaataatcatctgaagtgaatagagatttgttttactttttaaagatgaggcaattactatctgactccatcctaatgggtttcttcctgtggactgattaggaaaaacaggctggcaaggctcagtgcttttcagtcagagcagactttaagccatcctcgtggtgtcagccaggccaactgtatgaggccacaagggtgcacctgacctaggaaggacaaagcccttagatcagtgaaaaagagaaacatctatatgtatgtattatatatacacatagatagatggcttgatttatggagaaaaatcagaacaaaacaaccaaaaaaatgcacagagcctatgaaatattagttatttataagattctatggtagtgttttactttggaaaagcagtgtaactaacatggtagaaaactattctttaaaataagtataatctgcctcttatgggttttttgttttgttttgtttttgtaagggcaaatgccattctttgggtttaatcgcttgggttttttttcttcctgtaggacccatgccccctttgtgatgaagccaaggaagtactcaagccttatgaaaacagggtaatataatacagtgtggcttttatgtatatggattgcatattagatgtggtata

SEQ ID NO: 117288 - DNA, 1068 bp, Homo sapiens
agtgtcaccttccccattttccagcttggttccttttgacaccaacacttcccagttatgattgagagtgagaaaagagagtatgcagtgaacaagtatctttacacttctgcctggatctataagtgaatttgagtcctctttaaggggctattttaggctcctacagataaaaactactttggattttttattcaaggccttatttagtcatagactattcccatggcatttgtttagcatgtgatttccccttctctgatcaggagaatgcttgaggcccaaagccccaggcacagttcctttgggtttctaaaatgagagaatgggacaagtggtagcatttccatttaattgtggctgaaactgaggctttaggagatgaggatttgcctccctctttgggttttatgtttatgaaatcctcacctaaaaatgcactcagggaagtcaaacatgctgaatttcaacggaaactctatgtgaagaataacttcaaagctcaaaatgaagaactataccatttatgcttaattcctctgactgattagttagtaggagctgtgttggtttaaatttattttgacctctctagacaatttactcagaaccacttggaacaagttttgtctttaaagattatcaataaaatccacctttacaattacctaggcggcttcttttttgacgtgcatgaattgaggatatccttggtaaaataataatggtactgaatttttccctgtttgagaaataaaaacaaatattgggaaaaaccaattggaagggaactggcctttgcttaaaacccatcaaggggaaaccttgatttctcaaaatctaaatttcagtaccttcataattttgtgaaggctgagtaagtttaagccaatacctggtgccaaggtatttgctagtcagtcttacctaggcttagtgacatccttaggtgcagataaatatgttgaatatttaaacagtcatatcttagaaattcctgtttaaataatatttgtgagaaaactttcagttatttctatttgaaatttttttcagttttgcaattcc

SEQ ID NO: 117289 - DNA, 1087 bp, Homo sapiens
tttacttattttattttttagaaatgagatcttgctatgttgcccaggcttgtctacaactcctagcctcaaatgcttcccgtcttggcctcccagagtgctgggattataggcatgggacaccacacctggcccagacataactatctctaacatgcattcatgtggcagaaatcaaattagtaatttactatttgaaatgtagtagataattagttatattgttattataacatgaaattatttcccacttataaagtatctacatgggaatgttacagattgtttgatattaaatattctcatagattgctttcttagaaatttggacaaactcttcgtctggaaataagttgcattataaacagtaaaggtggacatctatctcttgatgattttttttttagtcgttctctattcaagctttaaaaatatacttttggttactgtgtaatatttgttacatttttgtgtttttatagtataccataattgaagaaaaatgatggaagagagtggaatagagacaacaccacctgggactcctccaccaaatcctgcagggctggctgctactgctatgtcttctacccctgttccattaggtacatgtagttgtctaacatctcgtgtgttttgagaatagtgaagatactatcatcttttctcagagtcaattaagaaaagaatgcatatattaaaacttctctattatttttcaggatgaaaggaaatagcctttttaatttaaagaatagaaagaaagtcttgtgtatttaaagtaagaaaacatcagtgttttgctttaggtggacttttgttctttatgttcataattttaccatcatttatattatggcagaaatatcctaaaaagcatgtgttagctttgtcttctgttctttttcttttttttgagacggagtttcacttgtcacccaggctggagtgcagtggtgcgatctcatctcactgcaacctccgcctcccaggttcaagtgattctcctgcctcagcctcccaagtagctgcaattacagcactcaccaccatgctcagctaatttttgtatttttagtagaaatgg

SEQ ID NO: 117290 - DNA, 1023 bp, Homo sapiens
ccctccttcatgtattgctcactccttctgtacttcctttgctgattcctcctcttctctccagtcttctgacggtcaccttctcatcaattcactctcagactatcccatggctttaaatactgtctctgtgctaacagttccaaatttatatctccacctgagaccttcctgtagactcttgatttatatataagttgcctttttgacaagtttacttgaatatctcaaacttaatatgtctagaactaaacttctttcctccacacttgctccctctagccttcttcaccttaattgatggcagttctagccttccgttttctcaggcaagaaaccttggagtcagccctgacttctctcattacccacttctaatccatcaagaaatcttatttgtaagacagacagttcttgtttttcaacataattgtgttccataaagttgctacagactgaatttgtgaatactgagccattgctcccaggggagatacgatggttaggatactgtgggcctctggtcacattttgccaacctgtcaatacataactttgttttatgcctctttctgtttaaatacatttttatacacatacatgcacatatttttgattcattaatattgaactctcacagtcaacagtactgtaactcatgcttgaatgcagcttatttaacacactcgttttctcattaaggcacatcattgtcttcttgtgcttaggaacactacagcactccagcactacacttgggggccatttgaaaacagcagttaacatcaacaaacacaaagatgcaaaaaagaggtgctaaatagatcccaaaaaggatacctgtttacattgtgtcagctgaaagaagaagtcagggcactgccttgttcagcctcagctaggagtgtatgcatcaggcaactcaaatttctcatagctctgtgcatgtccgattttgagattataaataaatttcatgtgtagtcaatggaatccacaaaactaataggatcgatcaactgt

SEQ ID NO: 117291 - DNA, 1055 bp, Homo sapiens
ttatttaacagtaacaatcaatgagaaaatgtaatataaaaataatccacaatagcaaccaacatcataatgcatatggaataatttggaaggtgtaccccaaactgttgatactacggaaatgtaattgtattttgtcattttttactctacatttttgtattgtttgaacgtttacagtgagtatatatatgtgtttgcatataaatgtatgcatgtattgtgtaatcataaattagtatatttaatatgtaataatttgaaatggtctctaacctctgccattgttgtttagggtgctcaggaacggatagatagcttgcgtcgaactggggtgatccatgaaaaacagacagctgtgtcagtagaaaacttcattgcagaattgctgcctgacaagtaagtgtattatgtttctcttggaagcaaaatataattgggtctgggagttgacactgaatacttagcaaaaagtgtctcctgttttataaccagagagaaaagtatattttgatgctggctatatcacttaactagctgtgtgtcctgcatggcttagctggcatttctatccttgtgtctcttttttaattataaaatggagatggtcatgcctgctttctgagatcatgctaataattaataaaatggcactaagtataagatgatagatttggtgtggatataattgaccatgagtagcaaacacaattattctcatagttattcaaagtcgtggaatatatgggcaagaaggcctgatggcattctctaggtttgagtttctagtgagcagtatctctcctgtactcataatagtttagaaaaacctccagacagcataatttatcattgtttttcaggtggctttttatgggaaaaatttttaatttgcttaattgatttatattagaataacttccctttgttgaaatctaccttcttttgtatttgcattatggttttgttgtttttattttttatttgtttgttcagtgttgaataacaatgggcatagcattttgtggcttgtaatatgcaaaatatatcctcca

SEQ ID NO: 117292 - DNA, 1070 bp, Homo sapiens
aatcattatttctctcatttttttctttgtttttactctgagttctggaaaagatttaccttttctagttgttttatgtccgcctttcgtttgctttcccttttatctcacatttcatttccactgttatctccatttcccttttccttgattgattgtcctcctgttcatctttagtgaaatcaacattagaaaccttataggcacgtgtctttaggtttttggctgaaaaatggacctaatagtgtacctatccacacagtttccaggagaatgtaagtataaatgataatccttattcctctttttttttttttttggtgtgttttctctaatcctttcatgaacaaaatggaatataaatatatacttgcattggaatctctgtgctcttaagtggtattctattgacttttttctgtcaatttcataaaatttttgttacagttgtagtttgtacattgttaaatatcatttcaaaactgcctttcaaacttatttgggacatgaagacatttgagaatctaagaaaactattgggctgtctcccaagaaaaatgcgtgtatgtgtactttcatagaactttggcatatgtgttcacataatccctaaaagtaacctctggcctacttattacagtttagaaagggggctaagaattgatgcttggaatttgaaattttactgaaacttttatttataccgtaatttcttttcataagttcaagaaaacctttttatagatattaacattacactcatttcaatatgaaggtgattaaaagactgtaagtgaatactatgcatactgttatgccaataaattagaaaaattaggtgaaagagtggattttctaggaaaatagaagttttgccatagttaagagtattaggttgaaccaaatgacgttgttgcctttgatggtcagaaatagttatatattgtcagtttcatatgattcagcttaattgaagcattaaaatggaagaactttatgtaactaaaaaaaaaaaaatcactgagtaccaatggtgttacaagtgagttctacaaaatgttcagagatga

SEQ ID NO: 117293 - DNA, 2016 bp, Homo sapiens
tttgcatcagattgacttggaagctattttacgtacgtaatactgtactgtttctcttggaaccagctgtagagtttccaattcagttatcttggtgtctcagttatcttagtgggatgtgagaaactggatatcgttaaaaaagaaaaaagaaacaagagctcctcaggtgattgtaatacatggcacatttggtagtcatgtataactgtatagatccgttctagatgtggctatacttctctggactatacctaacaccctaaaacagaaaaaccacatcagtcttggatatcaagcaatgagtttattcttctgtcattcctttgtagatgaataaatgatttgaataggagcaaatatgagttgggtcaattaggaatgttgcatcagtggttgatgttgtccaggactggatattacttgatacatattaacatgtgaatcacatttccagagagaatttccataattgagcaattcttttctgaatggatttaagccttaattttcagttttcctctttctggttgaaattttactactataaaagataactttagcactgattttagtaccaatcttattattaacctgaagtgacacttaatttagaactagaactcaaaccttccgactgttagcctcgttaatggggatattttttaaaaaatagatgtgtgtaatgttacattgattgtgttctagccttgtaagttgatatagttggcagcctagctgtatttctcagagtttgtcataatctatatttaaaataacatgaaacactttgaaatgtcacttatagctagttccaatgatatttttaaatgtattataagtaatatcaatttcatctttccacaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagacattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaaattatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgc

SEQ ID NO: 117294 - DNA, 1908 bp, Homo sapiens
atttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaagttgtatagcgattttttttttaaatgctagtttatattgaaaggacgcatatttctttttacctaaatttgttactggctgccaagaattcttgtacaacagcaacttaaccaccatctttctagtggaactgtaacattcacatataccagagttgctaacttcagggtgcaagaactcaaaatatttagaggagaggatacattggagataaaggtaataggcaagaatttaaggcctatggtcatgaggacacttcttgagtattgggttttcgagtagttttatttcttagtttcagttcacagcagaattaattaaaaggagggaaagtacagagatttcccatatatcgccttcccctacatatgcatagcttcttctctctttatcaacactccccaccagagtggtccataatcaatgaacaataagtggtccataatcaatgaataataaacaatcaatgaacctgcattgacctaacatctcccatagcccatagtttaccttagttactcttagggttg

SEQ ID NO: 117295 - DNA, 1045 bp, Homo sapiens
tacccaaataaaactcttactttaaatgagctcctttgttgatgtttcctgccacttcaaagcaagtgtttgcacatgctgattgacaagctgagaagaccgaatgttgagcggagctgcatttcttcacttggctgcacttttatataagacatttcagaaacttcttggtgttatctcagagctgaaatgaatttccagcttcatgttttcttagttattattatcagtcccaaagtacttactatatctggtgcacggtctaggtccctgtgctaatgttatgacgattaaagagggctgggtgtgagtttcactattaataatgtctatgggtctttcttcgagtctccaggcattggtacgaatgtctttctctcctactgctgcttgggtctgtggatctgatttcatttatgcctttccttgtctctgtccctccagtagttgtatataatcctggctaaatgcactggtgtcttctattgttagctttgcctaacctcatctctacagtttcttcagggattccttgagcacagaatagagcactgcctttctgccacagagagatggactgtaaagtctggcaatgtaactctgcaggagggatttaacagcttgtgataaaatatttaaggaaaaaataaccagctaatgggaagagattaattggatattaaaattatttccatgtaacaagaagactgggctaagaatatatattgcaacgggggaccaattgcataatggggaccataatgggaacaaaaaactatatgctccctcaatggggaccagtaactataatggggaccaattaaaatttgtccataatggagatcaataactatgccccattcctactttcatcaataattttaatttattaaggtaaattaaaatattaaatatatttaatatcataatagtgattgtattcatattatatataaaatataaaatatataaatactttaatacatttaagcatattaaatctataaaatataaatatattaaatttgtgacaaaggcaaagtat

SEQ ID NO: 117296 - DNA, 1045 bp, Homo sapiens
tatatttcatcctgtctcccttagctaatttatttaagaaaaagagggctatttttaattaacaatactaaaaggaaatgaaagtttaggttgtgggtaccttaaacatttgctatgaatcttaaatagttactgtttacaagcactgacttaatttcagtttgctgactctactacctggatattggaacctgaaaagggcaactcattgagcaataagttgatcatcagggttcccaggtaaataagggagcttactgcttagaagactctctgccatggatgagattcagcttttccatctgtatacagcagaaataatatatgtccttccatcatatctgagcagttaataagtcaatgattatatctagccaatgaaatagaagtgagccattcgtacttagtactttaaggcagcacttttcaaatgtattccacaacacaatgaggaggccagggaaggggcagggatgagagctgagaccacccgaccccagatgaaagatatgctaaccatactgacaaaaaacaacaggcttaggcgaattcatgcgtattgattcctgaggccttagatactccaataggcttctaccactcatgtagaagacaggaagattctactttgaagagtctgaacagcctaaaaagaaagacctaaagtcactgacatcacaattttctagtaaatgggatacccagattacattacagtgaagcttaaagtcaaccagcctctaaatatacatatttagagtttctaatcagggaagaccccaagatggaagataaaaaccagaacagacaggaaaaaaacaacttggcaagaaaataaaagccactgacgaagaagaaattttccaacacctattatgaatatcctagggagttttggaagatactgcatccctgaactgagaacaagatgctaagaaaaaaaggcattcagaaaacaaaaaagaagaaaatagaagaaaaagacagaaaacaggtctaaggagataagaaatttagaaaacagtatagaaaatctaatatgtaa

SEQ ID NO: 117297 - DNA, 1021 bp, Homo sapiens
gaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggtgagctcgcccagccctcccttcttccccagcccctggtgcatgccgaccgcgggatgtggctgcagactcttcccgagttgaggtggcgggagtagtagacgtgcacgacttgctggcatctctggattcagctgtcaagggtggaattgccgaggaatgttaacttaatctctcaaaagtttgtagcgggtttggctagttacgtgataccggagggctgcctctaacaaccttccccatccagttaggtatctcgtgtgcactttctttcccacccacgctcaacagtcaccatccctctgaatgacagtagtgtttgtgggccctttagaggagaatgtgcagtgaggatctctcgagagaggttggagagcacctaccatctgtgtcgttttgaaagattgtgttgtgtggcttatgtacgcctattagggatcgcaagagtgggaatgttgctgtttgaaggaaaaccttaacagggtgtgtttatggtctatgagttattaaagctcaattcttgcaatcttgaatatacaaaggatcatagagatcttgtcttgggacacgctgttcctaataatggcataactctttttttttgcgatgaaaacgttttgggagaggtgtatatttaaaaaaaaagggacagaggcgagtcttt

SEQ ID NO: 117298 - DNA, 1110 bp, Homo sapiens
gcataattatctaccatgggactaactctgtgttgggaactacagaagaagaaaagaagtaaaatacttcagaaacttgttagggaaaaggactggattgtcttccctccagttgaattcctttcattatccatcactgactttttaaaagtattttgtctagatgtccaactgtaggggaaaagataaatatccttggtgcatcttgctatattatatagccattctaggaccagtaggcatgagttctccatttatgagttattggggaagggggtatcttagatgttgacaacatgcttgtgacattgtgggattatgtggtgattagcaaaccagttactgcttctgcctagacagacattaacaaagtagttggacaaataacatagttaataactgttttttaagtgttacgaaagaaaaggatacttgtaaagatagaataggacctaattttaattgggttttgggaaggcgtttttttgagaagtatgacattgaagctgagacctgaagggtaagttgatgattgggtggaatgacagtcctgaccaaagggacagcgcacatgaaggtaatggggtgagaaagagtggtatattaacataactaaaaggagataactatttttcattataaatgtagtgggacgctattgaagaattttgtgtggggtagccacatgacccattttgttttaacatctttaggctctgggtggagaatggattggcaggggcaagaatggaagcaaagagactcaagtgattactgtggtctggttgagagatagtaaaggttggtggcacaaaggattggatgtgggagtgagaaagaagctgacttgtagattttgaacttgagaaacttaatagatgttggtactgttgcttgagatgagaaatactggaggaggaatagatttggtggttgggagaagtttgtatttgaggctattctgtttcagtagcctataaagacaaagacaacttattccaagagtcgtggaggaggctctgtgtgtgtgtgtgtgtgtgtgtgtgtgtgtgtctgtatataaacatatgtaaatatatatatttacatataaagatttggttgcttaag

SEQ ID NO: 117299 - DNA, 1028 bp, Homo sapiens
gcaccatggtaggagcctgttgtcccagctgcttgggaggctgaggcaggaggattgcttgagcccaggagtttgagactgtagtgcactgtgattatgcctgtgaacagccactgcgcttcagcatgggcaaaacagcaagaccctgtctaaaaaaaaatagtagtacagctcaatttggacttcacatccaggtttttctgactttaatgctaggacatagtagcagcaggttcttctctctttatcttttctatcccttagacctgttctaagataacaaagatgttgagggggaccccttggggattaccaccaccatttctctaccttgaactcctgagagttgaatgattatataactgacagaaatcaagagatgtgatgatgtaaatattattatgacttcttcactagcatctgtataagtgtttatcttcatacagagaataggcacttaataaagatttgttcatggaatgtacaaatcaggtgagcagttcctgtcacttaacaaggactttaagtaaaacactaaataattacagaatctcctctaaccatgagctgcttctctgagtgggctgtgttgatgcctagtcaagaaatttcacacactattaatcatttcagtgtatagctttagtccttgaaagtcaccctgggggaacaagaatgtgtctctcgagggtgaggggaagagtagagtagtgtccagaactgggtaaaggtgggaccctgataagaaatatttacatgtggcaaagtcaaatttggctgatttcacagttttgccaggggctttgccctgctaaacccatgctacttgccattgaagtcaggcttacccataatactaaatgcattcccccaggtgtacactgactgaagtagttctacaatgcggcaaacaggtaaaattgcagctactgctttgttaaatagaaaacagcttttaatttttagcataaaaatttcctgggtagaaggaaagaaattttgggatttaaaatgtagcaaaaaatcag

SEQ ID NO: 117300 - DNA, 1029 bp, Homo sapiens
ttgtcatctagatgataaacatgttgttcttgttgctttcaatagttacatggctttaaaaaacagataaaagaaaaatatgtatggtttttaaatattttcatttatattcattcttttttgtttatcagattgcttcccttccttgggcacttcttgtaatggaggtcagttggcaacaagttctcttagtttttttttatctaaacatgtctttattttactggagttttgaaggatagttttgctggatatagaattcttagttgacagctttcttctttcagccttttcagtatgccatttcaatgtcttctggcctttggtgtttctggtaggaagtcagccaactgtgtaagatgttatttttctcattgctttccagattttctctttacctttgactttcagcagtttgtgcttcaagagtttctctatttgtgtatcctttgtcagtttgttaagtttcttgaatctgtacgttgatgtttttcactcttccttcttctgccatttccattctgctattaagtccacctagggaatttttcatttcaaaatttttttcatgaatttctgtaaaaatttattccaggtctagaatttctaacttttaaaatatagttttcatttctctattagattccatctctgttactcattgatatatttacctttgcttttgtttaacatatttattgcagctgtttttggagtctttgtctcctgaatttaacatatgggccacatggaggaaatttctaatgactgcttgttttttttgttttttttgtttttttttcttgagtgtgtgttacattttcctgtttatttggatgtctagcagttttttatatggaaactggccatgcagacactacgggttttggggttggtttttaaaaatattcttctgaaaattattgttgttggtttttttttgttgttgttctaaaaggcactttttatctaggctcaaactgcagactttccacccccatccactcctctccccatacaatagctgat

SEQ ID NO: 117301 - DNA, 1062 bp, Homo sapiens
gcacttcagcgtgggcgacagtgaaactgtttctgaaaacaaaaaaaaaagcataaaaataaaagttacattaagattaaatatattagaaattcattgggaaatgatctcttgggatctgtgaaggggaggaggctgtggcccattttaatctaaactttaaaagataaaatgggaattcaaataggatgattttatatttgatattgggagcattatctggatgttgtgaattgttaatacgtgttttgtgaaatattctttttaggtatttctgaaaatacagtcactcacttgcctctttaactgctctgcttattgggggcatctgctttgtgaattcatgtataattaaaggataatttggcattttaaatcctaactttagtacctgttttttttgtttgtttgtttgtttttaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggtaattcaccttccttctagtcattcgtttaccaaatctttattgagggattatatgccgatcaccatgttagaggttgggaaagcagtgatatgatgaccaagagattcgtccttcataaagtttactacaggagataggcaaagaacaaaatactattagaatgtcagcagtgggccgggcgcggtggctcgcgcatgtaatcccagcactatgggaggccgaggcgagcggatcacgaggtcaggagatcgaggcgagcggatcacgaggtcaggagatcgagaccatcctggccaacatggtgaaaccccatctctactacaaatacaaaaaaaaaaaaaaaaatcagctgggcgtggtggcaggcacctgtagtcccagctactggggaggctgaggcaggagaatggtgtgaacccaggaggtggagcttgcagtgaactgagacggcaccactgcactccagcctgggcgacagagcaagactccgtctcgga

SEQ ID NO: 117302 - DNA, 1024 bp, Homo sapiens
gaatcttttaaaaatgccattgatattaaactacaaataattttgtttgcagagtggaaacagtgtgtttttggacagcagcaggaagttgtgcttatcacttactctctcacagtataaaagacctttaaaagcatgagttcactaatcacaataaatacaaaatatatttctgctatataacttaaaattctaactagcagtattagttataacttttttacttctttgttagcaattccttttttgatttattgagtctatattaaatatagaagcattaataatcatacatttatgtcatcagatgcttgaatgactaacacctcagtggtaaatagtaatttgttcctttaggtcttccatttattccttaagcaaccatttattcaacttcttcatgtaaggcaccgtaatatctctaaaatgtttcaaaaggagtgtgaatgtgtataaaaataactagtattgcttattatatttatgattcctttttctaggaacattccatacttatgatagatgaaatcaatgatatccgaattattggagccattacagtcgtgattcttttaggtatctcagtagctggaatggagtgggaagcaaaagtaagttatgataggaacacctgtaaatatttaatacgtaaacttttagagcttatgttttgggaacactctgaagtatggtaatatttccagattctaatggtacctaagtggccattttcacaaatgtttatgtataaggttattttctacttgacaaggcagagaatctttggagataacactcagcctaggatctagttaaacacagtactttgtaaattttgaatttcccgccttctcgcccatcctccagttttgcagtatgtaaaaatgctgaggtcagtgtgttagtccaaattaaacgtttggctttgtaatttatttaaaagttcaacttagacatggggcagtaaataaaagttattgcccacatgaggttagagaagttattcttgctattgaaatttcag

SEQ ID NO: 117303 - DNA, 1082 bp, Homo sapiens
tgtgccaccactcctggctaattttttaattatttctagagtcaaggtcttccttgtgttgcccaggctggtctcaaactgctgggctcaagaaatctgcctgcttcggtctcccaacgtgctgaaattacaggcgtgaggcaccacgccatgcccccttttgtttttctacctcccttcttgcttcttttacctcagagattgaggggattatccacattttgatttgcatttgggctagtcataacaattcattcagaggctcttgaaacataattagcgaggtatacaaaaaatgagacatgaatcagatcagatgatcattttgatggtaaaccattgtctcatacaagaaaagaacaccaaatacttgaactgggaaatatgcaaaaatttactcgttactttaactgaagaaaagttaggggtcatgtatacctattattcttgacctcagttattatagtctaatttgctctccattaattgtcaagaatattttgttctctgcagctgaaatatttaatgagaactttgggcccgattttcgagaggaagagactttcttttctgtatttgccatcttttttcctgctgcaactggtattctggctggagcaaatatctcaggtgatcttgcagtaagtattataaagtgctatatcaattatatattttaaaagtggaatttgtatatttatttttacagatagactttaaaaaatcttcttgtcttctaggatcctcagtcagccatacccaaaggaacactcctagccattttaattactacattggtttacgtaggaattgcagtatctgtaggtaaatagtttcacatttctttatgtgtcgcagaaatttcatgatgtacgtactataaatacttatttttatgacatttgctaacttttttaaatacagaaatatttcaataaaaagacatggagttgctcattataattcaaaaacagtttttagaaaactagtaatgacttctatagacattatctaaaccgccaaatgctttatggtatctccaggatttttattaattatggtaaattaaaaaattatatgaa

SEQ ID NO: 117304 - DNA, 1291 bp, Homo sapiens
attacccagcttcaaaaaagttagcaaaaatattagtacatggttaatcttgtttcatctatacccaagtcactctgctctatgggttctttttaagcaaatcttagataccatgtgttttcttctttttaggataatcatatttgagacagagatttaaatataattataattcattaacattcaaattattttccctcacagaagagtggtattacctgaagtctgatttttagccacattcaagtataaaatatttggagtataggaaaacatcactgccatttggaactctttcagtacagtgttttcatatttacttaaggacatcttaaccaaataggctaggaaatagtttgctagtataccattttccacaactctttacatggtttttaagtgtttatgtgtaaatactattctttataaaaggttcagtttcatcacatattggggaccatgatgctttacaaattctgttcaaggtaaagtcttaattgtaaatgcaatgtatgctattataagggagtagatatgtagtcactactttggtttctttataaatatatatatgtatataaaattctgaaatgaatgtagatattaactatattattcttgttgtcacttgtgctttaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtgagcattgactttgtaatatacagacattctgtatttatctaggggtgagactactatcaaatatgaccattcagaatatagctgtaacatagaagggaggacagttgttattttttttaatttttaattttttcttgagatagagtctcactctgtcgcccaggctgtagtgcggtggtgctatcttggcttgctgcaagctccgcctcctaggttcaaatgattctcttgccccaatctcccgcgtagctgggactataggcgccagccaccacacccggctaatttttgtatttttagtaaggatggggttttaccatgttggttaggctggtctcgaactcctgacgtcaagtgatccacctgcatgggcctcccaaagtgctgggatggcaggtgtgagccactgcgtctggccagttgttctgtatatcccctaaaactgtaaatatctaattggacaaactaaaatatgaatggataaaatctgaggatgt

SEQ ID NO: 117305 - DNA, 1718 bp, Homo sapiens
acattaatcttcatgacattgacattttcaacatttgaaccaggttgtttttgaattatgcctctcagtttgaattcacctgaattcatgatcttagtgatcaatcctatgttgttggtgttttttttttttttaagtcttctaagaggaaatgtttgaacatgtacacagagaaagcaatataatatacctagtatctacattacccagctttatcagttatcaatgcatggttaattttgtttcatgtgtaactcttcctatcccagattatttagagcaaaaccctagactttatatcatatcttttcgctggaaatatttccacatttagctctagaagataaaaggttagaaaaaaataaccacaatactatcttaacataagaaacagccttcctaatagaagtacatgatggcacttacacagtattcttgccaaaacttgtacctcattttgattaactgtctagatagaaccagtttactagaattatagaaatgagaagaggttaagcaatacaatgatgatgaagtcagaaaaatccagagtatgagatctccatgggagaaatgatagaaaaataataaaaggaaaaggaaatgtgaacctgttgattgaaaaagactgaagagacgcataaaccaaatataatgtgtaacctttttttttttttttttggatcctgatttgaacagactatttttaaaagataagaaaggacaatttagggaatttgaatgctgacttgccttttttgtggtactgttaagcaattattaagtttctaagctgcgacagtggcattgtagttaagttttcaaaagtccttacctgttagagatacgtactgacatatttatgtgctaaaggatatctgggacttgtttcaaaatattgtggggaatagccctaagttgatcattgttgaaattaggtgatggatgttagcagttcattacactcttctctctgccattgtgtgtgtttaacattttacgaatgaaaaggttttcttaaggtaagggctagtggtaaataaatttgtttcagatatttgtaatgcacatagcgttgttgttattattattataaaatgatccctagtgttaacctccttcaagatgtgaccacataatattgtgttattttctgaattgtttgtgagatttatttttccatttttgtcacttttatttaaggtaatgagtatggtgtcaggatttacaccactaatttctgcaggtatattttcagccactctttcttcagcattagcatccctagtgagtgctcccaaaatatttcaggtaagtgtttttatattacaggctttattaaagggagagttaaagtaatacttctcaatttagaattgttgctattttcaaattatttgcttctatcaaccatatatacatatatatgatatatatatgcacataaagatatacatagttaattttatatgtgtgaatgaatgtgaatgtttatataaatatttgtgcatttgctgttaaggtatattctttgagtctttttagaagtgctgatggatttttgcttttttgacatttttagcatacattttcaagatgtttaaggtataggagtgcagtctaagactgaaaataggaagtagtaaaatatctttgttctagtcagtatgatatcaacctaaatattttattttacaaatatttaaacacctaacgtg

SEQ ID NO: 117306 - DNA, 1020 bp, Homo sapiens
aaaaagaataaattcatgtaattaacattttgctgcactcggtatatttttaaattattttttgaaaggatccagttacagtactgtagtagctgtatagcctaataagctaggctatttatacatataacctactgtggtccttgaactggagtgagtaccatggagttaacaaaatactagaagacatagtatctttcccactaggttactgtgtagcaggggaaattggacaaacttgttttaactgagtaatgattaatgatttcctagtatgtcgtattgataacagctaaacgtatctccaggtaagatgatgatgctggagtatgttaggattggtcccggtattgagcattataacccgtgacacatgaaagacctgatgagaaaggcttcatctgggctcaatagaatagactgggaagagattacaagagtagtttcaatatagtagttttaaacagtaagaacacattttgtaatccagatatgaaataatgagcttttagattaaagtggtagctccagaaatgaaataaaacattttagaatcagttatttctctaacatacctatcaagtctataaattaacaaatgtctaaaatcatttgaagtccaagttgtttattcaataagaaataaaattgtcctgttcaaataacccaaacagttaagtactataaataagtatttcttaacaattagaaatttgctcatttccatttagacctttggctatatacaaacaataattttaacatatttatttgtgaaagactctttcagagttgtatgcacagcatgtctgcagccctgtcatctcaatcttttctaagtaatactttttctttaaatgaattatagttcagattatcagtcttaatatcttgctgtatatgtgaactattgaaagtacaatagtgtatttcagcaattgactttttaaatgtgaaagcatgtttaattctctatgcctcagattggctattgattggttgttattactgatgttaatg

SEQ ID NO: 117307 - DNA, 1031 bp, Homo sapiens
aaaccttgtctctactaaaaatacaaaaattagccaggcgtagtggcgcatgcctgtagtcccagctacttgggaggctgaggcaggagaatggctcgaacccaggaggcggaggttgcagtgagccaagatcatgccactgcactccagcctaggcaacagagcgagactccatctcaaaaaacaaaaaaagaatatattatctttctaatagtttattaaccatcggtataaactttctttagtcatgagtaatccctccttattggcttctgcatgataaacacaaatcttttccatgtttattagtaaaccaaaagggaaaataatgtttttaaagaaaccctgaaacgtagataaatgtcaaaagagaattgctctacccagtctctctctcagtaagaaaagtaattgtttatttttttgttactcttttgaattccccccttcctttttgctagactaaaaaggtctgagagaccacacgcaggtcttcagctttagggtagacagaaatggagaagaaggaatgagagccctgggaggaaaacttttcacttcagcatattttggatagtgatgtcaaggatgacagaaaatagaaattattattttatgtaaaaagttgtatcctagaactgagagtatgaccaaaagcctatgtttatttgccgtcaattaaaaaaaaaaacaaaaaaaaaaaacctcttgctttggctcattgtagtaaagccaacattaaaaaaaatttatttttgggcatgttggtgcatgcctgcaatcccatcactttgggaggctgaggcgggaggatcacttgagcctaggagttggagaccagcagtttgagaccaggctaggcaacatagtgagatcttgtctttaccaaaaatttacaaaatagccaagtatgatggtgcatacctgtggtcgggagactgaggctggaggactgctagagccaaggagtgtctaggctatagtgagccatgattgtaccactacatgctagcctgggcaacagcgagacc

SEQ ID NO: 117308 - DNA, 1007 bp, Homo sapiens
tttaaaaagtattttcatgtatttataatcattgtgaaatgtttttgaatgccttattattcatcattaagttttaaaacaggaatttgggaataggaattaagagcataggcattggagtcaggcaaatctgctttaaaaatatcagccttttctgttagatgttttgtagcctaggcaaatttgatgacttccaagcctcagtttccttatctgttaaaatgtatttaccttacaggttggttgttaagattaaaaagaagattaaggcctgcgagctcttagcatagtgctggcatgtagcttcttttgtttctcttcatttacgcaaataagtgatgaggattatggacatactatcaattttatattatatttgtctttgtgatacatgtttgtatggtggaaactaaatctttactaactctgacaaagagaaaatgaagaaaaactactttaaaatggagaaatggtactttcaccatgaacttaggaagactccatttggtggtcttggttttatagagtgggtagagtttttcagtgttgtctgtcatcttacgtatctatggacagttgttacattttacattttttatgtaattgatttagagagaattgattcacatactatgtattactgtctaccagattctactgtcctatgacttgtactcattactgattctccagctcgtaattcaaatacagtttgtgtatctatatccaaaatgcttggaacctgaagagtttcagaatttggacggggagaggttgattttggaatatttgcattacatagtacttaccagttgagcatctctgatccagaaatcccaaatctgaaatgctccattgagcatcatgttaggcatgtaaaaagtttcagactttcagatcaggatattcaacctgtaacctagttgtggtttatgtatttaaatgaatagtcatttcaaacagattatcatagttgtttaaataagaagccatttataataaactta

SEQ ID NO: 117309 - DNA, 2269 bp, Homo sapiens
catttgtttccatttatcatgtcccaatcgttcctttttttttttttttttttttttttttttttttttttttgcgactgagtctttttctgccacccaggctggagtacagtggcgcaatctcggcccactgaaagctccgcctcccgggttcacaccattctcctgcctcagcctcccgagtagctgggactacaggcacctgccaccatgcccagctaattttttagtatttttagtagagatggggtttcatcgtgttagccaggatggtctcgatctcctgacctcgtgatccacccacctcggcctcccaaagtgctgggattacaggtgtgagccaccacgcccagcccattcttttgggttattttctaatacaagaagatgttccaggctcagttttattgttttgcactttcccttcacagccacgaaagtaaccctttccaaggaatgctggttccttttactgaatcatagtgtttagaaacaaagatcagggcattggatatgcttgtgtctactggagtgtcactgctcccaggccttctccatggacagagccaggaactccttgtgtgtgtgtctgtggagatataaatggagatcaaaaagcaatttcagtccagcttctcccttttcatatttctaatttcagtgttaaacatggctcctgctaaggtcaataattatacttattttctcaatcctgttgtatgtgactgatctcgaccttaccaggccactatcccatttggctaccttccttgaatgggatcagactccgttaggagtcccttgtttctcaggtctgctaatggctttttgactgaattatcaaggaaggacagaaagatttttgtttcatatggagttgtagtaaacatgtttttcgagactaaattgatgttcctgattaagaaatttgcatttagtaaatgatttattacatttttataattcaggtttgaccttattgataccttaccttctgacgaccaagaaaaaatggaaagactgtaagatcagagtattcattggtggaaagataaacagaatagaccatgaccggagagcgtaagtttatttcacattgaagggcatgaatctattagcacttcattgctacagtataaatttgataggataaaaattagacaatccagaaaatgtctattatcttgctttgttctttactgaagttaaaaattttaaatataaccttgttctctttagtcttcatgtttaactagtaaatacttaattttacttagatataattttttttaacatactagcattttagaaggtccttcttaaatacttgtaacattaaagtgttaagcaacttctttcttttaatcagggagaaaatgcacaaacgttacatatttatatatgagataaattttgttgtagacttctagacaacaaaatgcaggatgccattgtcatccatccaattctttccatctatactgtcacgattctagttcttgtttcagtatttctctcctgctctctaagtactcttgttttgtctttgacctgtaacatgtatattgtacagagtacataatatgcataatcttcaacctaattaatatgtatattgtacacattatgggtcaaaggtaagacatgggtactcagaagcattgaaacccagttttatttttcagaaagcagagttttgaccatatgattcctctacccaaaatagttaaacgacttctctgctacctgccatagaaaatctaattgttataatgtagcagtcaaggcccttgacagtctgtcctctcattccctttctattcttctgtttcccccagtgtttcagtacacttttccctatgctctaaacatgcatgtgacttcaggcttttactcctttgcctcctctcatctctctcctgtaaatagctcttcacttgcctctccttttatctctttaaatactgcattctttaaaacccagctcagttcttcatagtgcctttcctattttccccccacttacccccccatctagttgttatgtttccttctggaatcacaatatacttttatacctaccactcatcacattatggctggtattatatttattgtcttatttaagttttgtgggccctgtttagcatgttttatagtagccacttaattgatagatcctggaattcaactgtttattcatttcaaatagtgaattatgcaagaaatactaataataaatttaatagtcaaacctatagcagatctg

SEQ ID NO: 117310 - DNA, 1074 bp, Homo sapiens
tttctacatcctgtcccagttccttctttccccaaaatgctatgaacttaatctgccatcaactatatcttcagtatggcccacaggtcatatttgggccctgagataagtgttcttggatggaagaataatccaaaaataattaaatatttgtctactagtttttactgaaatttatgtacttatcaatatagtttgactaaaattaacttaagaaacattagcttccatttaaattttattattaatgtctttgtccattactcagtgctaaggagagattcagagaaagtaaaatactcagtgattactcagaaagtaaagtactcagtgaatttaagtctactttgtgaatgaatggtgtgaattaattcaaatggatattgtttagcatatgatagactgactttttctataaatcatgctttttagatatatggattcagcccaatatagaatgaaaatacttgtatcttaattctatttatttttgttgtaggatggctactttgcttagcaagttccggatagacttttctgatatcatggttctaggagatatcaataccaaaccaaagaaagaaaagtaagttactctacaaatttctgatccctttatagatggcctactcagacacagattcaacttaattaaaacccagagatttttttcctgttgttagttacatgtgaagtcaatattttaaaaaatctagcattgatagttggcatgcatatatcagatattaaagaaagtctaaagagttttcaatattcagagaggatttaaattacagctttacatgtgatttctgaaaggtggttcatttccattgcccctgcctacagtcgttataaccactcagtccctgctctacatacctattactttccactgttttgttttattgctaaaataggaaaatctaaacatttgcctgcaatagttgcattcagaattcttctagcaaagactttggaatattccacctgaaaatggtatatacaggttgttataatgatatttgtatttattttacctgatataattttaattcttagattaatgttgaa

SEQ ID NO: 117311 - DNA, 1086 bp, Homo sapiens
acagtgagatcagctttagcagttaaaaatgcaatttattacaggttggagattccttatcccaaatgcttgggatcaaccaaaagtgtttcagatttcagatttttttttaaattttggaatattttcattatacctgctggtttagcattcctaatccaaaaatcagaaatttaaaatgttccactgagcatttccattagacatcgtattggtgcttagaaagttttagattttgaagcattttggatttcagattagggatgcacaatctgtattgtctatatgggttctaattttctcatcagtttgagagactagaaattgctgtttttgaaataaattgccaaactgattattatggttggggtatggagaggagcgtaataaatgagaggcactaactttgcaagttacaatttaatatttaagatcttcctgttatgtaacttaaaataagattagttgtcagtattctttctgttttttaaagtattatagcttttgaggaaatcattgagccatacagacttcatgaagatgataaagagcaagatattgcagataaaatgaaagaagatgaaccatggcgaataacagataatgagcttgaactttataagaccaaggtattctcttctgcttccttttcattaatcttttatataataaaagacatgaaaaccaagaactttaatttgatataggagggtcagttgtataaatgaactctactttaaaatagatttatttgaggttagtggaaagcatttttaaaaaaaataaaaatagagaacagatatttttattacacgaaaattcatttcagtttctttttgtctccttatagttttatgaaccatgctaaattcttatttccacatggtctaggaatgactgtcctgtttcatttcagacataccggcagatcaggttaaatgagttattaaaggaacattcaagcacagctaatattattgtcatgtaagtaatatctttataaagattttcttgctaatttatgataatatgctttgaattaatttctattccaagtacatatctatataacacccatattgactt

SEQ ID NO: 117312 - DNA, 2170 bp, Homo sapiens
cttttctgtatttagatatgcaaatgcttaccatcgtgttacagttgcctatagtattcactacagtaacgtactatacaggtttgtagcttaggagcaacaggctgtgtcatatagcctagatgtgtagtaggctataccatctaggtttgtgtaagtactcctgtgatgttttcacgagggcaaaattgcctgacagtaagttctgagaaatgcgtctccatcgctaagcaacacaactgtggttgttattctatttgcagaattctcctgcactcagaaatattctgtaattatagtaatttacagtaactgttattgtaatctactttataatttttgctacattttattctgtaaatgcattgctcagggttttttttttttctttttctctttttgataccaggagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctg

SEQ ID NO: 117313 - DNA, 1097 bp, Homo sapiens
acattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattcttatatctgtttaataagtctttgccagctttgtggttttatctcatttcgataactattgcttcattcatttctgaatttttaaaatagcttttaccttaatattcacgccctggaaaagtcgttcactattcttaaacctttgcaataatcactgttgatgctcacagtatgactgaaccatctgagatgcagctcattatggtatttttttaagtgacctagcttttctaattctgctttatctttgggccagatctctcatttgtgaatgaggaaactggaagattaaaagcgattcatagtccctgaatataatctgattctttccttccaaagatttttgtctaagctcatttagagttttag

SEQ ID NO: 117314 - DNA, 1034 bp, Homo sapiens
aggaaaaataataataactcttgtttctttcctccctgtcttagactttgaatgttgaccctcacagggagggataatttagactctggtatggccaaagatttgagcacaaaggcaaccgtggttactgtattttttatataacttcattttaaaatatattaaaagaaacctaaatgttcaagatatcagcatatggcactaaatgcacaaaaataatgtgagctttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatgattttaaagaaagccacacagagctgaatgggcagtgtaatcaataatttaaaaaacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatat

SEQ ID NO: 117315 - DNA, 1003 bp, Homo sapiens
gagtgcagtggcattatcttggctcactgcaacccccacctcctgggttcaagtgattctcctgcctcagcctcccaagtagctggtattacaggtgcccaccaccacgcctggctaatttttgtacttatagtagagacggtgtttcaccatgttggccaggctggtctcgaactcctgacctcaagtgatccactggcctcggcctcccaaagtgtgaaaaaatggtttttaattaacttacttcactgtaagattttcttcagactagtatcttttctaccaacttttcccagatgacattctaacatgaccacacacacacatacacagacatagatatgtgtacacataccctgcacagatataaattcattcctacattcagtgggtatgacagtgaacatttggcacctttctaggtgctagaaatacaggaacatcatctttgctttggggtaacttactacctaaggggagagacctattttgtaaataaacctgttttgtgaagacatccttataatacaatgtgacagacattgtactggaggtctgttcaggagatgggagcaccgcaggaggttagggatcattatggtagttgtgagagggtggcagttcaagaaagcctgtcacagaggattgatgattgtctaggtcactcttaaatgttggataggattttactgatcaaccaaagaaagagaacagaagaggctatttggaaacataggcagcatgagcacgacaaggagcatagaatggctggctcagaagattgaactcaggcctgcggtcagcgtggagccattgcaggagttgttgtgtttgttttttttgttgttggtggtggtggcggtggtgttggtttctgcagttttttgttgttttatagaagggatgtgatgactcttttgttaaacttctaccaacataaattgagaacttgtgtgtgccagataccgtgctaggagctaaaggtgcaacagcgagccagaca

SEQ ID NO: 117316 - DNA, 1084 bp, Homo sapiens
attaaaaaaaaaagatagtaatgatagaggcagtggtaagtagacagattccagatatgttttttttttttttttttttttttgagacagagtctcgctctgttgcccaggctggagtgcagtggcgtgatctcggctcactgcaagccctgcctcccaggttcatgccattctcctgcctcagccaccctagtagctgggactacaggtgcccgccaccatgctcagctaattttctgtatttttagtagagacgggttttcaccatgttagccaggatggtcgattccagatatgttttgaaggttgagtagacagcccttattactggattgaataaggaatcatagtaaggagtcaaaaatgatgtcaaagcttagggcctgtgcaactgaaaaaaaaagtgaatttccttttattgaaaatgcagaagactgggagagaagacggcagattttgtacatggaggaaagagcattgacagtttgattttagatgtgttaactttgaaataattattagatgtttaagagaagaaatgaaataggcaattggtagaagggtctagagttcacgggagagatgagatacagaaccataaatttgagagttctcagcaaaaaagtagtatttaaacccatagactcaatggagtgatctggatgataactgtagagataaagaaaagccttagattagttgatcccttaagtatcttctctaagtttgttgcaggctatcttttccaaaacctgcaaagttagctatgcaagttgaaactaaaccattggataaactcgtgatatagattaattatacaaaaaatgtattgtattcctattattggaggtccagtatgtcccaaatgagaaatttcttactatcttgtccattccatgagtataggaaaatatggtctatgtggatttctaaatataggaaagtctgccatgattggcttcctctgactcaatctcgaaaaagctgaaaagcaggagattgcttggtacttaaggattaaaaggaacctttcatgttaacgtacaaaatttgaatttcatcctttgagtgacttttccctaaa

SEQ ID NO: 117317 - DNA, 1023 bp, Homo sapiens
cttcaaatcatgtaggcaacacttcaccatctaatatagaccaggtgagcgtgccagtgtaagttcatatattaagtagtatttagcttcagttctggcatatgtgaaatctgtgtggtctaacatgatagtcactagccatatgtggctatgtaaattcagttaaaattaaataacattaaatattccttagttatactgtccatatttccagtactcagtagcacatgcagctgtgtattagaccgcatagatttgggagcagttgcatcattgtagaaagctttactcaacagtattgttgtagatggaaatagagaatccagcattttctttcaatcccccaggagaacattttacttcctcgtgaagtacacaaacccctttggagaccactgctctggtgaagcacctttctgatggctttagtgagtggacattgtgtaaagcattacttctgtgtatcttttatagatattaatgaatgctccctgagtgacaatctctgcagaaatggaaaatgtgtgaacatgattggaacctatcagtgctcttgcaatcctggatatcaggctacgccagaccgccagggctgtacaggtaaggggagaccaagcaggcctgaaactcatatgtctcaaatcagcctaggaaaacttttggcgctgaattataatgaaggctatgcaaatcctttgtcccaaaaatgaatgtaagactaggggcagatctcagttattgtgtgatcttgcagcagactcactcatcttaatgtagaaaatgctctaatccccatagttcttctatttctgagttaatcttagggtactgcacttaaacatggaatgctgcctaaaatgaaggtgaaagaactaagaaagataatgttcaatcaacacacatagtggggagaaaaattcaaagccacattagcattatctgtttaaaaagaagaaaactccttttaaggaagcagacctgacaatgtggttgcaatgctgttttcacagatattgatgaatg

SEQ ID NO: 117318 - DNA, 1041 bp, Homo sapiens
gagtgtagtggcacaatctcagctcactgcacccttgactcctgggctcaagcatcctcccacatcagcctcccaagtagctgggagtacatgcatgtgcccccatgcccagctaattttgttttattttttgtggaaatgaggtctcactatgttgctcaggctggtctcaaactcatgggctcaagcaatcctcctgcctcagcctcccaaagttctgggattacaggcatgagccatcgcacctggccaaatttttgtttttctttgtttccttccttaagacaaaattaactccatcaatgatgttctgccttcaattgcacaaacttaatctaagtaccagataaggatcatgctcaattcttataatttcaatgaattacaatgaaattctagggacagtagaggttaaaaaattgagactgaattcttatgtttctgagtaagaaacaaatttttgactctccaagaaggaggagtactgtagttttgctggttgaactcatgactgggatgtcatctcagggttagctgatttagatttaacacaggataggaaattgtcattatgcttcagtgtgtagaattatgttacagtatgtgactttatttcagcctttttaaagaaacttcaatatacatctaaagatgacttcgacctcaccagtttctgctttctggaaattagttcttattaattatttaattacaaatgttgtgaagattttaagtattcctgagtcggcagctctgtgtttgaagtctctttcatcttttggggaagtcatttaatgctgggttacgtttgataaattcaagtggattgaaaattagaagacatacctcaagttattttgttattatcaaatgaccaaatgaatatcagcatagcatctacttctagttaaagtgtctttgtgtgaaaaaaattacagaaatttaccttaatttttaaagaatttgttttacttaactaatttgaattatttagcgttaaatgggattgtcaaataaataatgaaaaagaagattgtgagg

SEQ ID NO: 117319 - DNA, 1132 bp, Homo sapiens
gagagagactgtttcaggatctctgggacatcagttgtgaacagcgtaagtttcactattttaccttttgtgggatttttggtaacggtacagattgactggaaaatattgtatatcattattatgaccttgtttttatgcagttgaattagaccctacttatcttgttttgacatgtttttattgtaaatgtcagtgttcctattagtactcattacttaactggtcttttgaaaatgtcttagtttgcccttttcctatacacaagttattattctaaacagtttatagtataactcatatataggtagagtttacttaagccaagtacttgtaatctatagatttgcatattgctaaatctgaatgaagaagtaggtcagagagtttttcaaacagtacagagaggagtccatctgtgatactttctttgaccaccctaccttcctacccccatcttatttattgggcaaaactaaggcagtctgtcctgtccttttacctgccatatatccattcctctagaatagctcttttcattgtgttgtgactgtgtatttgcttggctgtaggcctcttaagagcagagatacttttctaaaattgcctttgtgtttcttatactccacacagtgcagcataatggaagacgcatcatacatgtgactgcataaacatgggggattccaagtagaagaaataggatgaaaataagtatagagataataaaggtccttgaatgttcacagagattaatcatttcgtgtggttgtaatacacagttagtgaaaggaaagagtagatgatgaggctggaaaaatagacacagaccttaatttacaaagtctgaaatgctggagtcaagaggctgccctctataccctcaagtaggcactgagtagaggagctatgaatgacttgtatgcttgaaagcagttctccacaaacgtcattctggagtggcaaacaaaatagaatgaagggtggaatctcttagaactcactgcatgtctgctagattaaagttgtataatatttcactaggattatgatttatgtgtacaaaacttagatttttaatataaattggaaattatataatttggagggaagataacatttactgaacttt

SEQ ID NO: 117320 - DNA, 1049 bp, Homo sapiens
taaacaatgtttttaagaaaataagttccattgtaattttctgttttaaaatgtcatgcatgtttattataaagtaatttagaaataaaacaagatgaaagacgagaatctaattactcataattcctacacttaggattaattaccgttaatgtcttggagactataacgtacactgcacgttgtaataacacaaaaggacaagcaagatgtaagagtaagttatacgtgctttggggtgtttacttcaatttacctttttaactacaaattagaatatacaagagtgtaactaaactaatttttaaatttaaatatttaatatttattcatccaatatttgttgagtactcttacagtattaggctaagtacttggaacttgagttataagaaaaaccaatatatacttcttattaatgagaagcaaattattgaaaaactagtcatctactttacacatgaggatgcaataagacacagtaaataccgtaataggagtaggaacaaaaagtaagagagctcagaaatgctcactaatgcaggacaaattacaaaagtctttctttcagtcaaatgaatgtagaatgaaaaaacatagcttactacagtgggaaaaacagtatcagactaattcctgagatatatcatgattaaatcttatactaatgttatttaaactccataattcatgaccaattaccctaattactaagctgatatttattttgcagaaataaaatgtctccctttttcttgcactctgaagatttagtagaatgaaaattacaataagcagagagagaatgttaccaactgcagatgtcagactcacatgtaccctcaggcacacacacacacacacacacatttctgcacttgtgaggccgttaagaagagcattttataaccttgcactctctaagctaaacttagccttaaatgggcatcagagaaataccaaaagatctgtgggaacttaactttttggcactagctcagttgatacccttatcttgaatgccattaagaacagagggaaagaaaatt

SEQ ID NO: 117321 - DNA, 1035 bp, Homo sapiens
agtgaaaagcaaatttaaaggacctgtagtgggaacagactccatgtattttggaaaccgtaagatccatgtccctggagtaaagtggggaaagggaaaatggtaagaattgagtttggagagggaggtatagggccttgtagtaggccaaggaacaaaatttggactacagcctaaatattatgagaagtcactggagcattttgagcagtggtgttctgtgacctggttaacattaaaaaaaaatcacctgtctgctgtgttgagcctggattataacagagaaaaggaaagggccatgtaggaggctaccacagtggtgctagtgaacaatgctgcagctgtagtcgctgaagatgtggtaagtggttgtattgagcttgtattttggaggtatactctgatggaccaggcgtggtggataaaaaaaaatagaaaaagtaaaaatcaaaagtgacaaggagagggttttggtggagctgctggattaatagcgatgtcatttccagatacgggaaatactgtatagggagtgggttgggtaaggagtggtggggctgaggataagagttttgttttggattcattagattgagaaatctgtcagacttataagtgcaaagatctatgaactctgatcttaggagagaggttggacatagagatataaatttgggaccgtatagaccgaattattatatagataatattttaatcataggcttagataaagatcattaggaagttgttgtagctaaagaagagagttgaaaacagagacccaattcagcccaacattgtgagatggggaagaggaaaagaagcctgcaaagaagagtgagaaagaatggacatgaggatggaatgaaaactgagagagtgtggtatcctagaaaacgaaggaagaaggcagcaccaatagcaaagatttataccttcctatgtcagacagtaggcttttgtttctttcctcttgttaacattttaacttggtttagaatgctatttttctaacacatttgtgtagaaattaca

SEQ ID NO: 117322 - DNA, 1051 bp, Homo sapiens
gtgatcacattgcactgataatcgggacgcggccccatttgaatagtggggaagactcaaccggtttgagtcagttcagacttcacttctagactctgttgaagggcaataatgataaagatttcaaagataattgaaagttttatctttctatgtctattaatacaaattggaagaggggaggagtagagcaattatctagataactcaaaaccactttttctgtaaaaaatccagatgagaccacatgttattatgcaaattatcaggcttttaactctgcttgaggtttgggccttatgaagatcaagatttcttaggcatttatataaaaccactttcttatttctggttttatatcaacaaccacataacctagatacgaaaggagcattctcgcggatttagtgttgacctaagttaacaaacttttaaaagacagaactcttacaaaggggcttgagtttttttttttttttgctttttggaagacgtttaaatttagggtttccagaccctgaacctcaatagtgtgcagtagatttccaaagtatgaatcttagaccttgaaaaattctgtatctctgaccttaaaagttttgattattttattctgtttccaaagtgtataaccagttctccaagttctaattggagagctcattagttatcagcctcacagtcacggactctgggatgtcttatttcatatgcctgtaaatttgtgacttgcagtgtgactggccttctcctgtgtgtttatgtagcacaaccacatttgtcttgttggaaggagagccaggtatcatagacagcacattcatttagagccagtcttgactttagattgacctccatgttctccagggagaaaataattatgcaactgtgaacagagaaaaagggcaaggcacactaaccaagggataataaggatgtagtggcatttctaactctgtatttattggttttgtggttttgagatagatgcttaatgttatttctgggcagtttttaaaaaagagatgaaatctccagtgtcataaagact

SEQ ID NO: 117323 - DNA, 1002 bp, Homo sapiens
gttcgccccccttctccccaatctccgtcctcttccctcccttcgccctcccccccttccttcctcttcccctcacccaaccctggttcccctcgttcctcagtcccgatctctcccttactctgtccccgcccactctgcgccggcctctcagtccgggttgagccccacgtgtggacggccgcgcccccactgacagccgccgcccgccggcccgccccgcgccccgccgggcctctaaaacccccgcgccgcgccctccaccgccgcatcttctccagcgcccagcctcccgccctctctcttgctggccgcacgccccggccccgcgcacctccgcccggctccgcagccgctacccgcgcttcgttgccctgtgggactccgagcgagcccggagggaaccctcctcttcttctgggggcgacttttgtttgcttgcctgtttctttctggtgacttttgcagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcc

SEQ ID NO: 117324 - DNA, 1718 bp, Homo sapiens
gtgaaaccccatctctattagcagtaccaaaattagccgggtgcagtggtgcacgcctgtaatcccggctacttgggaggctgaggcacaagaatcgcttgaaccagaaggtggaggttgcaatgagtcgagatcacgccactgcactccagcctgggcgacagagtgagactctgtctcaaaaaaatatgttttgtagagacaaggtctcactgtgttgcctaggctgctcttgcaatcctgggcttaagtgatcctcccaccttggcctccgaagtgctgggattaccagcatgagccaccatgcccagctggattccctaacattaacatttgatattcctgcagtacatttgtcacaaccaaagaaccaacattggtacgttactattaactaaaccacactttattcatatttcactagcttttccctaatgtcctttttctgttccaaaatccaaactaggataccaattacattttgttgtcttgtctcctttggctcctctagtctatagcagtttctcaactttgtttttaatgaccttgacagttttgaggagcactggtcagatattttggtagaatgtccctcaattttgattcatttgatgtttttctcattgttggatcggggttgtgaaatttcaagaggaaggtcacaagggtcattctcattacatcatatcaaaggtacatgttattaacatgatgtcattaatgacattaatcttgatcacctggctgagacacagtcgtcaggtctctccattgtaaagttactcttccccctctatactctcctcataagaagcagagtactaagtgcagccacattcaagaggatgttgggagttaaacaccttacatagatactctccacatcatattcaacagcatgtggagaatgtctatgaaaggtagggtattttttattcagtaaattgtaacctgtactctgctttaaaaacatgccttgccactgtattctctatggtttctttgtttactgagtttgtggatggtaagttcctatactagagagatttcccagggcagtgaggattttagggctgtatttttgacctcctcaatgtgtgtctaatatgacacatctgatgcagtcccctgtccagaacccatagctaaaatgaagggcaggaaacaccagctagcaagaactggagaccacaactctggatattaggattcctgggtaggtaaggatttattcttttaaacacctcaacttaaaaatatcttgaccattttataatgtagtccttctgaaatatataatttaacagttttcttaatgagtgtgctggaatgatgttttcctaatttataagttagaacagctttttactcttccactggaggtctagactgtagcattatttgagttttgatctgtttttattgtattttgaatcttttctctgtcagccatcatttcttgctgctatcagtttgcctgcctccagcagtttcctttctgatttgctgtttatagccttctgttaatttagaatccagacaatgaaacttgttaggaatgtatacagaggtagtcaatacagtataaaataggatctgagagctggaattctaagcaagtgtaagctctaagcatgttagtgaatggcctccaccacatttacgcaactgcccaggaattttatttttcaaatttttttttgtttttgctggttctc

SEQ ID NO: 117325 - DNA, 1019 bp, Homo sapiens
tatgctcaatcacaattatctttgagtggtccttcaatgctaattttaatgaggtgtcatttgataattctccaaaacgctcttgtcatgtgaagataaagttgacgtggcatcattgaaatgtactttcattggttgtaatacatgattcagtcattgttgcagcctgttttcactctatagtatctgttaatgaattgacacaagttagtacttacaaagatggaatctgtataatacatttgcggatgatatgaactgggtatttttttcccgtgtcataagttatttttcacttggcctacctttactacagagtgcctcataatgactcagttttcccactaagttctcagtctgcaagactgaagactcattcttcatgttggacacttagggtgaatgaagaaaaaaactcaaagtcgcaccaaaactgagtgctagtaaatcagctatgtgaaggtcatccagatcacatggagcaaaatctttaacaaattcttgtaaaactctaagaatatgtttaaggttcttagtatcagaaacattggcctaattcagttcctgattttacaaatgaataaaccaaagccagagatactgttttatgctccagattatctagctaattagaagcaaaactagatgtagaacaaggtccttagatgatctgtagtgctctgtctgctttatcatgttgttgtacatttgtaaactacttttagtttattatgttattacatatgattcttgtactttcctactagactcatgtgtgcatccaacaaactgccctggagctagttggccgaggagtcgaggttcacattgttgctgatgccacctcatcaagaagcatgatggacaggatgtttgccctcgaggtaattgtcctgcttgggaatagatcatttgtcaagttttccaaataaatgagaagaatactggatatttaacagtaatgaaaggtttacctcctaaatttgagttggtctggcaatatcagactaattgatttc

SEQ ID NO: 117326 - DNA, 1099 bp, Homo sapiens
tgaaatccatccccatcactgaacttgatggtatggctgggaaccacggtttcagtagaggacactaattattgcatcccagcatagtgttactcttctgaaatagtgttcattctcatgcttatttcttgatttgcctttatctttttgttcaagcgtctcgctcgaaccgggatcatagtgaccacgagtgaggctgttctgcttcagctggtagctgataaggaccatccaaaattcaaggaaattcagaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgg

SEQ ID NO: 117327 - DNA, 1879 bp, Homo sapiens
tttatttaaggtaataaaatcttgacatttataatctttcaactcatgggagttttcaaagaaggaaaatcctttgtacgtaggggcagatggattttactaaagggtgaaaggccttcttcattaagagcagattttttttatttttcctattggcagtggtaacaaatagcaacctggtgtgtttaaatacttttttccaaccatttgtgtgtcaaaaaagaagaatcaaagatttctgcacctttaaaaagtttttattaaatttaacctagtgcttctcaaactttaatatgaatgcaaattatttgaggatcttgttaaaatgctgatgctgactcagtaggtctgttgtgcagcctgaggtgacattttgcatttccaaggtgacatttcgcatttccaaaaattgggcattttccaccagtgctgttcagaaaggaccatatttgaaatagcgagaatttaactccagacaactgttttcctccactgcacccaaacctttcagggctcagtgaaataccagtacagtgaagccttttcacaggtgaaactaattctgtgacgtcagcttcgtttcccctgccttccataacaaactattataccacaaacagtgtcgtaaaacaacggcacaagtgtattctcgcagttctgtaggttagaattctgaaatgagtcttagtgggctaagatcaaggtatcagcagggccgtgttcttttccggaggctgtacggaagaaactgtttccttgctgctctgtgcttctagcattcacccatgttttttttttgttttttttttttttggttttttttttggcttttttgaccccatttctacctcttctaagccaatgaaggtgtatctgttttttcttatgtcacatctgtctgactcactcttctgtctttctcattctgacttaagagctcatgtgctttaaggtcatctgatcagaaccttattccatctgcaacctaagttttcttttgctgtgtaacaacatattcacaggttccagggtttacaacattaacatctctggtggccactctgtataacacagacaccgccatgtgatttagtattttatttcattttgtcatttgtcatatttccatctttcctgctatattataagctctctggaagcagagaccgtgaattatatatagtcattctggaaacattttgaaaacccactaagttctaaacattgtgctttgtgcttaggataaaaagatgcccctaggaaacttatgctatggcacaaaatcagatacaattctcagtaaatgtgaattgaattaaattatatcagaggtccaggaatgtcaatataatactaaagttcagaataactgtgaattctgccttctctctttttttgtacatcatgccaagcaggtcactgacaaggctttattattacaagaaaaccaaattgattataatacattatgccttaaaattggaagcatctgtaactttgtaggataatgaaattctttcaactgatgtaaatagagaacttgactacataagcaaaagagtagtcattgtgttgaattgcaagggtatgggagcaggagcaagaggattcacttattgaaatgctaaaacatctgtagaaacttattctaaaattaaaagtgataacttattccaatcaggaaacaaaatatcctgttacatccgttaaagtaatacatttctcaacgtggaatatattccctctctaaaagttgatgtttgtgtaaatatgactttagaactgggtggaactataaagatcatgatctcaaaggtccatttcagctcccaaattctaaaatggttttattttacagacacagttagtgaggcccaga

SEQ ID NO: 117328 - DNA, 1034 bp, Homo sapiens
gatatactactacatgaaagtggacataggcacagccaaaatctgtaagatgctcttcatatggattacattatgggtagctcttgctgcagttgtgcatggttgtggccatgaagaaaggtggccatattgctaggcttttaggtttgtgtcatttttacactaaggcaaataacaataatttcataatatacaactaattacatagatctttgcatgcctgtgtgagcatgcctgcaagagatattcctgaaaatgatgtctttgaatggggggtggggagacacagggcttgcgttattaaaagttttatatattctgccaaatcaacttctaaaaatgctagaccaagttacactctcactaactgtagttaagagtgcctttttcctcatatctttatccatagtgaatattaacacagttattaaatttaaacatacttcgtgaatttttaatgtttatttccacaatttacattttttcttttgtgcattacatcctcatcatcctttttatatgtttctgttaatcttttagtctttaaatgctgtacccagatctcgaattataaaactattagattacacaataaaagcacagatataaatataggtaacacccagatttcatgaatgttaacattttattttattatttttgcttaagacctttattttaaattctgcacatcatgttgaagccctcagggtacttctctccaaccaattttttatctgggtccccagatgtaacaacgattccaaatttgcctatatatttccattcatatttttataattttgttaggcatatatgcagccataaaaatgtacatagcattgttttgtttttaaaatttgcacaaatttagttgtactttacaaatccttttagaatgccttttaaaattcaaatcatatttttaaggtttgttcaggtggatgcgtgtagttttagcctacggtttaaactgcagtgtttatataatttttgaatattttattcattaccttattgatggaggttcattt

SEQ ID NO: 117329 - DNA, 1067 bp, Homo sapiens
aaaaaaagaaaatataaacacaaaactccaaagtgtaattagaagttacctcttgggagggaagtagaattgatggattgatggctgggagtacatcaatgagagggatgggtgaatataacttttctgcagccatttctggattgtttgacataagcatgcagtgatttattacttctatgatttctttaattagaaaagaaaaaatgtacaaattgtttaaatccaaactatttttgaaaaaaaactagaaatattttatcactatatattatcaataagaaaatgattccttagagggaatttctgtgaaatatcagttaattgtttacagactgtgccaaatatttcctataagcttaaacaaagcatcagaatttgggtctgttttattttttaaatatatacacaaaagtataagaacctgtgtatatcaagcaagtctcctgatattgtgctaatttattgcttgaatcataaaactttgcaccagcaatcatttttatcatccctgaaacacaaaagcagtaatattaagagataaccaaacatactgcgatgagccctcaaacatcacatagcttgtttgtctttagttttttagcaatataaaaatatctttatttttatatctggcaccttcaatatttttctgctatgattttttcccttgtatatataaacataatttgcaatcttgaaatctttaaagtaaacttattttggcagttaaaactgtaattactaaacaaaagtaaaaagttttattttcctataattgtgttaatgataactctcttagaggttctgtaatgctttgtatattgaaataactaatgaacctctcagttttccaggccatgtgggcttcttcaaatattcatctgtttcagctcttttagaagccatcgtgaaaatagcttccaacactctgccattgtgtgcagtagtgctaaaatatttgaatgcttgcaacctcacaccaaacactgcaagctcaatacattgctaaccaagagacaaagcttgggattttgtaactgataacactctagtgatattaatca

SEQ ID NO: 117330 - DNA, 1043 bp, Homo sapiens
tcctgacctcgtgatccgcccgcctcggcctcccaaagtgctgggattacaggcgtgagccaccgcgcccggcctccttttccaatttttaaactgcatctttgtacaaaatccaaatttatttaatgagaatcttagaatattgatattctctgagttgttgatctttattttgtttttcaagtttagattaaaaactttttgaatctaaaagaggttgaatttaaatgttgacattattagagaaaatctacagagactaattattttatggcctataaaagtaaagcactaacagggcccacacaaaactatatggtatagttttaattctcttttctaaaaacagcaataaaaacatattatcaagtaaattctaaaaacagatgaataaatatcagaatgaacagaattttgcttagatttctgaaattattaacataatgatacttataactctattattattacagttagcccttattaaatccttagtaagggctatacattgtgtttagtctttcattcaattcctaaaaaaaactgttaggtaactatgattatcattcacattttagaaatgagcaagctgagaatcagagcatttctgtaatttcctcaaaatcctttgtaaattgtgttgccattaagtgtagaagttcatttagggctaggaggatcaacttactcaacctcatcgttatacaatcactaatctaaatgcttgtaatcttacttattattctcaatatgattttgttactcttaccatgtttgctacgaccatcatctatttgattttcaggaatgaggagaaattttaataacctgtcccccaaattctagcaaccattcctgggtgaccatcagcaatctctctcattgcttttgttttcagtgaatgaaaaaataaaataaaaataaaaaagagaatgactacacttctttctcttattccagttatctttaccagttaatagataccaagtaaagtataaaataattggcatgaaataacagaatttcagcatctaattgcccac

SEQ ID NO: 117331 - DNA, 1032 bp, Homo sapiens
atctaagaaagcaaggtagcaaggccaagattttccacttaaggaaggggtattgggagggatggttgctgaggagtaattaagatcactttttatttaaaatcatttcataacctctaggtcacctcttcaaaaactttgttatttggtggaacatagctgtttgctcctgaattctccaaaacggtgtgttagaatttgcccacagtaacataaaccaaactgggactgccatgacccagatcccagcagagccaggccagtgtagtgtttctgattcctctggctaaattctcacttcctagcccagagttccagaagcaaactgcccaatccctgatctctcaccaccaactttgtgacccaggtcccagttactgtaccacagatgctttggtttcctctgacaccccccaatgagtattaggtaacaaagcaggcaagaaattcacaagtagaggacaaaacagcaatgctgagcagctgtaagtggaataggaagaaagaagcccatgccttggttactggaagttggggtaaagacaggtgagtggaacctgagtataattttggaccagcctagcaacgaggctacttggcatggctgccaacacagggctccaatctacctgctttcacataaaaattaaggcttagcttgattaggactcagccctggtgtccaaaatcctgaaaacttttagggatggggtgacagaaagagtgaggctggattgattcctctgaatattgggacaggaatatttactttgtcctgacactcaggaatttgttgaagcccggtgagttaggaaagagttgtaagttcttaggtagtcagagcattgatcttcccctcacaagagcttctgtaatggcttcatggtgaattaacacaccctacaattcagataggcagataatgtgtcattttatagcagtttataactgatataaccgtcttcatggccatctaccacaaagagtaggtatgggggagggaagagggagaggaacaaagttgctaattaa

SEQ ID NO: 117332 - DNA, 1027 bp, Homo sapiens
aagtgggaaaaatctatacagatgagtgtatagtccttgagttttgtttcttaggttttgttttccctacaggaaggaaaaaaaagaggttatagttgcttacagatgttaggaaacccagttatagggaatctagtcaatggtaagggatttttgagaatacatttcttctccagaaattacataaggaagaagggaccataacctagagtttgattctgatcatgctatacttttactttttcagaggtcagtttcccagcttgcctcacagttagtattgggaagataaatataaagcaagaataataatacatgacaatataatgggaaagaaatttcataaatgtttgaagggtgagtttcatcagctatttaaaactaatgtgtttaaagtacagaggaaaagagcccaaccaaggttcggtgagagctaatcattgggcctaaatgtcttcagatttacagtttttcagtaaaatgtgcgtaagaagtaaataaagaatactgaagtctaaaaccatcatcacagggttttaaagacagttctgagtacagtgctgaagaaattaacacccagggcttacatgtaacaccctccacccttttctgttttttttggtctcatgtattaataaagtgtacagagaggaaaaatgagtaagacggtttagcctcagataggaggaaatgcttgttctctaaatacacagcattatagcacatattatttaaacataacacagtaagaccattccccgcccccccaatagctcttcaaagggaaatacaagctttttggcatgaactacttatcacattttcctaatactaggtattggtagcaactcttaaagtttttaaacagtttattccacttaaaatatgcaatcaatgtagacacttcttctgggtagtacttatatctcctatttaataatcagatgttgtcctcatccttccctatgattgatggtcaaaaaaaaaaaaaaaaagcctgtcttgcttttttaagggctttctcctt

SEQ ID NO: 117333 - DNA, 1052 bp, Homo sapiens
tcataaaataatataatagagaataaatggccaggcgtggtggctcacacctgtaatcccagcactttgggaggctgaggcaggtggatcacctgaggtcaggggttcgagaccagcctggctaacatggtaaaaccccatctctactaaaaatacagaattagttgggtgtggtggcatgtgcctgtaatcccagctacttggggggctgaagcaggggaatcacttgaaccctgaggtggaagttgcagtgtgccaagattgcaccattgtactccagcctggactaaaagagtgaaacttcgtctcaaaaagaaaaaagaggaaatatttagattgattggttaaaagtataaggaacatattaattttctattttcagctatcagttttctgtggctgtcatattaccacaaactgggtgccttaaaacagcagaaatatgttctcttattcttctggaggccagacgtctgaaagcaaggtgtcagcagggctgtactacctctgtggctccaggggagaattcattctttgcgttttcatcattctggctgttgccagattccttgacttgtgtccacctccctttgctttatcttcaagtggccttcttctctgtgtgttttttatgagacacttgtctttgaatttagggactatgaaggttgattttttgtatgggtcaacttgtctatggtgttcagttgttgggtcagacacttgtctagatgtgttttgtgaaggtaccttaaagatgtgattaatatttatgagaaagcagattatcttctgtaaaatgtggatgggcctcatgcaatcagctgaggcctaaagagcaacagctgaggtttcttggagaaaaaagaattttgtctcaagactgtaacataaaaatcctgtctgagttttcagtctgctaccctgacctataaatgtcagacttaggactgcaacatcaacttttacctgaatttcaagcctgccagcctgccgtgtggatttcagaccagcacttagagttgtgggaactaattccttaaaaccagtct

SEQ ID NO: 117334 - DNA, 1037 bp, Homo sapiens
taatgggtactctagaagcctaatctctatcagtacgcaatatacgcatgtaacaagcaagcacatgtaccccctgaatataaaatatgataattttttttgactgaacttgttttcgtactttaagttctaaggtacatgtgcatacctatgtaataatttttttaaatgcagtgaaattaaagtaatttcagaggaaattcatgtttctataaacaagagacctaatttttcaacattaggtccagaggctaatacaaactatatttgttctattaatttgcatatttgccagagtttatgaagtttttttttagtaaataacttattcaagctatttatatatcagactgaaataaatatcgagcatattttaagttatatattaactcacaattttttaaagcatgttcaaaaaaatatagattttttttacacatgggattcagtgcccaaatgaaaaacagacttccatttaaaaggaaatttgcatttggtggataataaatagctcctggattttgttgagtgtggcttcttttagcattcttttctttcttgcattttaatatctgttaagattcagcagtagaatttggtcttctatattaaatggctatgtctattttttgatttttaaatttattttcttaccattttaaaactgaagataaactttacagttttttattgtatgcatgtaatctaagcaataattttgtgaatatatgtctactcgcctgaatctcaatcaggtatttgattttgggggtggggagagtagctgaaaatgaagaaaaaaataaaggactctcagcataaacaaataagccttttgtcttcaacttttggagcccaactttcatttatagttctacactgattgtcataaaggttcacaaaattggatgcatttcagtagtgaaactgtcactgtactagaatgttcttcatctgatttttcgttgttgtgacatctcagatatatatttgtgtcatagttttatatctctcttcttgctttttccctaaatttc

SEQ ID NO: 117335 - DNA, 1032 bp, Homo sapiens
ctcagaacaaagtggcatggaatttagcataacttcatcataggccctgtttcattctggaaatagtttggagttatgctgtcatattatgcacattcctatgcagtggctactaactagatattgtaaaattacatttacatttatagcaacttgacttgggttgtaattttgtcagagttcactgaagtagcccatcctcaatcattacttttcagatgtattagtgccattgtcatgagtattgaattatctccaggttattttataagaagatcctatgtaaagcaagattttaaaaatatatatggacataaaattattcttgaaaaagtgataggcagcaattcagatactctgttctcaaagttccaataattgatcaatatggatagttataattgagtcaaaactatttttctccagtattcccccagagaactaggttgctgttctttttttaaaaaaattctgataaacagggttttggtttttgtttcagatatttttcactgtgaatatgtgaaaatattttactctaatatcttacttaacctccccaagcacacaagttcaagtggatttggatatgagaataagagtctcagacttctttcagaaaatcattgccaattatgttattttactgtaccacgtgatacatttgtaatataaattctgtgataattttatttcattagcatgaacaggcaatgcttagctctgcagtgaggtaagtggacgtatgacagtcatgcgcttacacttttttgttaattcatataattttgctgcttttggatggtgtaaaagaccaatcttgtcactaaatccattaatttgtgttatgggcatatcactcccagcagtacaggagaagaaaacacactcatgggcaaaccagttatgtaaaacacctacttttgtgtgctaggcattggggatacagcagagaataaaatagatcaagtctttgccttttaaaccagcttttattctactgtagggatacagacaataaacccataaaga

SEQ ID NO: 117336 - DNA, 1036 bp, Homo sapiens
aaagcaagctctatcctctccaccctgccccacaatcactcaaatcagttggctgcttaattcttctctcttctagcttattacctcttttcagagcagaatagctaaggggttatatttgcttcagtgtctaacactctttttcatatggctgatagaatccttcagtatgttacaacgaaaaacatttttattatcaaaataatttatcaaccaactgtaagcataacacatctgacaattttataattgcttataatttacaaagcactttcatatatatttttaattgtggtgctaccaatggtcttgtaaggtaggtggggcaggaattaatattcttgcctaactctataatttatacactctagttgatggcaatttaatcagtttatgatgcaaaactttttacatcatgaaaatacacatatataaatacttaaatgttagtgttatgtttgaagttatctaaacatcaagctcatattggcatttccatgcataattccagagagccctttcaaaaaattatcctcctgcgttagtgttttatatttttatattattgtatatatcacatattataaattgtatagggccatccagagtctgtgcaaagtacttaatacaaataaataacttctcctttggctaacttaagtggcaatttgccatttacctaagattgaggttttattctttcagaaataattgtaatcaagatttcatgaaatggtagaaaaatgcaaaactgacaatcatttggattgtaatgctttgtcaaaaagttatattatcataaaagcacaatcccatatatgcggttatgattagttattggaaggttttatcaaagatgaggttgaatttattggttttgattttaaaatgtgataaagtttttacagcatttaaaaaaatgactgcattcacacttaggcttttcattagaacattcacatgctatattatcaacttcaaagcagatgcacaaatggaaacaatagttaagcattttatccacaagtattttata

SEQ ID NO: 117337 - DNA, 1037 bp, Homo sapiens
gtggtgtgaggaggagcaattagatacctgtatttggaccagcagggtctgggagccctacgggtggtgctggagcacaaggaattggtgggagtgggaaagtgatggtcttaaattgacacaaggatgcagaggagcccagaagatgtgttggatgttactaatctctacactaaggaaccatgggatcatggaacactgttgatagaagaaatgttggaactagagattccagaccatttagtttatagccagtgaaaatgaagcccaaagaagttccatttgagatctcatggtcaggttgtggcagagctgaaaataaaaaccagtcttctgattcccagtcaatggctttctctctgagctctttgcagcttcattagagacattctgtcaatagttacaccatgtctactttctgggtggctgtttttgtttccctggtttttttgttcataaacaagcttagagcataataaacaaattttttttatttttccttcatattttcagtgtgactacaaaagtttgtaaagatgttaatttttctaaaatttctaaattttctaaaatttcaccaccaaaagtttcttcaaaactacagatgtccagctacttatctggtatcaaacacatcataaatctgttaaatattgatgcttccagatcatttttcttgatgctcagaataacactgctgcatttccattaaattctcagcattaatgttttgctttggatgtttgtctcctccatatctcatgttgaaatgtgattctcaatgttggaggtagggcctggtgggaggggattggaccatggaggcagattccgtgaatggcttagcaccatcccttcggttagtgagttagcactctgagttcctgtgagatctggttgtttaaaagaacatgccactccccctgcccctcttgctccctgtttttcaggtgacatgcctgctccctcttcactttccgcaagcactggtaagcttcctgagactctcactaggagcagctgccagcaccacacat

SEQ ID NO: 117338 - DNA, 1043 bp, Homo sapiens
ttgcctctgcagttgtttatatttcacaatgaggattatgtcattaccctacaggtagccccatccaaatacaatcttattactaaaagattctagaatttaatggctatcccacaatagactgcttttcagacatcagtaggattttccaaatatcaaggatataatttgctgcattgaagttgaatgaactgcaaattttatttacaggtttttcatatacagatatttcttgcctgatcagagactgatgtagagcttctgaagctgcccaaaatatatcccatttgatgtttcctaaagttcttttaagagaacctgagctcttcctgttctctatcatggcggatcaaggtgaaaaggagaaccccatgcagaaacttcacatctgcaagctctgcctcaacatctgtgtggaggagagtggagacagactaacccgagcagccaaggcattggagcagctcacagggcagagtcctgtgttttccagagctagatacaatcagatcctctggcatgcagagaaatgaaaagattgctgtccactgcacagttcaaggatccaaggcagaagaaatcctggagaaggatctaaaggtgcagaagtatgagttaagaaaaaataacttctcagatactagaaactttggttttgggatccaggaacacatcgatttgggtatcatatatgacccaagcattggtatctacggcctggacttctctgtggtgctgggtaggccaggtttcagcatcacagacaagaagcacaggacaggctgcactggggccaaacacagactcagcaaagaggagatgatgcgttgcttccagcataagtatgatgggatcatccttcctgacaaataaacccgtttccatcaaaaaggccaataaaaagtttttggtggaaaaaaaagagaaccagaaagctcagccttccttagactttatttgctgggcacagaaaatcatgcgcagccttgccaaccttctaaggaatcagagaaagcctcatcccactgactcatgacatttag

SEQ ID NO: 117339 - DNA, 1063 bp, Homo sapiens
gaacctagggagcactcccctttgcccatcctctcatcacccccaggtaaggaactgaaggttctagtagggaagtcgaggctgaactgtggttacatagtctgagtcaatacagcagatgcaagaccatgatagtggactcaggcctcaaaccggaaaccaggtctacattggcagattatttctaaatgtcatgagtcagtgggatgaggctttctctgattccttagaaggttggcaaggctgcgcatgattttctgtgcccagcaaataaagtctaaggaaggctgagctttctggttctcttttttttccaccaaaaactttttattggcctttttgatggaaacgggtttatttgtcaggaaggatgatcccatcatacttatgctggaagcaacgcatcatctcctctttgctgagtctgtgtttggccccagtgcagcctgtcctgtgcttcttgtctgtgatgctgaaacctggcctacccagcaccacagagaagtccaggccgtagataccaatgcttgggtcatatatgatacccaaatcgatgtgttcctggatcccaaaaccaaagtttctagtatctgagaagttattttttcttaactcatacttctgcacctttagatccttctccaggatttcttctgccttggatccttgaactgtgcagtggacagcaatcttttcatttctctgcatgccagaggatctgattgtatctagctctggaaaacacaggactctgccctgtgagctgctccaatgccttggctgctcgggttagtctgtctccactctcctccacacagatgttgaggcagagcttgcagatgtgaagtttctgcatggggttctccttttcaccttgatccgccatgatagagaacaggaagagctcaggttctcttaaaagaactttaggaaacatcaaatgggatatattttgggcagcttcagaagctctacatcagtctctgatcaggcaagaaatatctgtatatgaaaaacctgtaaataaaatttgcagttcattcaacttcaatgcagcaaatta

SEQ ID NO: 117340 - DNA, 1033 bp, Homo sapiens
ggtttttgtttgtttgtttgttttgagacagagtttcgctcttgttgcccacactggagtgcaatggtgcgatattggctcactgcaacctccgcctcccaggttcaagtgattctcttgcctcaacctcctgagtagctgggattacaggcatgtgccaccatgcccagctaattttgtatttttagtagagatggggtttctccatgttggtcaggctggtctcgaactcctgatctcaggtgatccacctgcctcggcctcccaaaatgctgggattacaggtgtgagccaccatgcctggcctctggttctatttttgtttgtgaagttatctgcatagcttctctttattcctgcctattttcccagtttatctgtgagccattcattagtttcaagaaattagccgatggagaaattcttagcagaagcgattgcaggcaatagggaaagggtaggtggagagcttggggttggttaattggcctggtttgggatggaggcaaggagaacccagctaacattaaggaattggattttcacagcccttggcaaatagtaacaaaatatgttttttttttttttttttttttttttttgcgacaaggtctccctctgtcacccaggctggagtgcagtggggattatagctcactgcagccttgaactcccaggctcaagtgacccttccaactcagcctcccaagtagttgggatgataggcccatgccatcacacttggctcaaaatagctaattaaatcatttatttgatcacctgcagtgacatgccaattgaaggcaaggctttgggtttccaaatcctattgccataggatcacataaagggtaggcatggaatttgagggttgtgcaggtgttgtgactgcttctaatattgctgaacatcttaaaaagtaataacaaggctgggtgccgtgtctcacacctgtaatcccagcactttgggaggccgaggtgggtggatcacttgaggtcaggagttcgagacagcctggccaatatagcga

SEQ ID NO: 117341 - DNA, 1094 bp, Homo sapiens
cagattgcccaagcgcaggagttcgagaccagcctggacaacattggagaagccccatctcaacaaaaaaatacaaaaattagccgggtgtggtggcatgtgcttgtagtcccagctccttgggtgggtgaggcaggaggatcacttcaacctgggaggtcgaggctgcagtgagctgagatcgtgccactgcactccagtctgagtgacagagcaagaccccatctcttaaaaaaaaaagtttaattgaacagcagattttatttctaatttgtttcttgaaattagtaatgataaatacctaatcttaatgagtctccagttgtagattatgctctgttgggattaagagtttccaaatatttgctcaaagggttgtgtttcaatgagagttttaagatttgatatttcagcttgacagtttgttatttaatggcaagaagtaataaattgcctgtgcctaagaaactttttttccttttccagcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttctaagaacataggaaattgaccattt

SEQ ID NO: 117342 - DNA, 1057 bp, Homo sapiens
aatgtcggttagattcaaaacgttatcaaaaatttaattaggttcctctaggtaaattaaaaaaaaaaatactttgtctctactcaggggaaattctttggttttagaaaaaatatttctttttaaagttcgcagttgcctttgagaaatggttcttgaaaaatttacatttgaaccaccgaagtccaactgtagaacggcaggaagcattctaaatgaatcagcattttgtagggagtacccagtagaattactcctgagacaaataagtgtggatgggttttattaaaacagctttcacttcagcagtgagcaagagattcgaaaatattcatgtcatatgtgtatttacagacactgttttaaataattagtctaaatgctaaagaatatcatatatatactcttcagctttacacaaaaggataggtatatttcttaaatagttgagtaaagtgagaatagatattaatcaagtatcagacaaatatgtagttacaaaactgattgctatcataaagaaaaaaaaaaaaccaggaaattgcacaactaggactctgacctgggagtaatgggacggggagggcaatcagaggtttttttctgttttttcttttttctcccagaaatcatgtatgtgctgggaatggaatggcggaatgactagcagtttaaattagacggaagttggggtttggagggggagaggatcattgaaaaagctctgagggcagagagctcagaaggccagttccatgtgaagacctgcaggagatctggagaggcaggcaaggattagcatggccaatttttatgcattcattggctcccagtttaaatgtcactgcctcagagttgttcttaaacacttaatctaaatcaggcttttcctgtaatgatcattcatatttttcctttgtaacatgtatgacctttggtgattatacttttaaagttggtcttcccataagacttccatggagtccgggtgcagtagctcacgcctgtaatcccagcactctgggaggccgaggcaggtggatcacctgaggtcagg

SEQ ID NO: 117343 - DNA, 1012 bp, Homo sapiens
aagtgatcttaatgtgtagtcaagattgagaaccactggtagagagagaaaaaaactctgttgaagagaggacttaaaatctgctgcagcagcaagaccttaaataatctaagtgctaagttgcagccagcaccacttaaattatcaaatcttgtcagttacagtatccaactttccctacaagcatccataggcagacgaagggtttataccagtaactgcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccgggtaggtactgggcaccacctctctcgcctgctgaggtgggtatcgtccgcggatcctcgggtttctcgcggagggagaggaggggtcgcgagtgtagcggcgacgggaggggacctggctgccctggtccagcgggcccccagccagcggacagggcccgggcactccgaggcggcctgccggcgcgtgccggcgctccggttactcgttatctgccccgggcgcgggccaggccgccgggcgccctgagtgccgcaccgcggggcctgggcgcgtgtcggggcgcactggggcccccgcgtggaagcccgccggttccccggctgcctcggaccttgcctgtatcaggaatctcgaaatctcgccagcgctctgcctgacagagagaaacccgatcgcgc

SEQ ID NO: 117344 - DNA, 1454 bp, Homo sapiens
aggcggacagctgaggcagccaactgaccgcctgatgtaaaatggaaaggcagaccccccccctccccccaacttttcacgtctggaagtcgggagggtggtgcgaggggcgggcggggagggcccggggtctctaggtgagggtttcggggagcaaagacacctggctccggagctccgactcttcgcctgaggcgcccgacgcgttcagtccgcgggtcctgccgcggttcgccccgggccccgggcttgaaagcccttggctacctcgtcgcgggagctgagctactcttacaggttgttttacccagtgcttgcagctttaagttgcgattttaggcaacgggtgtggtaggtagcggctccttgatgccgcattaacagctgaaaaagcgccccgatccgctgacttcactatgtgtaagaaacaacattggggattcctctttagcttgcaattattttaaatgataagcttttttaggggaattttggggggtgatgtgcagtttacaaaatctaaatgtttcgttgaagggcctggcttatagtacgtgctcagtaaagtatttgttgaatgaatgaatcttgaaatatcagacaaagcttatctcacatctagtaaaatttaggcacatactccttgattatgattaaggaaagaatgtcggcaaacagtatgtatttttgatatacgttttttagtttttgtcccacataacatactgttgatgaacagtccgttcttactctcaatattatgaacatagaaaatatatatcaaatttggattttctcttttggtttgagagaagttggtatacattttctgtttcttaaaaacaggccttatttctaatctttaaaaataatggagaagataaagagggagtgggattgtattttgaaacccagctttctgtttcattatgaataaaggagtttatgtgtttttgagaagggactgtggtatggtcttgctgctttttgagcaagggagaactctaaatttagggggggaaaagctaatgttgcactaatataataaaatgtcaccatttactcaacagatattcattaagcacctgtttatgggcacaggcaaaatccgcaattatccttttcttaaacttgaatgcaaagttatttccttattattgatgtcgcaagtggtgactgtcttaaacccctagtggctatttcagttgggaaagatggcaggtgaactgcaggaagtgtaaattcataacagcctttaaaggttaataagtaactttgtacagctaaaattattgggttaagcttttatattgtcagtttaatagaatctgtctacattttaaaatgaagggaggaagacatttaataagctagtgtttttattatctccctggtccctattaggagactttggtacagtgtattgaagggtaatgtacttctggtcctgtttt

SEQ ID NO: 117345 - DNA, 1041 bp, Homo sapiens
tcctccctcagcctctcgagtagcagggactacaggcgtgtgccaccatgcctggctaatttttgtatttttagtagagccggggtttcaccttgttggccaggatggtctcgatcgcttgacctcgtgatccgcccaccttggccttccaaagtgctggtattacaagcgtgagccaccgtgccaggcgaggaatttagcttttaaattattagttttatgcatcctgctaccttggttcaaagcttaagtatacttgtatctttctataatactaacaaataatgagtagtgcaggatttagctgagactgctttgggccctcatccaaagggagttcctgaattgaaatgccaagaagacttggtaataagttgtcttaatcctgacactgtaaaatacctgttaatgtattttagtcaaatagattatggtaaaacatactccctctttttcctagaaagtattaggttaatttcatattaaatctaggtacctttgaaataactaaattatgagccctgatatatctgttttcttgcttacccacttagaaactcatgctgtgatttcatatttaatctgtatgatcgaatttttttatcttgtactaaaacataaaattattggccgggcgtggtggctcattcctgtaatcccagcactttgggtggctgaggtgggtggatcacctaaggtcaggagttcgagaccagcctggcctatgaaaccttgtctttactaaaaatacaaaaattagccaagcatggtggcacatgcctgtaatcccagctacttgggaggctgaggcaggagaatcatgtgaacccgggagacagaggctgcagtgagccgagattgcgccactgcactcctgcctgggcaacagagcgagactccatctcaaaaaaaacaaaacaggcagggtgccctggctcacgcctgtaatcctagcactttgggaggccgaggtgggtggatcatctgagttcgggaatttgagaccaacctggccaacatggtgaaaccccatctctacta

SEQ ID NO: 117346 - DNA, 1048 bp, Homo sapiens
cctgcctcagcctcccgagtagctggaattacaggcgcccatcaccatgcccggctgatttttgtatttttttttaatagagacagggtttcaccacgttggacaggctggtctcgaactctcactcctgacctcaagtgatccacctgccttagcctcccaaaatactgagattacaagcgtgagccactgcacctggcctaatccttctgtaatcctagtacgtttcctgatttaatcaccacagattacttttaatacctctcgtcaaacctctagcctcccttttttcctcttcattttcagctcatgaccttgtttcctgtatgttaaaaatgaaagcgatcagaataaaacttttatacgtctccttgtatctttacccatactttgcctttcctactattctgtcatcatggtctccactcgtgctcctttctccttttaaggacattgcattgcttcagtattcatctcattctcctgcattctaatgagctgcatcatttccccatttctactggattatccctatcagcatatagatgtattgaaatatctcccatctttaaaaaaacacctttccaaatgccacatcttcctttagttactcctctccaaaaaggtaaatatttgttgtcatccgcgctccctgtcttgtttggatccactacaatctgctttttttctctttcattctaccataacagctctttttgagattattgagtgactttgttggtggtaaattccctagttctcaagcctaatctcagtggatgtagaagcaatagcagcatttgatgtggttgataacatcatgtttgaaatcttccctttgtttctggcatattactgcctgttttcagtttcttttgttggttccttttcattgccccaacttctaaaaaatgaggcagtgtttcagggacatatgtttagacctcttctatatttatatttagttttagtcccctgtgatctcattctgtctagctagaattatatacatatatatatattttacatttttttataattttttttt

SEQ ID NO: 117347 - DNA, 2570 bp, Homo sapiens
agccaagatcgcaccactgcactccagcctggcgacagagactccgtctcaaaaaaaaaaaaaaaagtttttttttcttgaggcagggccttgctcatcctccaggctggagtacagtggcgtgatcttagctcactgtggccttgacctcccgggctcaggtgatcctcctaccttagtcttccaagtagctgggaccacaggtatgtgccaccacatccggctagttttttgtatttttatagagatgggttttcatcatgttgcccaggctggtcttgggctcaagtgatctgcctgcctgggccccccaaagtgctgggactacaggcgtgagctactgcgcccagcctagaattatatatttcaaactaaaaatgttatctttagtctggatctgtttcctacctccagacttctgtatccatttgcgtactccgcatttttaagtagatttctaataggcatcccagatttaatgtcacaactgaactccttgtcctccctcttctccatcacccctccaccccagtaattgtccccattcccgtcttcctcatcctattaaatgtcaactccatctttcagtttctttggccaaaaacctagtagacattcttgactctcttctttctcatactcccacatgtgattcaaataattagcatgaaaacatgtcccttatctatcttaaaaactgccataagaataaatgtaaccacaatttgctctcttcatctgctgccacctctgtaagcaaccatcgtctcttgcatgtattattttagtagtctctacatgctgcttctgctgttttctgttctcaaaccagcaacaagggcgatcttttgaaaatgaaagtctgattattttactcctgtgttcaaacccttagtggctttccatatcgtttataaaaaccagaatacttaatacctaagtattcaagaagtcttgacccttcatcgtctgtacgtcctgcttgtctgatttcatgtcttaccagtttctccttggcttcttccactctggccacatatagacctccctgaggtcttgaacttgccaagcatagtgttgctttagtgctagtaggaatagagcttcgttttattcactgcagaatccccagtattcagaacagtggagagcacataatggggactcaacatttcctgaatgaatgactgttaatcttgtcactcatgtctttggttacagcttatatgaatgtttctataactaaaagtatttgaatttcacctaaaaccatgtagtcctgtaagaattaagtagaaacaaatttagatgcaagagtatgaagtaagtttcaaatcaatttttgtgtatgtaaagtgaaaatacacagtaaaatggtaagggacagaggaggtaggaaaggaaaggagataaactgatggaataaagaaaaggaaaacctgatttggtagtagggtgacagcaccttaaaaaaacctattttgggcttgcgctatttttttttaaagtgatgtttcttcaattctgagtgttggtgatttacatggacttagacccttcaatttggactatattgtaatcttttttttttttttttgagactgagtctcgctctttagcccaggctagagtgcggtggtgtgatctcggctcactgcaaactccgtctcccggattcaagcaattcttgtgcctcagcctcccaagtagctgggattacaggagtccaccaccaggccaggctaattttgtttttagtagggaccaggtttcaccatattggccaggctggtctcaaactcctgacctcaagtgatccacccacctgggccttccaaagtgctgggattacaggtgtgagccactgcacctggccgtataattttctttttatcagggatgtaggctcaaatgagattgggtgccaaaacttcattatttttcttttcttttcttttcttttcttgctagtttttgctaaacttcttttgttaaagaaaggcagttactgttactgagatagctcgatggtatcctgtgcatttttttttgaaagctcaaatagaagtctcacagttttagggagggattttttttagtctacaaaaagttattagtatgcctgtcctcttagtactgtactgcctagttactctcctttcaaaaaaaaaagcgtatatttattatatttccatggtaaactagcagctacaataatgtacacaactctattgagtagtatttattaaatgcatatacatatttgtgttcctaaaaatgcttgtacatactaaaactgcaattttactgatagttgggaaatgaaagtgcaaaagaaattaatgacttgtgaagttctggtatttcattatgtcaagacaagattttttttttttttcctgagctgtagatctcatttgctgttggttgattaagaaaaaaatcttggccaggtgcgataggctaagtctgtagtcccagcactttgggaggctgaggtgagtggattgcttgagctcaggagttcgagaccagtctgggcaacgaggcgaaaccccatctacaaaaaa

SEQ ID NO: 117348 - DNA, 1248 bp, Homo sapiens
gtgcagtggcttggtcttggctcactgcaacctctgcctcctaggttcaagtgattctcctgcctcagcctcccgagtaggtgagactacaggtgtgcaccaccacgcccgactaatttttgtatttttagtagaaacagggtttcatcatgttggccagactggtcttgaactcccaacctcaagtgatgcgcatgcctcgatctcccaaagctctgggattacaggcgtaagccaccacacctggtgaatattggcaatttcttatggtttagtctagtagaattacttattttggtttaaagaaatttctttatggtggtcagtggagttatatcagtgcttttaccttctttttcaaagttatgttctctttacatctgatgattacttctagattcatttattgcataaaatgtgctatttatatgtttgtatattgtttaactgtgtatctaatagttcattccaaagcaggcacaaaagatcttcagatcctctgacagagtgttcttggttttactgcttatgctaaataagattattgaaaggcgttacttttctggtcaagaaagcagaactgattcagtttgttatatagcattttctcagccctccccccccccctttcagaataatttacataaatactcctgagttcaattttttttaacttttttttctgcttttacttattaccctttaagtgcttgcttactttctctgataatttactttcttctactctgtgatttcttttacaaatcaatgaaatggtgttgtcttgttttctcaagttttttcctgttacctttcctgtggtcacctggacattccagtccgttttccacactctccctctaccttctcccccagttctttaaagagacacaaagttacaggcagcattttctgactggagaaaaattattgtttaaaaattgaactctgagactgggcacagtggttggctcacgcttgtaatcccggcactttgggaggctgaggtgggcgattgcttgagtacaggagttcgagatcagcccaggcaacagggtgaaaccctatctctataaaaaatacaaaaattagctgggcatgagtgtgtttatgaccccagctccttgggggctgaggtgggaggttgcttgagcctaggatgtcaaggcttcagtgagctgagctcacaccactgcactccagcctggatgacagagcaagaccctgtctcaaagaaaaattgaactt

SEQ ID NO: 117349 - DNA, 1030 bp, Homo sapiens
agaatagtttttttaaatgataatagaggttgcctatggtggtgtgcgctttagtcccagctacatgggaggctgaggtgagaggattgcttgagccaaaggacttgagtctagcctggacaacataatgagaccctatctctaaaaaaacaaaacccagaccaggcacagtggctcattcctgtaatcccagcactttgggaggacaaggtgggaggattgcttgagccctggagtttgagaccagcttggacaacataaaaaaaccctgtctctgaaaaaaaaaaaaaattgcctggtgaggtggtatacacctttgtcccagcaactcaggaggctgagacaggaagatctctggagcctggaaggttgaggctgtagtgagctcgggttgtgctccagcctgggtgacagagtgagaccctgttgctccccccgccccaaaataaaacccaaaaccgtaaaaccaacagtagctgtatctttgtatgttactgatataaatttattcagccaagaaaagcaggatcatcagtgtaaggagtgttaatattctatattgattcatgattagcatatattataaataaaataatttctgactatggctaagagaacttttaatttttcacatggacctaagcatttcaatttataatagcagtgtagaataattcttgtgtatttgacttctgaaatgagggagaggaaaaatacaggcaatgcatattttaagcataatgaacagtattgtttctttcagagctccttgcaagaaacaaactctattctaggatttttaggcagaaagatatcttatggtaggcaatttggtacttacaaaatcattgcatggtctggaagagctggaatcagagggttatcactagattaatatattcaagaacataagcccatagctgtgactgagaggtcaggaaacaaactggtaagtagtcataggaacactgaatctggtaccacagcttcttccagttgcctttatatctggtgagtagagttaggctat

SEQ ID NO: 117350 - DNA, 1053 bp, Homo sapiens
ggaacaaattggagggactaagagtggttaccaggggtcagttagcagctattatggtattcgttgagagatgatggtggtgcctagaactctactggtgacttagtgttggggagaaacagattggacaaatagaacatggccgtttggctgtgggggatgagatggaaaggcaaaagttaaggataacatgcttgtttctggcttcgtaaactgggtagatgagagggaatttaatgaaaataaattgaataggattggggtgggtaatggtaagaaagaagcagagttgagttaagaagcagggttcagtaaagtttgaagcagaggtagcacatcctgtggagctgcactacatgcagctgggtgtgaggctaaattaaaagacaactaggctggagagctttgggctggagacagctgtgggctggaaatgtagatttggcgatcagcattgatgctaatcgaactcaggggagtgattgaaataacctaggggagcatttgtagagtgaaagatgagggcataggacaaaacccttaagaactattaatgtaatgttagtttttgagcctttggtattttgactggattgtctgagaaccagcaaaaaggagggaatcagggctgttctgatataggtatttagtagaaacccacctaaattatttgattcgaagagtaaagttctcaaatggtctatcctacccagcctgtcacagtatctgacatttatgctgttagtttctctactttggcttaaggtgttgtctctcttggagtttcctgttaaagtgttgttatccttagagaactagaatattaatcccattgttggtgatcgtggtagtgtttttagggtcactagcttttattctggaattcagtgaaaggatggatgggaatttgagaaaaataagatttgaaaaacatgccattactgaggagtttaggaccacagaacctggacttgcagcattgaggttgccaagcacctggataaggggagtgagaacaagtgagagcaagagagaggttggaaaagggggaca

SEQ ID NO: 117351 - DNA, 1036 bp, Homo sapiens
ccagcctgggcaacatagtgagaccttgtctctacaaaaaatttaaaaattaactggacatgatggcacacacccgtagtcccagctacttggaagattaagggtaggatggtttgagtctgggaggcagaggttgcggtgagctgagattgcgacactgcactctagcctgggcagcaaagcaagaccctgtctcaaaaaaaataaaataaaataaaattgcatagtggatacatgtattatttaacaaataattataaagcaaatacctgtgtagctaccacccaggtcaagaagtggaacactgtcagcattccaggagcccataagcacctcttcctatttgtaatccttgccctcaggcctagaggtaaccattctcctgactttaattataagtttccttgctttaattttatatgtatgtatgcatctctaaacaaaatagtttaaattgtttttgaaattcacagaaatcattgcatgtatattgtgtcatgtttcttatctcgccatgtgagaatcatctgtgttgcctgaagctgtcattcattttgttttgtgtaaaaccataattcaccttttttcattttcttcatttttttctagatagattttaggctgtttcttcaaagtttgcagcaaattacctgtttttgctatagcagaataatgctattttgccattttaattctcgtaacaaaaaagcatcttatatcaatacaaggtgagcatccaaatccaaaaatctgaaatctgaaatgctccaaagtccaaaacgtaaaaaaaaatttaaaatttaaattaaattaaattgttttgtagagatgaggtcttgctatgttgcctaggctagtctcgaactcttggcttcacacaatcctcatgcttcagctgcgccaaatgttgggactacaggtgtgagccactgtgcccagccagaattttttgaatactgacatggtccaaggaaatgttcactggagcattttggatttcaaatttttcagatttagggtgttcagtaggataagt

SEQ ID NO: 117352 - DNA, 1108 bp, Homo sapiens
atcctgtaatgtggttgttactgatctatagttggcaaagcttataaatgtgtgaggtctctttccagaatttacaaataagtgatttatatttcgccatttgggacaaaaatgttaacatctctttgaacacagtcaaattgatacatctttagtctttgatcttttcatttcaaggaaggctcattttcttcattctaccactctactttttaaactttatatccatttttcttgcaaacattgtctacacttgttgactctgctgctttcctttcactcacttaacctcctgtaatctgatgtctacccacactactttactgaaactgctgttgccagcgccacactgtgtttgctgcacagtctaaggaatagtcctcagtctttcctatctcagtggcagttaatactgccacccactttctccttgaaacaggctccagtgacaccacatttaacggattttcctcttctaattctggtaacacccaaacctccttagtagacttctctttttctacctatgatttaaatgctgttcttactcagaggactctgttgagcacactttgcttgtcatgataccgttttgcctagagatcattcattgctttagtcataatctgatgattgcaaaacttctccttggcttcagatttatatatcaaactgtctattggacatcttaacttgactattgtagtagtctgcaagtgatataaacccacttcatcataacttcaggctaaagagggagatatgttgccttacaaaaccaaacgtctggtgcacaggtgaaactgatcttagggatgcctagaatcagagattgatgtcatcttgacttcccacttctcttttgccgctgcttgtcagcattattacctcaaaaccatcttccacatgaggtataggatattattgactaaggacatccttaaagtcaacagcttggcagtcagaaataaaaaataggtttaactctttgtccaactgcagatagaacattgcctgacaaggattctgatagactcagcttggtttgccacagtgggatgtagagtattttgactaacatgcgttctagtaatgatggtaggagtgg

SEQ ID NO: 117353 - DNA, 1033 bp, Homo sapiens
gtggctcacacctgtaatcccagcactttgggaggcctaggtgggctgatcacctgaggccaggaattggagactagcctggccaacatggtgaaaccccatctctactaaaaatacaaaaattagctgggcatggtggcgcatgcctgtaatcgcagctactcaggaggctgaggcacgagaattgcttgaacctgggaggcaggggttgcagtcagctgagaatgcgccactgcgctccagcctgggtgacagagcaagaccctgtctcaaaaaagtactgatactaaagataatctcttgggtagtaattttacagttaagacttcattgtttataaacttttcaaattaattaaaaagactactttgaaaaaggataaaccctgaaaatgtagaaataatttcaagtttttttttgttttatagggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattag

SEQ ID NO: 117354 - DNA, 1042 bp, Homo sapiens
aggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctggttggcctttcctttaaattttgtttagtttttcttttctttcaaggaaggaattatttaccagaattcagttagagcaccttttttgcattcttatattttcagtcatgattcctatcatgcaaaaaacaacttaaaactttttgatttaaaagagaatttaaatttctatcattgtaatctttaacttcacagttcacctcttaatttaacaaatacctagtcagaatgaaaattaaatggatagaaataggactaataaaacatttatgcctggtgcagtgactcacaactgtaatcccagctcttttggagatggaggtgggtggatagtttgagaccagcctggacaacatggtgaaaccctttctgtaagtttttattgcctatcaaccacatgatttttaacagaggtatcagatatctacacagctttcca

SEQ ID NO: 117355 - DNA, 1046 bp, Homo sapiens
aatcagttgtaagtggtaaatggtagtagttcatctttcccatcaacatgattgtctctttattttaggaataatagcatttcaaaaattcctgtggtaaagaaacattaatctgaaacttaagccttagaaattaatcgcaggtatgatagaatgaggcttggtggttccatagctttcttggtcctttgaaatgggaaataacctgaaccaaaaatcctagtttgaaagttacacttcagtgatttggcctataaacagtggtcctatgattatacattttttccttcactgatttgcataattttgttttcatggccacagcaaaacaatgtgaaatatatttttgctatacccactttttttatcaaattcagatgtctactctcaccattttatattcatttccccagaaaaatgtgctgttttcataatgtctttatttagcaggtctttcaaaccaaatggaagccttacctgtctttgtccttaatagtgtaaatatcttgcacagagtgttgaggcctatggttttggacttgcaccttacagctgcctttgttttatctatctagctttaactgtgagtgttcagatcagctgatcacattgatcaggagccaaagccaaatgctttgtagtttgttatgtatgtatcccttaaaaaatcatgaggttttgatttttatattttaactaagggtacattcctgccttctcttagtttgtcatatgactagaacaagagaagtcttaagctgcatttactccaattccagatctccatttgtttttgttttataaatttataatcttaatgaagagactagtgccctctcttcctgccacaactctcaatctgccaagactgttgaagcagttaacgctcagtgcaaacttttgccaaatagtaagtttcaacaaaatatctttatagtgaaagattttgagaattagtaaatccagtacatgattccataaaagcttattaaagttaataattctaatttactccaaatgattactttcaatatgatctttgggga

SEQ ID NO: 117356 - DNA, 1769 bp, Homo sapiens
cccagccaatggtgtgggttgtttgtttgttgagacaaggtcttgctgtgtcactcaggctggagtgcagtggcatgatcgtggctcactgcagcctcaacttcctggtctcaggtaattctccctcctcagcctcccaagtaggtgggactacaggcacacaccaccacacccagctaattttttgtatttgagacagcattttaccatgttgcccaggctggtcttgaactcctggactcaagcaatctgccagcctcagtctcccacaaagttggggttatgggtgtgagccactgtaccccgcactgatggtgtattttttaaatgaaatgggcaagctgcctatttctgtgtgcctagtaccctgtggctcaaatggaatattcttatctttgatgaaacagtggctcaatctaatgggatacttttaacattaatggaattgtattttaccttaatgcatggaaacttgaaactgtgtttcaaatgccaaattatctgaaatgattctattgatatagttccttttattagcaaaagtcttgactgactttgtacctgtgccaatagtttgagaaatgattgttttattgaaaataaatgaaaatttatgcttttaaacaagagtaataaaatgattaaaaaccatgaaattccagtttattgtcaaccttcaatgtgatcagaaatcataggtattattataataaaatctgggcctcgatgcaatgtttgagaggatttctttgttgacattgattttctaaatagataactagattattaggatctcattaatatgctgatctgccagttaattatatattttttattttcagaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtaggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctg

SEQ ID NO: 117357 - DNA, 1036 bp, Homo sapiens
ggcttcctatttctctcaaactgagacctacattgcattggtgctacagatcaagtcacatctctgtgtagatcaagcatatcacctctgtaaagatgacttctgtttggtcagaccagagacaattttatgacctcaaacatgaatatcagctaacaagagctctcaaatacaaacaaaaccacaacaattcaaataataagttatttttcaaatatacaagaatatccttggtattggcagacaatttcaatttgtccttcagcccaagctatggcttggaaataataatgccattatctttaaaatagcttgttaaagaaaaatctatagcaatatacacaaggatcactctgagtttacattttttctgtaactgtggtcccaaggcagttccggcgtgcaaagtggagactggtatccaggcatagcatccattgctcaggaaactatttatctgcagaaattaaatgaaaggaagcataactcaggtctatttcattgctcggagtagagggaataaaacctctggactggttgtagcaatgagctgttcgttagcaatggcctgcagaatcatgaggtggttcttgcccattcctccacgactttcagtggttttcaaataggtcatccaaaggctagactgctgaaacttgttcattttctgaaaataaaaaatatataattaactggcagatcagcatattaatgagatcctaataatctagttatctatttagaaaatcaatgtcaacaaagaaatcctctcaaacattgcatcgaggcccagattttattataataatacctatgatttctgatcacattgaaggttgacaataaactggaatttcatggtttttaatcattttattactcttgtttaaaagcataaattttcatttattttcaataaaacaatcatttctcaaactattggcacaggtacaaagtcagtcaagacttttgctaataaaaggaactatatcaatagaatcatttcagataatttggcatttgaaacacagtttca

SEQ ID NO: 117358 - DNA, 2240 bp, Homo sapiens
ttacagaaataattctagttacctgatatttttgtcatatttttccttatgattttaccagcttggcttcctttcaacagtttttttgtttttgtttttgtttttatttttatcaccagcttgtgctgataaaggtaatctttctcctgcattctgtcttgcaataactgatgtgtatatgttttatatataagtagatttttttccatgcattaaaaaatatgttgctagatttcaatttttcagatattatcaagatgttagaatttttaaatagtgaaatattatgtaaacaaggctaattgtgattgaccatgtcagggtttttgcatctctccctccagttggcagtatcatatctgatcacagcagcaagatcagtggccagagctgccccggaataggtggggcttacttgcaaaagaaaatccttcagattaccaggagcacagccaaaagaacagacagtactgagaaggccactgaggagaatagagacaggacaagttgtgagaacacaaccagaaaaagaatgacatccccgtttagaagacttagggaaagaatgctttcaagggagagactagtcaacagccaaaaagaggacacagatcacaatcaagctacagaaagctgtgagaaagtgaaggatgttggaagcaacatcaaagatgagaaagggagtgccatcttcaattcaaatagccaaggcaacagtaacactttaaactgcttctatacgcgattcaagtctaaaaggaggaagacactctgatgaagttccttatttaattttagtgttaagtttgttttcagttattaatgtatacatggcttaaattaaaccatttgtcaaagcttaggcagacaacttagtaaaatactatttataaacacttgaaaatgcctcatttgtacataagttattttactgatgtattgagttagtaaattttatactcttgttttctgtagttgactttatttcctactgttagctggatctgtgagtgaaatatgtagaggaggcttttttatcttctactttttacgtatctttgattgggggagaagggactagtctaacatagcaatatcagaatcatctgggaaacttgttaaaaaatgcaattactgtgtcccaccccagacttcataaacttgaattgccagaaatgggatctggaatgtttattttaattggcttgccaggtggttcttagtattattatatttgagaaatactgatcaaatagacataagaatgaaattattttttaaacaatgaagcaagattattgtgtagagcaatgactttttcttttcaagaagaaggtttttatttatttttaatttacttattacatccactttcttggtcctcttaaaaattgactaatcagctcatggacattgacaaatagcagtgatcccaagttcagagatgtatgatagacgtcagaagactggcttgtcttggcttaccctgttcctgtccacgtaggccaaatataaatcacacattttctaggcctttttctctttgaaatagttaacgaaacgacttaataagattactgtgcaacaaattattccttaaatgacttgagttatatgtgaataactccaagatccataaacagagaaagacttggaactaaggatgttgtcatcctctttctgcatgaagatgaggccctgagaattccagtaacatacccaaagcctgtaattcttcctaatgacatttctaggtattggtccaaaggtcacatatctactaaaccctactttcctctgtgagcaagaagatattttttacttctttgagacccgtcccttgttgggattactagggcattttctttttcttttatttctaaacaaaaatttggtttcttccagttatcaaaatagattattatgtacattagccattctgttgcagatttgtttttgggtccttcacctcagtgcgtccctagaatacagaagaacatctctctagttgtctgctgtgcagtaagtcacagaacaacatagaacatgtagatgctgtttttttctataacacattattaaacatgtatccactcagctgtttaatattctgcaaggttggtgaagaaaaaggaaactaagtatgacactaagtttaaacctaaaacaatttaaaaaactgaaacaggctgggcatggtggctcatacctgtaatcccagcaatttggtaggctgaggc

SEQ ID NO: 117359 - DNA, 1460 bp, Homo sapiens
gtaaaagtttctgtaagagattctttttaggccaggcacagtggctcatgcttataataccagcattttgggaagctgaggcgggtggatcacttgagcccaggagttggagaccagccagggcaacatgatgagaccccaactctacaaacaatttaaaacttaggcatggtggtgtgcctgtagtcccagctacccgggagactgaggtgagaggatcgcttgagcctgggaggcagaggttgcagtgagctgtgatcatgccactgtacttcaacctgggcaacacagcaagaccctgtctcaaaaaaaagaaagaaactgtttttaaccaactataagatttaggaaaacaaaaattaggaaaacaaatatgcttttccttttttagtaacagagtattaccttttttaaaattaggatttaaaataacctgtactcttgtggattttttacttatacagaatctcatgaggtaaaaaactgaaattcttgttcatttacgtgttttcataattcagactggagcatttcttttcttggctagcctgggcagtgtgcagcagatgccatttcatgttagctgcacatgtagcattctaaatatggtgtgtatttcttatattgacccttcacactctgtgtgtaccctggaaagaaaggggatttagtcctggcatcttcttcacagatgtaaaagaattacatatttaaataatcacaccagaggatggtacatggtcagagggaagacaagcttattataataattctaacaggagagagaagcttccagagcttgcttcagcttccaggctctaagtttcatctcactctgcagagctctttcttatttttgccacctatgtggcaattatgtacagtgatgtcagacctgagtttgaaccgtgattctgtcctccactgtagctgtgttactacaagtaatttatttatacggtcaggtttcctctctgtaagatgggaaaaagaccatctaggccaaagcaggcggatcgcctgaggtcaggagttcaacactagcctggccaagatggtgaaacccatctctattaaaaatacaaaaaaattagccaggggtagtggcacatgcctgtagtcccagctactcaggaggccgaggcaggagaatcacttgaaccaaggaggcggaggttgcagtgagccaagatcatgctattgcaccccaactagtttggtggctatggaaacgaagaaagaattggatgcagaattgttgcctaacctgggtgacaagagcaaaactccatctcaaaaaaaaaagaggaaaagaaaaagaccatctattttaacagcctcttatgtggtttaaatgaaataatatttataaagcctcatgtgtggtaagtgtttagtgaattggaatgtctcttttctttctctgcggccacctcaggacaccatagctccattactca

SEQ ID NO: 117360 - DNA, 1021 bp, Homo sapiens
acaggaatgtaaagatatatagtattatgaagattttaatgatatgttttttcttacattttaagttggatttgctggtcaacatttcttacaagacatcttgtcagaaatttctgcacttaaaaatgaaattttatgtttttatgtcccttgtaatttcattctgtcacttaaatgagtggcccaaaaatcttgccagcaagatgttcagaaattctattcctttaaggtcttttcccttaaaaactttgaattcaaaatttatattatagtaagtaaatgtttttccttaagcttcttatttatataagcttcctgatgaattaggtatttaaaatataattggtctaaagcatatttttataaagtattttggagcttttttgaccttcagtatatactcatcttaccctcctgccttccatttaaagtcattttactgttaagctgtaattttttcctgataaaatgtttctgttcttttctgtctgcatagtttctctgactctcaactgttgtcttttttctgtgctttcctattcaaacacatgcttcaatgtttgtggctcttgcttacaggaagaagaggtggcggagtctggggtaagtgtagagatgaacgcaactggaatgaaggttgtgcgactcttaacatatattgcatccttttcattaatgcacgcacataaaatagcatgaattctattaaccctgtcagcctacattcctgacaaatgccttctgctaacaaggtgaaagtagtgatagaactagctatttttcctttatttttccactattgatgccctataagtcctttttagattttgatttagctaggtcagttagatgatgataatgatagtgaatatttgttgtgtgcttgctatgtgccatacattgttctaagcactctaaacgaattatcttacttaattctactactaccctataaaggagatacttttctttccatagtatggatgggaaaggttgagttgcctaaagttttagttcatta

SEQ ID NO: 117361 - DNA, 1063 bp, Homo sapiens
tgaaatatgtttatataacttgagagtattcgtcatgattactttgtttccagcttgtgttgagaccctgaacaattcatgtgtccaatctatacgtgctgtttaccgtatgttcctcagtcttgccttcagggccttggactttgacagacctcagggtctacctcgggggataaatggggtcatgctatgttatagacaagtgtgaaaaaacaatgctataaacaggttgccctttgtttgggatttttgttttgttttgtttttttgtggatttttttgagttgagatctcactctgttgcccaggctgaagtgtagtggcacagtcatggctcattgcagcctcaaactcctgagctcaggcaatcctcctgcctcggccttccaaagtgctgggattacaagtgggagccattgtgccccgagcccatgaaactggttttagaagccatgcacagtttatcatttgactttattcataaccatcactcctatatggaacacagttcctagtggctcattccctaagagcagggttgaaccatgtatgggtataccagttcttaaaagcaaaattggcactgtgataaagaaggtccttctttgtgcccctcaagattaccagcttgacttttgctacttttatgtagataatttaattttgaacttaaacatttattttcattctataggaaatgactccaaagtagatggtttagtaaactttgagaagttaagaatgatttccaaggaaatccgccaagttgttcgaatgacttctgctaacatggacccagctatgatgtttcgacagaggtaggacattgaaatatgtaaaagtgttagagtggtatcaagggtgatgtaataattaaaatatttatcatttattgatcatatttattctaccatgtgtgctgtacaaagtgctttatatgtgtccgtttcatgtaatcatttatcattaataaccataacaggtaggtgatattagccttcgttatacatattaagaaactgaatgaagctcagagcagtttttacataatttgcaaatattt

SEQ ID NO: 117362 - DNA, 1485 bp, Homo sapiens
ccgcctgtagttccagctacttgggaggctgaggcaggagaatggcaggagcccgggaggcggagcttacagtgagcctagatggcgccactgcactccagcctgggcgacagagcgagactctgtctcaaaaataaaaaacaattccatttgctcatctcctgattttcatgcagttgttgctgtgcttttaacacaagatattgttgcttaataaagtcagtatttaaccttgcctgtatatttacttttgttgttgttactactattttttattcattcttgcatttcagagcttccgtattgctgggcatagtttttcggccttatagaacactgtttagtattctccttaagtgcaggtttgctggtgatgaatatctcttaatttttgtttatctgaaaatgcctttacttcattttcagaggatttttggttggcagctatcttcttcaaacactttgaaatgacattccattgttctgtgccttccactgttaatgttgagaagttagcttacagttttatttgctgttgctttaactgtaatctgcctttgtttgatactggctgttaagattttgttttttcttaatttctttctagttttgcttaatatgactaagtgtggggttttgtttttgtttcttattccgattggtgtctgtaggacaccttgaaacctatggttttgtacttttcatcagtttgggaaaattctcagtaattttatcttttattctctctccaactatgtctcatttctggtaagttcattactgatgtcctaattccagttattatttttgtttgttttacagcttcctttttctttttttagtttaatgttcttttccagagttctcattgttttttcttgtctttgaacatattcaacatcgttatttcaaagtctgcctctaataattccataatctggatcccctttgggtcttaatctgttttctcctttttactctttcatttctgtcatgttatgttttctcctgatgtgcctggttattattgaaaagtgagattacagaaataatctcgctttttgaatgatgttccatatctccagagaggattaaagtttgcttctggcaggcagttaggggtgctagaattccaaaatcactttaatccgttttgatgtaatttaacaaaagacttttatcccagtctacattcagtttatccttggtctcaggatatagctcttcagagtttcaaccaagcattggaggtttacaaggacttaagttgcttttccttttacctcaaaagacagggtgtctgtactcggtttttcagctcattatccctttctgaaatcagatacacctaggggcaagcactgggaaatgcaaaacttgcttctctgcatttttttgtacttttgtccagcttttctgatctcaccagaagtgttgttctaattatgtagtcttactgcctcttctttcattatcactcagttt

SEQ ID NO: 117363 - DNA, 1050 bp, Homo sapiens
gatttcattcctcttgcttcacttggaaatttatttaaaaaggaagtgagtggagtaacttctgaatagagatttttaaccgtcttgattcaggaatttattttgccttaattagaattcatgctattcataaacaaatatttacatagtaccaatcctctgtcagataaaacagtaagataaaagctttacgagggcaaggccagtacctaaaatagtatctgacagatagtttcataaaataattaagttcatgacataacaacattatttttactctttaatagatgccagttggtagaataagagacagacttctcaaaaatcttttcatttaaaatgttaacttttcattttatctgtaaattaatatttttggctaaaagttattaacagtaaaatgatattttacaacgacaaaaaggaaaagtgctcttatttaatcatatttatgaatacatttatttaaaaaaatttttccatttaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataaggtaagttggtacaaataggtacaaatgtctgtatggttttgtcattacatgcagctgattttctacttaggtattcaatgcctatgaaaagaaatgttcaattaatatgcctttattgaagtgttgttagatttaatgtattttccattttggtggtattggctttttctatttttgtt

SEQ ID NO: 117364 - DNA, 1162 bp, Homo sapiens
cattaggggtttggataattgaaatatataaaatacatatcatggagtactatgtcttcattaaaaatagttttgtagaagaatataatggcattaaaatgttttataagatattaaatgaaaaaattctggcttccaaaccatatatatagtatgagcccaagttttgtttttgggtttttctatcaatgatttgttatctgaaaaaaaaaaaaggatatatttatcaataaatgcaacagtgacttctgttaatattgtgaaatagaaatgtatatttcagtgttcagagggatcactgtgtttcacgttgctttttgaagggtttaaaagtgatttttttaaaaaataacaaagcatatctttctatttatgtagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtgaataagcttattagtggatgtgcttatttgtagatgtgcttttgaagatttcctgttaaaacagctattgtaagtagaaacattatcatgttttagtgctcctaaattcactccagaagacgcttgataaaatatcttgtcactcctgctaaaataaactcttagaaccactgatataatctagttcctgtttttttatagaggaagctgaatgatacaaatcttcatatatatctgaatgactgtatctactaatttataaatttgtttttaatatggccagtatgtactttggcaaaagaagccatggttttcacagttctttttctaagtagttttcctttaatgaatatgcaggaaaattttaaaaattttaaaatgtgttctgaaaattatttaataaactagattatttctgtagtacatttgttccttactctggtttttttttttttttttgagatggagtctccctctgtcgcccaggctggagtgcagtggcgcgatctcagctcactgcaacctccacctcccaggttc

SEQ ID NO: 117365 - DNA, 2198 bp, Homo sapiens
ccttttttatggacttaaaaagatagtggaaacccatttgttcagtatatttctcttggcaaattgaaatttccatttgtttgcaataatcttctagcacagggtagagaggtatattagtccgttttcatgctgctgataaagacatacccaagactggacaatttacaaaggaaagaggtttaatgcactcgcagttccacgtggctggggaagcctcacaatcatggcagaaagcaaggaggagcaagtcacatcttggatgacagcaggcaaagagagtttgtgcaggggaactcctctgtttaaaaccatcagatctcgtgagacttgttcactattgtgagaacagcatgagaaagactcacccccatgattcagttacctcccactggctccctcccatgacatgtgggaattgtgggagttacaattcaagatgagatttggttggggacacagccaaacctttcaagaagtatgtctgattttgatggatcttgaaacagtctgaccttaagtcttgtaggtttaaaaacctgatgatgtcagcagcccactaagtattggctcatcagaatgaaatctgaacaagatgcatttgatgactcagatttcttaatacattgaggaaagagagtttgatgcatccttcttacagaaggaaccagagtagatgaagtattctactttcaacttgagaggacccagaacattcaacatatgttggctaagactccttgtccctggaattatattcatgtatattcagttgaatctttcagtcctcagagcaagtctttttttttttttttttttggtcctcagtctcaagaggaccaaaaaatttattttatgaaaatatttcctgccatatctgtatctgttccatttctcccttttaaccagggattatacctcaggacattttgagataaatttgtaatttgttttgttttgttttgttttcctctaaaggctaacagtgtccataatgctaagaaggtgatgctggacaaacagtataattacttgagcccccaaaatcttccatcctgcccccactgcagtcatcacacacatacaaaaaagccacagtaatatatattccctaattctttttttcttttttgagactgggtcttactctgttgcccagagtggagtgcagtggcatgatctcagctcactgcagcttcaacctcccaggctcaagtgatgctcccacttccacctcccgagtagctggaactacaagaatgtgccaccacacccagctaatttttaaaaattttttgtagagatggggtcttgctatatatccaggctggtctcgaactcctgggctcaagtgatcttccagccttggcctcccaaagtcctgggattacaggtgtgagtcatacccagcctgtattcctaatttttttaaaaaggaaacttttgcaacagtaatttattgtcatagggaaaatttttagcatttgttcatgctataaagtcacttttcacttaaatttaattatattaaatattagcttatcatgttgaacattggtccagagttctataatgacaaaaagaaataagatagaacaagggggggtggaatattattatttacatgtgcttatcatataaacattgtctcaaattagaatttttctactaatagcagaaatcacaagggcaaagactaagatttcaccaggtgaacatttaaaatgttcttgtgttacaaataaataaaatatggaaactaacattttccacttcatagttggactaagtgttgttatctactacaatacagcaggaaaaaaacataagggataccaaaaaatatttttaaaaagacataatggttcattaaaccattatcagttactgagtcttaccagtaaccaaagaaatgaaaaaataatgatatttttttggagggaggaaaagaatagggcttatgaaatgggaaagcaaaacaaaacattaatatacaatttttgtaaggatgtgaccaaatttgttcccttacactctaggattataaaatattataacgtctctggagaacagtttggcagtatatttcaaaaaccttaaaagtatgcgtgccttctaattcagcaattctgtttttgagaattttcacggaggaagtagattgcctgcagaggcttacttacttttgacagggggta

SEQ ID NO: 117366 - DNA, 2083 bp, Homo sapiens
gttctttttagaacaaagatttaatgagtcattactttcctaagacatttgtagtgatttttatattagtgaaatgtcattcatgagacagaagacactccagttatttgatccgaagttaatgtgaagattgttaccaaagtataaagttaattaaactatttaccggaaagggtaaaggaagcactaagatatcacagaggtaagaaaactgcaaactggattcagttcttggcacgtaaaagaaatgtcactaccagggtgaagaagaagtgttgctgacctgaaccccctttctagcctcttgttctgtcattctctccccactattacttcaaccctccttcctgagtatggaatgaactttcagaatgccctttctttgcccatgtttgccacccatggccctctccttgcatgtccagtaagcttttttatttgtcagtgctgaactccagtgttacctcatctgggaaacccacctccctctgccacagagtcagtctctcctattgtttgctatgtggcaggatgggaatttatttctttgtctctgtgtgtgtgttttacagcagtgcttttcacactacgtagaacattcaaaaataaagtgtcttcacacttccaaagcacaaattaaatatatgctttcatgagacaagtattagggatcttatgatttgtagttttaataatttatatggctgtatgtttgccataggtatatgtaggatgtggggctgagggaataagggatagggttgtaggaggaggcaagagagaagtaagttggagatttagctggaggaacaaagagaagaggttgaaattattaagttttagaaactaagtccccatggagctgaaattcagacctataaagaaaaggtgtgttacttaacttgatttcaagttgattacataattctctccttgagaacatgtttaaaggactaaagataaagatgcctttttaaaatctgttcagagaacatctgatatgtctcagtctgcaacatgtgcttataccagtaatgtgaacacatatatgataggtatttaacttatatttttaaacccccaaatgtgtaattttgtgaaaggctttttatctagtgatggatattatttatatttggattgaaaaaaacatcaattcccagttaattccaaattcagcttcttatgtaatttatacaacacaaaaatttaaatgagccatgtacatcacatatgtatattataggacatgtgtaacagccaagtttgattaatgtttattggtcttgagcttacctatatttatccttcattttcaaagttattactagatcaaaatgaaagtgggggcaaagctacagaactgtaagtttgtttttgattgcttactttgattttgctttatttttgctgcatacagctgttggtttttattgtaagtatcttaaagactgtagtattctattgcccttgtttgtatgtattattttgttattttttaaaagtccaatgatacagaattgaatgaagtagtaagcacaacttttctttccacttagaaggtagccagtattaactggcatgtgtctttttagtcatttttttgaatatatatatgtttttaagtttggatggaatcagtatacatgctattctgtaacttctgaaatgttctttgggatttctgactcaatacaaaatgagtcctaaaaaaaattaggagtgtggctaagagaaatttgaaaaggaatttttttctatatctgcatgtagaacttacagcttacttcttttcacttaatagcccaaacccttaattgatttatttcatatagtaaacttaattttttcttcattgaaaattttttattattagtttttaattataaaggaacacagtcatagctttaaaaaaattaaactgccagaataagatagaatataaaagtttccactcctcagaatttagttattatttacttgtatatccttccagaaatttcattgcacataaaatgtgtctgctgttgctttcaccccaaatgagatgttttacttttcttccacttaactgtttcacttt

SEQ ID NO: 117367 - DNA, 1070 bp, Homo sapiens
attacaggcacgagccacccgacttctggctaattttagtatttttagtagagacggggtttcgccatgttggccaggctggtcttaaactcctgactcaggtgattcacccacctctgccacccaaagtgctgggattgcaggggtgagccaatgtgccccgccctattctcattttaatttttgtaaaagtaagtccattcttaagaattaaagtcctgttttcctttacaccacaacattcgcctatattacctgatttttcagtattcctgggggagatagtgttgctcacatttacagatgagaaaaccaaagtttataaagagaacgaaatttgcctgaagtcaagcagctagtagctcaggtctgtctgacatcaaagcttgcccttgaaacactaatctttgctttcttccatgtctctttgcttttctctgactcttcagctctgtcatatcctggccttctctttcatgtctgactattaacagtcctttagcagtttatttaacagtctaactctccatcttgcatagttttctaatctacgtaaaatcctatattttacatctagtgtaatttaaatgtatttcatattattcatttataatactatactttaatctttttcatgataataggtaagtattctgtgatacttctgttggtatgtatagcaagtactaggcagaatgctgcatttgataaaatatagacaagaattaatagtaacagagcattggttttaatgtaagtacaacccttagaagtagtttttggttattgatgttgatggaaatttttttcactgctatcttatgtttttataggactgttttgcttaaaagtaagctaaaatttgggggtatctaaaacctaagtgacagtgtttgtttctttgtttttattttttctctaggtggatttagaagttgcctatgtcacatttctaaaatattttaaaggaagaatattttgtttgcttaaataattagacttgagagattaaataagaaataatgtacccttagaatgaactttagagactgtaattttcataattctat

SEQ ID NO: 117368 - DNA, 1089 bp, Homo sapiens
tctcgaagtttttccaatcagatatcctcatcttcctgagttcttatttccagtcagggaaacacattttctcctcatttaatttggaactcagaggattaaaataccctgagttttttctaaaagttcattactcattctatccttgaggtgagtggcttataaaaatcattactttaaaataccaaaattttgaatgtcaagtgtactgtagcaaacactgtaagaaaaggcatggtctcacaaatggggatcgagtaaggagaatgttagaggggccagcccacactgaagaggtcagggatggttggggatgactggaagtcactgtgaaaaagggacaaaaccgaggatccagaaggcagaaaagaatgcatgaggagaattcctcagggggtaatgccctgagttccacttccagaagccttaatgggttttgtctggaatagatctttcttccattaactgcgtctcattttgaccagcgacacagttgtgacatgtatcatctaaagacagacaagactgtaattacaactctcttcaacttgttactatcacattctcaccagctgtactcaagttttaggcagctaaatcagtatctcatctccacattatcctttggtgagggtgtgggaattagttactgtacctgaattctgtctttggttacagcaagaggtgtaaaactgaggtcgccaggaacagtcagttgagtattttcaagcattataactttatattggtacccaaaaaagaggactatctggtaaaaatagttttgcttaaactcagaagggattattgggtctcttgctttgtgccaacaagaaaatgcttggttatgaatataaatatgaataaaatgctgcactgcagaagtttatattaacctgtctgtcccttccaaacatgtttccaaggagtaaaatgctaattatttcagccacataaatacagaaaaaatagtttatcttggaagtcaaaggtttctggagcctattttgttgggagagctgtcttacctatcagactggcctttttgcatttcggagaatgtatcttatatttcttgacagtcatctg

SEQ ID NO: 117369 - DNA, 1108 bp, Homo sapiens
actaaagaaagaagaagatatagctgctaaaggacgggtaaatacttgacagtgtttagttgaatgagactgagaaagttcaaataatggaaagtcactgtgtttatccttaaaatttgttgttggtataaaaattttctgaagagaagaaataaaatgacgcatttgttttatttccacagtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttaggtaggtaatgccgatcttagctatgcaggaattttcatcttcactgtaaagtttttatttggggtggggggaggcttgggtaagttttgctttgttatataactaatgtatcataaagtcttcaaacagtactcaaataagaatacatttgaacttctccctatcactttcatgaagttactactttcagattatataatagcattattttgaattttgggaaagactgtccattttattttatgaaatccatttttaaatatttttggtccacttttagtctcctgatctctacaaattgtacaccttaaatcttgggacttattcaccagttttttttttttaatcatttttcctttgcagcaccatttattccttcttgaattctaaagttgaactttttaatcagacctatttctatttccaaaatgggatatcaccaaaacttagtaatacttgaagattttaaatgtaaattaaggtctgtaaaatactgatggaattagtccactaaagtgtcatgattggcgatgactctagtatatattacattagcagcttcctgaagcaattacaaaagttctaatcaagagcagtacaatacttagcacatagtaggcactcagtttatatttattgaataagttaagacagtgaataatcagtgaatgaaataaagcaagtt

SEQ ID NO: 117370 - DNA, 1036 bp, Homo sapiens
tttcattttatttattcactattaaacttttaaggttgtaggagtaactaatactgttctgtattaatttgtattttttaaatacttttaagattatggaagtaaatggacaaaactttgagaatattacatttatgaaagccgttgaaattttgaggaataatactcatcttgcacttactgtgaagaccaacatttttggtgagttttgttgtaaaaattgcctgaactctttcttcttaatttggtaatagaaaagtcattacagtggaagaaaagatagtaaaatataaacatgtttttgtctaagctcttcagctagtttcagaatctttagttttgaactattatgtattctagaattttcatttttcattatgtttttaattattttgatagtaagttttaaaataggtgtacagctaccttcagttatttatgaaattcctatggagcgtgtattatgtactctgctggagggatactgaatgaaatatagaatgtccggaataaaactaagaagtcataatcaggcattttttcccccagctagtgtgcaaattagtctacttctaatctttaagccagctttctgaagtaatatgaatgccagattagctgttttatggaaataaactgagtaaagcattgacttaagtacttagtgaattacagatttctaataagagcatactctacctttgtgtggaaaaatgattacagtgcctctgttgtgtttttatcatgtttatatttaaataaaaccagtgactaagctcatacttttaaccaaatctactgtgtgtttttttaaacttttaggaaagatttaatgtgatttgattgccttagacactttaggatttttcagaaattctgaaaagagtaacagtaaaaatcatacagcaattgaaataacaaagaaactttaagagtccttatgaagtagggaggaaaacaaatctctctaggttttttaggttacaatttgagaagtaagagttggctttaaaagctatgcctacggaagggaagt

SEQ ID NO: 117371 - DNA, 1004 bp, Homo sapiens
gtggattgagttgaatgaagtgggaaaaattggcaaatttggtccctttcattaccccttggttcctattgacttctcggcagcacatgtgctctatacaaaatggggagagtgaacaacactgggaacttgattaaaaggttatagaggtactccactatcatttgagtcatcctgtgttggctttgtaaatattcaagggacatcagaatgtgggaaaaaaagtcatgggatttttttttccagtaatcagttagccatcaggtattcattgcattctactttatactcaaagacatcaatgtaggatcagaacagatgtaagacttggtgtctgctttaaaaaaaaaaaactttagctttttgttatggacatgagatttgcacatattaacactatttgagataattgaaactggaattagaactggtagactattactgagtttaaggaagagctaaaataatacaagaaggaagtcttttctggacgagatgaaaacttgaatgtttctttgaacattggacaatatttaaaaaggtggttcaagttgttcaaggttttgaataaaggttttaaaagattctggttttatataacagccaggagataagcaaggtgggagtagagtgtgtattaggaaaagtttaagaaatgataagtaggtcgggcgcggtggctcatgcctgtaatcccagcactttgggaggccgagacaggcggatcacgaggtcaagagatcaagaccatcgtggctaacatggtgaaaccctgtctctaccaaaaatacaaaaaattagccgggcatggtggcgggcgcctgtagtcccagctactcgggaggctgaggcaggagaatggcatgaacccgggaggtggagcctgcagtgagtcgagatcgcgccactgtgctccagcctgggcgacagagcgaggctccgtctcaaaaaaataaataaataaataaataaataaataaataaatgataggtaattttttgtc

SEQ ID NO: 117372 - DNA, 1010 bp, Homo sapiens
tgttgccttgagacaataaatacatgccctggttgtaggagaagtggcagtaacagcccacaccagggctaagttagtgaagttcaaaggtcctgctatgatgaaatgccagtgaaaacagcttcagctgagtgagtgctgttggctatttatttctctgccttttctgtctctcaacctctgggtgctggtggattacaattaagtttgcattccaattctcccagcgctaaggatttaaaggcgaaactgtactttgacgatttgtctaatggagtagctacaaagcggagtaatcaacaatagttctttggttcttgggtcatttgtttattttctaatccttcctatccttggatttttaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggttggttttataaggggcatgaaagtgattttaacccaaaattttattcatgaaacttttatagttgatagattacctgtttattatgataataagattcagtacacctaaaaaaattaatgaacctgaaccatcagtataaacattctctgcttacttttatgacagaatagcatgctaaaagtggacgagagccttaaaaggcaaaaactgaaataaagctctggtatagctataggttcaggaaacataatagttacatgagagtattttagaattttactgaaatacttgattgtttctggagatcaataaaacattttaaaacggatttaatattttagaaagaatattcatcaaatacatttttttaagagggcagattgcttttaagcttcaaaatgggaatatttttattttcttgagttacagacttcacaatcatttgaaaacaatttatcaaaccttaatatgtctctc

SEQ ID NO: 117373 - DNA, 1057 bp, Homo sapiens
gttgcccaggctggagtgcaatagcacaatctcagctcactgcaacctccgcctcccaggttcaagcgattctcctgcctcagcctcctgagtagctgagattacaggcatgcaccaccatgcctggctaatttttgtacttttagtagaggcgaggtttcaccatcttggccaggctggtcttgaactcctgaccctgtgatcctcccacctcggcctcccaaagtgctgggattacaggtttgagccaccatgcctgatctctaagatggtttttacacattttaatgatgaaggatgacttattgccatttaatatcagagtaggtagggtattattttagaatatactggtcagagttttccttttcaaacttaatattgtatgccactgagagcgggagtcagtttcatcaaagactgcaatatttagaaacaaaacagaaaatttaaggaccagtcataaaagcataagtaatcctagattaagatgcagagtgcttctggatctctgtggcactgaaatatgcattgacttctctgaacctcacttttcttatctggatatggaggtaattcaagactttattagggctaaatgaggtaaatcaaaagccttagcacaattgtagagtctgagtattaacccccatactgttttcccttctgtaagttctgccctctcctaatacttgccttctcacctccttttctctttaaagacttggatataaactgaacaattatagttgaaagaggggaaataaacacataactgtttctcttttcaagctagtcttggcgaaattattgccactattaattgcagatgaagcagtttacttaataatatgagggagttaaatcagagagataatttgaagtctgatgtcatacttcttcttcccttagagtcaggctattcctcagagatctttcttttcctaaacagatgagtgtaagctttgtgtgtagaaatgattaacatactggtggaatgccataggcttacacatatactttttcattttaattcatttttatctttttgtgagga

SEQ ID NO: 117374 - DNA, 1143 bp, Homo sapiens
cttttgtttagtaagaactagacaaaagactttttcactaacctattagatcaaaggccataactaaacccatggagtggctaggaatattagataaacgctccgctttcatctgaacctgtatggtccttgttctctctggaggttgtgaattctgttatcttccaatatgcccaggtttatatgtgagtctgaatatacatattaatcaaataattgattttaaaaatcaacggtcaaatagtaccttagtttctctactttagcaacataaatttataagttgattgtgaaattgggaattgaattctagatttcgttgtatttttaaggtatagtcctcgatggtctttataccagaatttctgttttcttatagaacaattgctggagtttatgcaccagctccctgcatttgcaaacatgaccatgtctgtaaggagagaactctgctcagtgatgatttttgaagtggtagagcaggctggagctattattcttgaagatgggcaagaggtaggtcaataaataaattacatacatttattatggatactaacttttaaaataacttaatttccataaatttgtcctgatttttgagtactgatttttgaaatttatacagatttcttaaataaatgccaagtttgagttagttacaatttctgaagaggtaagtttttgtttttgctttgccctaattttaaatttattcgcagtagactctgcacaaagtcagtgctccataaataatattcaatgaaccaaatgtttttacttctcagattacattaaatttaaatagatgaaatagatttaaaagattcttgaatatttttctatttgtataattatatcattattgtttaaaatgtttatcaagaatttttcttattccttatttctattatacatttaaaagaaaaagaatgaggaacatgtgttggtaccagtgcatcctagggaactgctgacagttgaagcgtttaggtgacaattctatgttcaaaaatgctcggatgacagcttgtggatgggtggaggaaggatgcaaagggattggaaggtattattgccatcaggaagtgcttcattatttttcctatcaaatgtactcatttgattaatgctgagatatca

SEQ ID NO: 117375 - DNA, 4293 bp, Homo sapiens
gaatgagaccagattgaaataatctgggtcaggggatgaaaaccttagattaagatgaagacagagtgatttaaaaacctgaatttttaatgcagattacacttaaaaattgataaaatagaaaagggatatactaggagtgagctctcctgcatattgagaaattaaattgtgtagaaaatactgctttaggttttttcccagtcgtttcttagattaaatcagtgtatataaataaggtttttggaaagtctttttagcatgtacacatatttaaatttaaaactacttgtctttaaaaaaggattataacctgcaaacaagtttgtggttctatgtattattcagaaatatactccgtttaaaccctgtaatttcatagccagtaaacaactcagagcgtactagtcagtcatgagatacagttgcccctatatgatcctgtcttagtccattcaggctgctgtaacaaaatactgtagactggggggtagcttataaacaccagaaatttatttctcactattcttgaggctggaaagtttaaagatcaaggcaccagcaagcagatttggtgtctggtaaaagacctctttctgattgttagaggtaccttctaactgtagcttcacagagtagaaggggagaatgagctccctcaggcttcttatatactaatcccattcgtgagagttctcatgacctaatcacttcccaaaggccccacttcataattccatcactcaaaataagaattttgaggaggtacaaacattcagacaatcgcagacccttaagaactagcttgtctaatttaaagatcacaatttgagtatttagtctagattgttaaatgactattacttaaagctgtgcagaaatccaaaggaagtataagacatggtcttaggaaacagatccagactcttctagttgtaggtgtcagagccttaacttgaattaacaaaagccaaaaggccagtgcctgtggtcctagctactagggaggctgaggctacagtgagctgtgatcataccactgcacaacttgggtgacagagtgaaaccctgtctttaaaaaaaaaaaaaagaagaaaaaaaatgtaaagccaaaaggttagtttattgaccaccagagaaagcagaggcaactctagcctcagggtacctggatgcttgcaggtacgtctgccccgtctgcctgtttctggtcttttggctccgtacggcttgcttatttttccttgcttgcttgctttgtgacactttctgtcacaaatgctctttgcagcacatgctgtgctctttctttctctgccctgcatgctctgtttctgttgctttgttgctctgagtctttgtttgactctcttgttcagtgtcctcctccccattccctttcctatttccctgcctattggtttcattttcttctgccacaggaaggcgtttccatgaggctataggctgcctactctcatattcttccaatttagcaaccagttaagaaaggatgctctgcttccagatctaattgtgtacagaaatctagagaaaagctctttctaacttagtttacatagctagggaacagggcactgtttcccactgtaatctctgggtttaagatggagaggaaaggtagtcctcaaaagaaggaagatcagctgggcatggtggctcaccctgtaatcccagcattttgggaggccaaggtgggtggatcacatgagcccaggagttcaagactagcctgggcagcatagcaacctcccccgagtctctacaaatatttaaaaaattagttgggtagggtggtgcatacctgtgttcccaggtattcagggcgttcaggagagaggatttcttgagtccaggaggacaaggttgcagtgagccgagatctgcagtgcacaccactacactccagtctgggtgacagtgggagaacctgtctcaaaaaaaagaaaaaaaaaaaaaaaagatgatctttttggcagtaaaaaagggtaaatgttcaaaacatgagatacttaatgaattaagattctgtagtcttcactaatattcatatttgagtgctttctacttattagggaattcttgtgtgttcactcattttttctataatgcctttaatacccatgctttttcattaacaagatgactcaagtgagtataatatttagaaatattttttaagaatctacttagtaccattttatcttctaaaagacattttcattattttctatgaatgactttttaatatatggtttttaaaaattttatagtttctttaaaatatgtaagactaatatgtttccaaattgtagttgtaagtataaggtcattttatagagttcaaaaatcacagctctttgcacacttttagatcctacagtaaagtattgggaaatgaagagtatttgttcagtcctttacgatgggtctattttagtgcattttagtactgttctttaccttactttaaacttctgttcttaatttatatgattacctaccctactaagcctaagtctctgtgatgaaagaacagtatcttcttcacaatacccagcatagactaataggtactcataaggtgattgttggtaaactttttctttcctgtacttcatgttttagtaaacttagtacttttaggaaatacaagtgttgggtggaaaacagatattaatacatttagtgatgtttgagtctcctgaccattttacatttactgattctgatttatcacctagttgtcacactgtggaaagatgagcctctaaatttggggcagaaagaaccttttataaataagtatcattttattgtattcttgatgcagcatccagcgttgcccaagtcttttatattttgtagggatgggtagttttgattaattcagactgtgacttataatattttttacatgaaatggtaagtgatcaagatttcttttcataggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattggtaagaaatatatgtgttcacaataagaatttgtaacttaatttatatggttacctatttctgcataacaaattattctaaaacttaataaatgtgtgttgtgttaagccattatcttagagtttttgtgagtcaaatttaggagcaccttagctgagtggttctggcttggtatctcccatgaggttgttgtcagaattgacacagggctgcagccatccaggtcttccctgggctgagctgtagaatctgtgtccaagatagctattcaaatggcctttggtgcatgaccttcagttcctcatgtgggcctctgataggctgcttaattgtccttacaacatacttaaggggaacttaggcttccccctaagtaagtaatccaaaggagaataaggcaaatgccacagttttttattatctgtattcaagagtaatgcatcatcacttctgctaaattctgtttgttataccaggtaactctgatacagtatagaatgggtctgtacaaggacatgactatcaggaggcagggatcactgtgagccatctttgaggttggctgccacaatatataaaataaaagctttgattgcattaaactgatttttcccttcatgtctataagacatttaaagcacaagcatagtacaatgttcagtgtctgtgaatttgctttttgaaaaacttgcagattttttaaaaccttatatttttatttccctagcttaaatatatgtatgttttgtgtgtactcttatttttttttttgagacggtgtctcactctgtcgcccaggctggagtgcagtggcgcaatcttggctcactgcaagctccgcctcccgggttcacgccattctcctgcctcagcctcctgagtagctgggactacaggcgcccgccaccacgcctggctaattttttgtatttttagtagcaatggggtttcaacgtgttagccaggatggtctcgatctcctgaccttgtgatccgcccacctcggcctccctaagtgctgggattacaggtgtgagccaccacgcctgaccatgtgtactcttaaaacattataaatttttttatgtaatattttacagaactagttaccatactttagttgggaagttgaatgatactaa

SEQ ID NO: 117376 - DNA, 1946 bp, Homo sapiens
gtgttcctatctttaggtccatgtgtacccaattgttagcgcccacttataagtaagaacatgcgggatttggttttcctgacagcagttcttaacaggaaaactgtttacactgttttatatggccaaatgtgtggctacacttctatgcatttccttcttgagagttttcatgtcttctggtctaaaaataaaagcccttggccctcaaagaaacttcaaaatatagcatgtactatagtgtggagggaaaaaaaggcaaatcaatgattccagtgtgaatgtgtttctaatcagcatagattaaaattttaaagtatacattaaggtgtaagagtgttcttagatagaatattttctgcatcttcaaagagtattcaagagaataaggagtacttctttctagattcctttttctatttatttcagtcttttccatgagctggaaaactgtgaaatattgactcttgaacaaaagcatgttgtctttttgttaactcattcttaaacaactccagacacacatttatccaccacctaccttttcagtttctatataggcagtaagcgtgttcttaaaaatcccaagacttcagttaccacctctatggcaacatgatttcctaatgcacagctcggagtgccaatctcttcagaactctggtgccacgttttcaccagtatgttcttttgtcaactcaagtcaccacatgttctcttacacctttctttaatatttctgttaagaatatcatctgaggctgggttcggtggatcacttgaggtcaggagtttgagaccagcctggctaacatagcaaaaccccatctctactaaaaatacaaaaaaaagtagccacgtgcggtggcgcatgcaccagctactcaggaggctgaggcaagagaatcgcttgaacccaggaggcagaggtgcagtgagccaagatcgcaccactgcactccagcctgggtgacagagaaagactccgtcacagaaaaaaaaaaaaaaaaaaaaaaaaaaaaaaaaaaaaaaaaaaaaaaaaaaaaaaaaaaggatatcatctgagtcctagtcaaaatctgttatcatcttttgactatcatttttaaactcccacttgaaataaattgctctgatttttaattactcttgtatttaaaaagctttaattcttcactgttatctaaattacactcttaattttaaattccaagccttttacctctaactacaatgtagttttatattttactgttcccccacttacacattctagattctgccccatcacatatgtacgttattccctgaacatgtctgccttttcctagtcttgtgttttaatcatgctcttctacccgtagcttcatgaagatgacattttcatgttatctcccatgtctttccaacaagaagaaatgtctccttccttggaatccctcagcagtttttctctcggacatgtcactttttctctctgctttttttggtagttacttgtaaacttgacatttttcatcaccagagtaaatttatggagtgcagagttgatgtcttaaatttgtatcccatggtgagtcaggcacagtgttggcatttaggaagtactctagaaattctttttttgcactgaattatatttgaaagtagaaaccaatattggcttcaaggaaaatgcagatctctgctaactaaaactttattatccagggcaaaagagacttgattttgcctgcctgccgtgttgtagaggttatgaaatgggtcaacctggactgaaagattaacttcatagagttctaaccctgaccaggaagacctaagaactaaatggtccatgaaaaggttaaatgaaatactaaagatgggaatacagaaaagagaggcactgaaagtctaaggcttaacacttgccctaaatttgaaaatgtggtttttgtaagttt

SEQ ID NO: 117377 - DNA, 1009 bp, Homo sapiens
tatacttaaatatgttatacttgtagatacagaatgtaaatccgagttcaagaacaccagttagtaacagtgtttttctactagtggtgggtttgtgggtagtttttattatgtttcttaaacgaacatttttatttatttaacaaatattaaggaggacgtaaatagattgtatagttaaaagttgaaaaaaaaattggaaaatatttaaaggagagtaaaaggaataaacacagaattataatagattgataagatataccctccaaagtacaagatttctataattttaatccatgggtaagagaaatgtctaactaaattttgtgtgtgtgtgtgtgtgtgtgtgtgtgtgtgtgtgtgtgtgtacatgcgcgaatgtttccaatcagatcctcgggaataaacaaggagaagaattaaatatcagtactggacccttgatctttcctttcaccttaggctgcctttagattcccttttggagctatgaatataccccttagttacaggtgtacattgccaatgtatgtatcttagcctgggatagctgaagtgatttgtctagttatttgaattttagcatttgagagattttttaagtgaacacctagcctttaacaccataagaaaagccttgtgaaatgatagaagtatttttaatttggacagttgaggggaagatatcctaacagcaatttttttttagtgtttctgcttttattcttctagaaatttagaaacgtttcaagtgaaatccagctttttttgtggggcagaagactatatatagattaatttgggcatttttttctaacgtggagtcttcttatccagaaaaatggatgtctccccaatttttaaaaataatttcaacttttattttagatgcaggggggtacatgtgcagatttcttacatagtatattgcgtggtgctgagtgtttggggttcgaatgatcccatcacccagatagtgagcataatacccattcggtggtttttcagc

SEQ ID NO: 117378 - DNA, 1011 bp, Homo sapiens
gtgtcaaatttgtaagcatgattaaagacgtgatctgtcttttgagaatgattaagtatggttcagcagagtatgaatctagtgttctctttcatttatccaggtgaatccatattaatatctaatgcttgttttggttaaaaaattagttcttggaataactgaacttaaacttataaaaaggctgatttttgttataattgactgtatatgtcttctgtagttagaagtcatgaagaaaattagagctgcttttctaccataaagcctctgttgtagtctagcgtgaattaaatagcaaattagtgagaatattgatggacttttccattttctaaaacccaagaggaacaatttcaaacctactgagcttttcagtgatcattgtaatattggggagaaggttctaggaagacccataaactgagagaatcctcacatgatcctgctgagattgaacccaagttaggttcaagccagggtaataagtatttcaggatccagatagtggaacttctatgatgtcttctttaatgcaagttgtaaggagcagttccctgggtgtggagcccagtggttgattttgtcagagatcatgagtatagaacataaaacagtttaaataaaataacaagaggatgcatgatattgagggttggtttgttaaggaattcaaatatattacctatttcagaactgtcaaatagaaatttaatgtgagccacgtatttaattttaaattttctagtagccacattaaaaaatataaaaggaaacaggtaaaattcattttagtaatatattttatttagtgcagtataaccaaatactataattacaacatgtatttaatgttttaacattatgcatgagttaccttacattacttttgcatattaagtcatcaaaaaacagagtttaatttaaagttacagcacatctcaatttggactagccatgttttaagtgcctaataaccacatacggctagtggctaccatatactaagaa

SEQ ID NO: 117379 - DNA, 1082 bp, Homo sapiens
cttcttggccttttagccttttctttaggaatcagaaaatattcttaggagaaaaagtaacgtcagaggccagatactgtgtgtgtgtgtatgtatgtatgtacttcaggttttctgtttgtcttagtactaggattcgtctgaattatctaacataccattatcagcaggggaagttcgtgatgtactttatgtgtaatttttataattacattaactcctcttgagataacataattcagactcagtcattccctcagaatacatttaatatacactatgtgtgtgtttctttaatgtttttcattagtaaagcaatgaggaaccctattttaaaaattaaattgattttgatagccctgaatagcaagttgcagagaaatcatttggaaaataaattagcatacttcttatgcaaaacttttactactctggaatgcagtggtttgtttattgtcttaatttctgtagcttgtattttgtgagatgtctcttttacggcatgaaatatattgtacagcctgcatacctggtaagaatgcgaccatattaaagatgaggtggtggagtcatttactttttgtgtttcttgtatacctgtgcctagtacagacattcattaaatcatgttgattactaagaaatctctcaggggccaactagaagctaattcaatattaagtgtaaagatgctcacagaatttttggaatatttaatgtaatcaacttgttactggtcttaagtcttgctgccagtagctgaacttgattccaagatattgctgttttattcttgtatcagtcaccattttttattaggagggagggagggagagtgagtgtgtgtgtgagagagagagagagtgtgtgtgtgtgtgtgtgtgtgtgtgtgtgtgtgtgtgtgtgtgtgtgtgtagggtaacattcctacccttaaatggacaggtctgatatttttatttgggaggatagaagggccaagtttttcctctgaaatatcattagtaatggcttttgaaaactgttcagtgagcttaccattgtaggattgtctaatagtttcagagagtaccatatggttc

SEQ ID NO: 117380 - DNA, 2409 bp, Homo sapiens
gacaaacctgttacggcatatatcatctaactgccatttgctcaactttttttttttttaaacctctggaggttaagaatataaagaagaaactttaatcttcaggatacaatgtttgcttttgatgcagaagaatcactgcagtgcttgttctacagaatgaaataagttgaagaaaagacaaagctatattacagagaggaaaggtttcacggaatccaggaacacagatttggtgcatgttgcctgatttgctttgactgataccgtattaactgttgtgctaccactctgcatgtctgtgccaggtgcctgaggccgcatgtatatgtctgtatattctgagccagaattgtaaacatcttcatttactgtgatttgcttgttaaagtgaacgttttaatttagaacaatactgaaagctcctgatttcagttttaaaaggggtttggagaggctgcctttatataaacactgcagtggtgtatgatttgtaaaaagaaacttaacagaattttatcaccgtactcatcactgtagctctggtttgaaaaggaaactaccctttccagcctaggaaatggcttttcttgttcgctgttatgccaattgtcttcagccatgggcctccaaagtaagtaattgttattttcttagcaattgatttaatccagttattaaattttattttgaactgtaaatgagctttattgcgctcttttctaaactttaaaaataagaactacaaagtagtctttctcattgccatttttttttaatttaaatatctaaaacattctaacgtgacctctaagagatttgaaaggtgcgttttaaatctgtagacttaaaatgcagtgcatttgagatgtactctcttcagactgaattattttttgattatggctattgctgtacttatcagtgatcatactctaacttgcttcattttcttaaatggttgatatatttaggtatgttagtctaattgccagattatatgacatttttcattaatatgatgctgtcataaattatgattgaattgtgctattttacaattgaattgtgctattttacaaagattagttgataattcttgagcagtgaaataatatgaagaaaatactcatgaaaatcaattatatgaaaatatttaaataatgattctaagtattttcaagatagtaaaccattagcagctggagactatttaaggtcatctatcatacttgtcatttttaaataaacataataactcacaaaaaagcaaagtgctatacaaccttccaggctaggttgtaggaaaatatatactctaattcagtgagttttattatacacagtggctatttatatagtctgtaatttgatgccactcaagttatctttcctgtctcatgtatgtattataaaacagtgttttttcaaaacatttaaattgtaacatttattaagattttttatggttctcttgcatacagacaggcacaatagaggcacttcttagtatggtctgaaatcatgtctttgtttcaaggttgtcctgttgatggtgactaaggaagaaatcctatgatagcatcgtggtgtttttctgttttatctggcctagctcactgcatgtctttcttaaaggcagcttctggaaagacatttaaattcactgtccatttggcaaacagctgattgaaatgtaaatagatgaaaagaagcctaggtacacaatgtatttgtgctattatctggctaaggcttaaatggcctttttagtgaaaatgacacctatatggcccaagcattgctgatgcttgatagctgcactatactacaaaggtttaaaccacttgtagaaaggaagtgagtgagaccgtgtaaaaaaaactttaaagaaaattaagaatgagatataggggttgttttttaaggtaaccagcaaaataaaatagcctttggaatgctgatagccaacttttgatcccagatttaacaaatatggaagagtcaaaatttcaaaatcagcttctaaggtttcatgaaatgccagcaaacattatatgagcaggattctggattggtactctactgtgtaaatcaagtatttgtaagagtacatgtctccatcccccttccctcatgttactgttgatgaaattttgactctggattgcaattaaacacataaaacttagaattttgttatacttcttttcattttccagtacattttactggttttatttttgttcatgtatttttgcctatgctactatgtacttgcattttactacttctgaattcattaattttcttgctaaaataaatagtcgtattagcatggttctactgggggttggggaagaatgaatcataaatgccttcctttatatttactcttaagataattgt

SEQ ID NO: 117381 - DNA, 1056 bp, Homo sapiens
tccttctttgtgtgttgatcagcatgatttataaaaagggggaaaggtgtgcattaaaattttgctttttgattcggctataatatattctgttggtactatacatgaatataattactgtctggtgttgaaattcttggtattcttgaatcttgctactgatatttatgtgtaaaatactcatcttttagaaattttatcttaagtgaaagtttgtcttcatgtacatacaaagtacctactatcatttttctgttttaaagaatgattaacattagattttaattaatgtacaatattaagtatcaagtggaattccaactcacgtatgattgatttaaattaaactgaaaaaaaaaaaaacacattggtgcttgaaaaccaacctgtataaatattgcatgttttatgtttagaaaactagtcatgcttgtttgcatttgtgagatttaattttatatttaaatgcgggtattgtgtattttggtattgtgtcttttggaattttggcagaaaaacattcttaaaagctttatgaaaatctaaataattacatattttgaaagcataacttgtctttgttcaaaattatacttagtttaacttaaattctagttttataagtagcagtgtaattcagattggcagcatagtgttgttcagaaagtgactcagacttttctcaaagatattgaagaacttattttttttgtgcttaacaacaagatgtttcttctgcagtcagtggagtcctttgttaaaagacctgtctcccaggtaacatctcctcttatgttgcacaccccattttccccaaaataaaagtgttaggtaaataaagcaaaataattatattgctttgatttgttcagtgattgtttttctcataattttgccgcctggaggtataactaactatattttactattgggaactgtctttctttggccactaggagcaaccattgcaagcttagttggagtatctaatgccttgtagcagaagcatgaagaacaaggatgggtactagtggtattgtgtttcagatggaagag

SEQ ID NO: 117382 - DNA, 1013 bp, Homo sapiens
atttaaaaatataataagtaaataaaatgcctgggttagtataaatccagtttttgttatcattagttttgtttgtttttcataatgcctagaatgtttatcctcttatggcttaccttcatctatggtaacctttctctgtccttcttttcagtgttgtcacatattaacataaaagatgtgtttacagttagtttagtaactatcagaaccttatctttggctttctaaacaatatgattttaagtatttcagtttgtatttttgtttataaataatatacacagttaacataaattttaataactacatggcatttacacttttataaaagtattttgtcatgatttgaatctttgcaaagtcaacatacattgctctattttatagtagtgcaaaagacctttctaaagctaaagatttcattaataagggttagcatcatggcatttcatatgcaggggaaacgtgttcataagtggctgtcctgtagtgattcctagacaataggtagatcaggacattctcctttgctgcacttaattcatttgaattgataagataatgagatgagatcgtgataaaattctaaaagtgatgcaagggaaaaataggttattcacctagtcatttattttagttatttgataaattactattctcttcaaaggatgtttatttcttcattcagtagttaaaaggtgaagtcattatttcctcagaatgctggtggatccccgtgttgagtatggaatttggcctgtttcttttcttagtattgttacacagggagatttagcatgataggttcactatacagttccctggaatcgaagatactatgagatgattggtagaaaaggaaaaggatgatgtcatcttcacttacaagccaaactaaaggaaaagagaattttgttcctttactgagttggtgtttactacagtaggtctaacatatggcactagtggattgcatttctcacactgggcagcagttttttaaagcagct

SEQ ID NO: 117383 - DNA, 1569 bp, Homo sapiens
actagactagaatgcagtggaatgatcacagctcattgcagctttgacctcccaactcaagggatcctctcacctcagcctcctgagtagctgggattataggcacatgcctccacacccagctaactttgtttttttttgtagagacggagtttcatcatgtttttcaggttggtcttgaactcgtgggctccagcaatagcctgcctcggcctcccaaactgttgggattacagatgtaatcaccaccacccccagcctctactgttatttttaatgggattttcccaaaatattttctgtctgcagtttcttcaatctgcaggtacagaacccatggacacagagggctgactgtatatatcttttgattaatttaaatattttaattaatttagatgatgctgaatgtttagttatgtatccttgtgtttgtgtttctcatgcagttaaattttttccaaaacattactttcaatattaatataatgctgtatgagtgtaacgaagtattctcacgtggcttccaatttttctcctattacaaacaacttttagggaaaaatctgtacatgactgattatttccttaggattgagttacagaaattactgggttaaaggtatgaaaattattttaagtttctacatgaatattggtaacttctcaataggcattttaaaattgtctttattattcactatgtataaaatgcttgagtactgagaggaccagagcagggcatgcccctctggttgtctggggcagttcttcctcccttaatggtgtgacactaattcagacagatttgcccagggaaccagaattaggaagactttttatcatacttgaaatattttatggagtaattgctaaagaaggagcttttgataattgtttaaagcaactcagatactaatgtataccagtggtctaagactgattatgacagtgttccagttggaaggggaataacaactactcagacatagcaaacaaattaatgctgacctaacgttattaccttttagtttgatttggtatgtgtttattaagtgtgctatcttgtgtatgtggcttttacagtgctagaaaatgtagtatttaaaagtagagaagggacgtaatggtcatctttatgaacaagggatataaaggaacccaggaattcacagatagttttaaatgagagttcattttttatcatttatatatgttactctctttttgaagaaaattaatacgctgtttgaaactttaggtttgcatatacttgagtaactatatacaaaatgtatccttttgtgcaggtatgaagatgcttgatacgcagtgtagacggaaagcagaagcatagtggtgccttttattgttctttcaatttcactgattctaattatagaagcttacatcaccttggttgatgatgacggtttctctctccttcttggtttttcttcctctattactccctaagggtggatcatatttcatagtgcatgtgtgtccagctggtggctgtgacagattttcaacaaaaatgggggtgatcagttagtggatatatat

SEQ ID NO: 117384 - DNA, 1019 bp, Homo sapiens
attgtggattttttttgggggggtgggcttctttcacacattataatgattttgagacctttccctgtcgtgtgcatcaattatattttttcccctctcttgtgggtattatttcattgtatgaatgtaccacaatttgtttctgtttgcctgtttatgaatatttggattgttccagttttgggcaattgcaaataaagctactgtaaacatttatgtacaaatctttgctgatacttatacttccatttctcttaggttaatacccaggagtgggtgactggtcatatggcaaatgtatgcttaactttataagaaactaccaaaattgttatttagtgtggctgttgcattttacataatttgtgttctttgaaaatgacagtttccacatcctcaccaacacttggtattgtcagattttattattattatttttaaaatttttaataggtagtggtatctcattttgattttatgtatccctgatgacttacggtgttgagcctcttttcatgtacttattagtcacttgtatattcatattcttttgtaaaatattcaaatatttttaaagtttgcaacaaatttaaatgtcttcatatagtttcagaaatttcagagctttgatctttgaggcagatgactttggtatttagatagcagaaaggtgatcaagagcaatatttagtgagcaggataagtaatcaagccaagtataaaaactccagtatttagatgagccatctatcttgaattcttgcttcactaactgaatgatgaggacagttcatctaaatcttcggtgcttcacctctaaaaatgacgatattgtaataccgggtttgcctgtcttagggggtggttgttgaaatttttagaatgtgtgtgtattcacagtctaatcactcaataatatctatagattcttcctttcacatgtttcagaatttgtgcttttcacttaatttgcccatgtcgtttctttagtgttcacttttttctttataggactgttg

SEQ ID NO: 117385 - DNA, 1682 bp, Homo sapiens
tgcataaagttttcttgttttactttttaacaattaactaaaaccataaccaggattgtttgctaagtaaaatatgtgtataatcaggcagtttgtaattagaggaactcaagttgtaattattgaatgtgtaggtgtagttaacagccttcatttctggtaagtgactttacttagaggatgtatgtttatgtgcacaagagagactgtttcctggacggaaactgtggtctccagatctttataataacatcacctctaatctttaactcatgagcgttgtgctatacagactgttttcttgaggcagtttcttgtaagaagtaaatgaagcttccttatgagtctgttaagactccatagattgtcaataatatggaaaaatttgatatttcatcaggaatatgaacatgtgtttcaggtagagaatgccaaagataatgaagatagtattctacaaagagaaattcctgccagacaatcccgaagaagatttcggaaaattaactataaaggagagcgccaaaccattactgatgatgtggaggttaacagctatctttctgtgagtatatttaggaacacttcatgaatcttccttaattttcatatctagtatctttaatttacatgtatctttggtaatatcaacatgctgggctctgtatgtgaaaatttggggcaggtaaatatataatctttttaaatgcttctgtttggttgaattggttaggaatgctcttaccagtgggagttctggttttgcttttttgttgttgtttaaatagtgaaaaaagttattaggctgggtgcagtgggtcatgcctgtaatatcagcactttgggagacctaggcgggcggatcacaaggtcaggagttcaagaccagcctggccaatatggtgaaacccccatctctactaaaaatacaaaaattagccaggtgtggtagtgcatgcctgtagtcacagttatttgggagactgaggcaggagaattgcttgaacccaggaggcagaggttgtagtgagccagtatcacaccactgcattccagcctggtcgacaagagcaaaactctgttgccaaaaaaaaaaaaaaaaagtaagctgtgtcttcaaaagtctttaattgtgaatagcttctttttagactgaaaagtagctgaatcaagaaataagggtaatctaaaaaaatcaggtgtatttttgaggggagaggtttcatagttaccagtttccaaagtactcacgatttctagaatattaaaacaattagtacagagcatttcctcttgtttgcatttgttaaaaataataataaaaaggatggttgaatatagtgaaattcccaaggatgtgtttagttttttcagttgtcataaacagatatttattcattccatgttaggtgttaggagtaagaaagattatttcgagagttgtttgtactggaataagtgttagaattaaggcagctctaatgtttgtcacatttgcctaattgcattgattcaatacaagaatatgaaatagtcctaaaatttatcatatccagagccacaacaaggtttatttcctgttctcactatttaacaatttctgtttttgtattgtaaatttcccatcactaattaaggtgacatattttgctttactgtgtaagtaatatgtgtcttttttt

SEQ ID NO: 117386 - DNA, 1355 bp, Homo sapiens
tgttagtccctgagaactgaatatgctggattgatattgcctatggttatattttaagattattagtatttttctgttgaacactcctgctgttctgaatggtcaagatctttgttatgaggacttttaatagcccttaatcaactgcaataattcactactagtttgtgatcaagacaatgaagtttatctttttaagtaaataatcagaatgtttgagattttagaaaaatcatggtatgcattaatgtaatcataaacttcacaggaaacatgattatggaagtttaatctttattctaaagaataatactgattagggaatttatcttttgtgtgaaagatttataataggctattgtaggttcatttttaggatttgtgagttactataacaaataaactacctggaataatgcttagcatatattaagcatcaagtaatttttggcttcttcagtcagaatacagaaaccataccgtaattggaacaagtgaagtttgatttttttattattatgattttttaaatttgagacagagtcgctgttgcccaggctggagggcagtggcatgatcttggctcactgcaacctgcgccttctgggttcaagcaattctgccttagccttccgaatagctgggattacaggtgtgtgccaccacacccagctaatttttgtatttttagtaaagacagggtttcaccatgttggctagactggtctcaggctcctgacctcaagtgatctgcccgccttgggcattacagtgctgtgattacagacatgagccactgtacctggcctgagcaggtaaagtttaattttaaaattaaactagttcaagggattagctactaagaaggataaagcagaataccctacagctgagggcgagttcccaaagacaaaacaaacttgaaagggagacagaccccttcctcacgactagagttgagacttggttgaagaatgttagttgcagcccaataaatagcagagacattcactgggttgctctgggacagagctggtccacagttgtctggtcaaggctggcaggaaggggaagggaactgctgaccaggagtggcacttaggagaccccccttaccaggatgcagatggcccctgaagctggggacaggaaacagaagccctccaattgcagaggaaagactttcttactgcagtgttactctagcaccctctgctgacaaaactgtaacattttcagctagcaaaggagaacatttacacaattctcatccttatcacaaagtatggcaataaagggtagatttgaagctgagagccagtatgtttggagaggcagtaaataactgtcacagt

SEQ ID NO: 117387 - DNA, 1005 bp, Homo sapiens
acaataaaaactgaatttgtttttcttattcagtttttcttagccatgggaccttaagtcagaactaacctttaactgtggttttgtcttcaataaaataggggtaatgatagtatctttgttgaagtatttcaaggattaaatgaaaataagtacctaaagcaaaacacagtgttgaggttgtgctagttagtaaagacaaaactcctgttatctttttgtagtttgtgttgatatttattatgccaaatgcttcagctgggtatggtatgttgtattatagtgttgtattatacaagtgaaaggagcaggaatcttgatttggcctaagctcctgtggagaaaacccataaactttctgaaccttgtttttttcttctgaaaaatgggctggctatctgtcctggttatcatatatcattatgattatatttataaaaacactttcgagtgctataaaacacttaactatataatattttaattaaacatgtgttcccaccacgaacagcttatccagtgacttttcctgggttttcatcaagtttctggttattgaccagattgataaaatataattattagagatttattatttattatatattttctgtataacataattcagctgttagtgtatgccaaataattatatcaggaagaaagaaaactgaaaaattagcattttgtaatactcaaaatattttttattgcaaactgatttatatattcagcaatttttttgtatgtacatgcctctgccagtaactgttcttcacactgaggattcagtagtgaatcagacaaatgtatattttttgtaatgaaaacattatttggtgtgaactgacagattttgacagattttgtaatgtacataaagagtattaaggttgatgccactgaatattacctatattattgcattatgtatatatataaaatacacatatatttctaaactctctgtagtttagtgacaacatactggtagatttggtcatt

SEQ ID NO: 117388 - DNA, 1050 bp, Homo sapiens
gtggcactagtctttattctgtgcccctctggaagaaatagtcttttatttactgtcttgttctggggaatggggcagaggtttccacttggctttttccattgtgacggcttttaccacacaggtcatggacccattatttagggtattctaactgccaagtatataaattctaattataaactgagggagtggggaatgaccattattaggtggatctgcagactcagtggacccactgtgagccacacttttgccatgactctctttattacctacattcagcaggttctggctgagtggttggtgcttttaccccgtagagcctcaattgggatcattcttttagttccattcaattggtagctctaagctgctctaggaaggcataacttacatatctagtaccttggtgttattccatgtggcctttctgcctccctaaggctagctggagcttcctcacaacattagtggtctcagggtgcttgaatcttttatacaacctcacttctatcgtattcttttggtcagaacaagtcacagagccaacccacatctgtggggagggcacatagattccaggttttgatgggtaactggcaagactgcattgcaaaagagcatatgggataagaaatacctctgtggccatctttggaaatacagtttaccatatcagtgcttcatctgctatctgctaaaatttggtagacctttcttttaacctattcaaatctttatttttatatacttaaatatctttttcactgttactttagtaaggatttagcagaaataaatgtggttgttcaattcactgtggttaattgacagttgttatctttggaattagagattattgccttttttttttttttttttcccttgagatggagtctcaatcgcctagactggagtgcagtggtgcgatctcggctcactgcaacttcttcccaggctcaagccatccctcacacctcagcttcctaagtagctgggactacagatgtgtaccacaagcctggctaatttttttaaattattttt

SEQ ID NO: 117389 - DNA, 1036 bp, Homo sapiens
ctcccaaagtgctgggattataggtgtgagccactgtacccagccgacttccctcttgaaagctacatagagcagctttcaagtgcattcagcgtaaatgattagcacctccttgaatctagcatttaaattttttactgccgaagactgtctgtaagacttccagtctgactctgtcagggttctttctttttttatttgtgactttatgcctaatagataatatagtacctcaagcttatcttgcagataattgacacaaaagccccaagaaacccttttccaagctcagcattacagactccacaactccatgctgtcctgtgtaaacaaaatgccataacccccacatcatatgaaaaagaattaatcagctcaccactacaaccattctttattctgttttgtgaatgcttagcattcttgtgaccctcaaactaggtacacaaagaaagggactaggatttactaggcatcttaatgcttgttgtctttcgctattaataggtcagacaatccagagtgacatagatcccacttataaacagtggttctcaaactttagtgtgcagaagaatcacctgtaggacctattaaatcacagactgctggtccctacaacccagatattctgattgactagatctggggtgaggcctgataatttacatttctacaaagttcctaaatgatgctgattgtgctggttcaggatctcacagggttattacttacatgcaacagaacccaattttggccaatcgaaagaaataatttactgaaaggattctgggtagctacagaattacttggaatactggaaaaccagacttggggctaggcttgggatactagaaaaacaggcttgggtctgtgacccttatcacagatttggtagatactactgctactagcagtgaatagtgagtgccacagtttgcactgtggaccacctgtactgtccattgcgtatgttgtagacccttgatatggtttggctctgtgtccccacccaaatctcacgttgaattgtaat

SEQ ID NO: 117390 - DNA, 2552 bp, Homo sapiens
ctggaattacaggtgtgagccaagttgcccggctgcttttaattttcaacattacttgtgctactaaattcacattttaatggaaaaatcctactgctctttaacagcagaattatttattttgaaattgcctattttattttttttgagacaaagtctccctctatagcccaggctggagtgcagtggcacgatctctgctcactgcaacctccgcctcctgggtcccggttcaagtagttctgcctcaccctcccgagtagctgagattacaggcacacgccactatgcccagctaatttttgtatttttagtagagacgggatttcaccatgttggccaggcttgtcttgaactcctgacatcatgatccgctcgcctcggcctcccaaagtgctgggattataggtgtgagccccgcgcctggctgaaattgcctatttttgagccttaggaaattttctaaactgttcataaagttatgttggccactgtgtgctgtgttaagtactttattgtgcttaattggaacagaagcattgttcaagggaatgctaaacagctgcccacagtacacagaatgtagccctgacatctagcagcataagaggttaactgatgcattggtagtgcttttgaatgagtgtagaatttgtttggggtaaagaagtatgaagaaggaaatctgaatcctagtgatgatttgtttgtgataaataatttgacaaaattctcccaagttcatttctgttttcagaaggtccttttactggactcccaagggtctattatgaatatattagctctatagttgcttattgggagtctagcagctgaaggcactagtctgtgcactatgttgtatccataaacaaagcaggtctgccctagtaagacttacattctgatagcatgaagagtggggaaggcagataatgaatatactaaaaggtaagttacataatatgtagcttataattgctagaaaagaaaagagcagagtaagagggattgaaagcaaggggcaagggctgggttgcagtttaaataaggtggttcgtttaacttggttgagaagatgatttttgatcaaagacttgatgcatgtgatggcattaactataggggtatatggagaaagtgctttcccagcaaagggagcaatcgttgcaaaggccctatgttgagagcatgttttgatgcattccagaaatagcaagcagctttgtgtgactggagaagggtgaacaggtgtgagagtagtaagagatgaaggaggagtggagataatgatgcatagcatagggcacatcctatttgacttttcagtgagggggagcactgaaagattttgaagcagaggagtgatattgacctacttaacctttttttttttttttttttttgagacagagtcttgctctgtcacccaggctggagtgcagtggtgcagtctgggctcactgcaatctctgccacctgagatcaagcgattctcctgcctcagcctcctgagtagctgggactacaggtgtgtgccaacacgcccggctaattttttgtgtttttagtagagatggggtttcaccgtgttagccaggatggcctcaatctcttgtcctcgtgatctgcccgccttggcctcccaaagtgctgggattacaggcgtgagccaccacgcctggcctacctttttgtttttaaagagggtctcactatattgcccagtctggtcactaatttctgggctcaacagattctcctgcttcaacctcccaagtagctggaactacaggcatgtgccactacacctgactaccttactgggtagtctcctggctgctgtgttgagaatagactgtaggtgtttaagggcaaaagcaggaggttaacggctgttattgcataaaatcaggttagagatgatggtcactctgactaaagtgatagtgatagtaatggaagtggtgagaagtggttaagttttagaaatattttgtagggttagccaacaggatttgctaatagatcagatgtggaccttgaggaaaagagaagaatcaagcatgacttcaaggtttttggcctaaataactggagtgttggagttattgtcagagaggtttgagctgccatcagcgagatgggaaaagctgcaggaggagtaggttttaggggcaagatcagaaattcagttttgaacatgtcaagtttgaaatgtctgttagaaatgagtaagaggttgcatatacaaatttgtattactaagaagcctgagctggagataacaattttatagtcatcagtttatagatattgaaagtcatgagactgggtaaaattaccaagtagtgagtgtacgtagagaatagaagaggaccaaggacagtgagtaccatgggacatgagatcagtataaggtcggggagaagagtagaaatcagcaaaggagaatgagtggaagcaaacagtgcagtaggagaaaaaccgagagagtggtggtgccctagaagccaaattaataagctgtaaaatagaaggggataaaatta

SEQ ID NO: 117391 - DNA, 2045 bp, Homo sapiens
agccggacttggccacaccctgggcttccggatttgggcacaacagttctctccagtcagaacgcctccccacggttctgccccaaaatgctatttttgctcaggtcctcagcgcgtttccggtgtctccaacggatggagaagacggaaccacaacgccaaggcagaccccgtgactgatttaggtgaggtctcgcgaggtgtctttaaatctcacgacgacagcaggaaacgacttactcgcaccgccccaattttaacgtcacagtggagttactcccttgggcgtttcttagcgtgcgcgtgcgtgctgcgcatgcgcacttactctcccccgcccccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggtgaggctggttgacctttatgtgcgtctcacagtccagtagacagcatcctcctgtctgtccgaaatccgcggcgactgccctcttgccagagtctcgcacctgctactgggaatctgttcgcttgagtctcttccctgacccaggcccttgtcgccagcagggtgccgaccgcccttcctgcctgtgatgcggtcttaacccgcgtacccgtccttgccgggggcttctgagtgtcgttaagaaagcaccattactaagtcgtattttctgagttgggtaatatgagtttcgcagttagatgcccattcgtttaagtagactatgaaaaacgagatggaaattgtaagggaagtatctcagccatgtaatttagaaatagtttttctttaaaggtctctgaaatattgtacagttgcctaaaaaaaagataaagttttcaaagttagtttaaaagtttacatccagtcaaatggtgaattctgtagtagatgatgcatgtttaaagaacaccactgtaggtactttttcagactgtcactgggaaattttacagtattttgtacttggatccaaaatttgctgtgtcgagttaacagttatggcatcagcttaaaagatttttcattcgaccttcatgaaggctagttttcaggcatataactaaaacctgttagctttgcttatcccggtagaatgctaaggttttggggaaggttttccttgatttggaggtttctataacaagtgggacatattttctaaacaaaacactaaacagtgtgagtggattattggattgttttgtttaaagttgcagtaaatgaaatgaaatgctttggttaattcttcactttggagtttttcagatatgtagtgttttgcatactgagtctcagtaacgttgggctgaccttttgggtcgtgacaattattcaggtcacaacggaagccatgataggtcaaattatgttattgaagatcctgatgtttgcataggaacaacacaaattctaccactttccagagttctctttttgagatatacatttataattcgatgagtgtttgtttccttatgatgattcttgaagtcaatgtgagctgatttatgaatttcagtaggcgaattatcttacagcctttatagcattggaaagtattatacaaggcttacgatgtgtattgcaggtttcaatttaatttaatttaatgttattttattttttatttgaaacagtctcactctgtcacccaggctggagtgcaatggcgcgatattggctcactacaacctttacctcccgggttcaagcgatttttctgcctcagcctccggagtagctgggattacaggcaggcgccaccacgcccggctaattttttgtatttttagtagagacggggttgcaccatattgcccagggtggt

SEQ ID NO: 117392 - DNA, 1078 bp, Homo sapiens
ccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaatatttctggcttttattaatatgtcttaattttgagtttgaaaatgttaagtgcaataaaaacatactagtacagattttgttttgttccaattggcatactctggggatgatcacttaaaaaaacagattttacataatgcctacttctggtagatgtcttatgagattgttctgctttttctaagttacttagatgttggatatgtacatagctgtttcttgttctgtatacatttctcaaatgtacacttgtattataataacctcccagttctaggggatatttgtgcaataaatacacatgtcaacttgatggatggtgttggtctttctttcatatattaaggtatacgtaacatggactgatgtctgtccagacatcagatgacagaagttatggactgatataacttctgtcaaacttagaagtttgacacttctaaggatgtgacctttcctcattggtatttccatattggtaatttaatagaatctacttcatgaggtggttgtgagaatcaagtgaaataatgaatgttaaggatttagctcagtactggcatactccaagtgctaaataatttttggctgctacttttaccagataatctgtccagccttcctcttgtggccccccacctattgttttgcgaatttttagcgtatgttcttatgaataaaaacatagtaacagaaaatataagagtatcttcttacagcgagcaacaaa

SEQ ID NO: 117393 - DNA, 3773 bp, Homo sapiens
tgattttgacttgagttatacagagagaattgttctccagtatttggaaaatcagtaacaggatataaccttgtttttctggggagtgagctgtgtgtttaatgcctttatgtaaaaatatttaagacaagttttaaaaagtaacataaatgtaaccaaaattcacagtgcattttggcatacaatgaaaagtaagtcattgtcttcttcccccaacttccaacccctactcaaacactgttaacagattgttttgtagaatttttaaatgaatattatttaaaaatctaagttgagttatactcttgtgtccttgtacaacttgccttttactatatcttgaatgttcatataagcacagaataatctcattcttcctaatggctgtctagcattcccttatatgttggaatttagattatttttagttttttgctactataaaccagtgccagactgaatataagtctctgacatttgtaggataaattccttgaaatagaatttttggttaaagggcctgtattgatagatagtttgacagattatactgaatactctccagaaagtttcaaaatgaattcccacaaacagtaagaggcactcttctcagtactggctattaccagatttgatctttgctaggctactatctaaaaaatggtatctgattttattcacatttctctaaccatgagggagtctgattaatattttctatgttggttggccatttttcttttcctataaatttgtggtaggatgtattttgaagtagctcccattacttccaatacatcttattatagaaacatttgaatccaaaacaatctgggtacacattattattctttgtttttttttttttttgagacagggtcttgctctgttgccctgctgttggtacatagctgacttcagcctcaacctcccaggctcaagagatctttctgcctcagcttccagagtagctggtaccacgggcacacaccaccatgcccagctagtttttaaaatttttttgtggagacagggtctcattatcttgcttaggttggtcttcaactcctgggcttaagcgatcctcccaactaggcctcccaaagtgttgggattacaggcacgagtcacctcacccagctattattacactagattgcagttgttagtcattgtgccatgccccagttcatgttccatcagcatgtcattgagacacttttctacgtttatgatgttgttactcgtatctgtagttctgtgttttatttactgagaatttttcctttcggccagagtggcctagctccttaaccgttgaggtatagtgaccttacagttggtggtcattgcctgtagagttcatgtcctcagtacagaaaatcaaaactgacatttttttcccctttatttcaggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttgaaaaagccaaagtgtacggtagaaatttctacaaaatgaatattatcaagagtttcatgtgatcactgcagtgttgtcacagctcataaatagcaacagtgtctcatgatttaatggctcagaaatagttattcattagtttttaatttttaatttctaaggtacagagatctataaaaccttgattatttgttagttttgcaattcaaaacagctaatgtctggttatttctcaaagtaagtattttaaacagcctgttaattataagaaactcagaataatgagtgtaaatgtgttatgttatccacccaagtgtacatatgtacctatttttttttaaaaagcagaaatagaaatacaagactggtaaacatgcctttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagtccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaagaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtacctttttttttttttttttttttttgacggagtttcactcttgttacccaggctggagtgcaatggtgcgatctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctcatgctattgttgttcctaaagctaagctttgctgggaagga

SEQ ID NO: 117394 - DNA, 1019 bp, Homo sapiens
ccagctactcaggagactgaggcaggagaattgcttgaacccgggaggcggaagttgcagtgagctgtggtcgcgctttgcactccagcctggttaacagagcaagactccatctcaaaaacaaaaaacaaacaaaaaatggttaaaagggcaaattgtatgtgtatttttgcacagttaaaaaaaaaaaaagacgctgtagaagctaatctttgatatgagccagaaaaagtttcacttctctttttagctaaaactacatactttaaaaatgtgctccaaattttagttcatattgaaataaacaaacagaattgtcaaaaacattatgttttggagtttgccatgactgagagttgcaaactgttttctgacctggttcttggttcctccctaactgcagtgtgtaatgcatcttgaagaccggttgcaggagctatacttcaaaagtaaaatgctgtctgaatacctgagggggcagatgcgtgttcatgtcaaggagctgggagtggttctggggtatgttaatggtttcttttttggctttgctttcattgccctgtcatcaggcaaggaattttcctcagaattgccctttttccttttacgtgtcttctcctattagaagctggaggctgttatcatttaggttgccctgtaccatgtaatagcaggttccctgtcatccactaatctgaaaggcattatcccttgtgccattacatacagtaggttgagaatataatcacagtgaattaaaatctgaatttttgtctcagaaacataagtacatactcatttattaaatatgttgcaaactcattattccaagtatctgccctgccttccacatgagctggttgaggtaacagaagtctgtagatggtaatacgttatccatatattactccttcccccccattaactatatattatatctgtctactctgcattattctctggcagaaaacagttatcaaaaatgcttactgaaggaggaatgggaagttggtaggggg

SEQ ID NO: 117395 - DNA, 1177 bp, Homo sapiens
gcggaggttgcagtgagctgagattgcaccactgcactccagcctggctacagagcaagactctgtctgaaaataaaataaaataaaatgtttgtctctttcagggtaaaaaaacattttctttcaattgcctggcacatagtagacacttaatacatttgtcaaattaatgaatgatcaaaagactgttgaaagttaagttctggactaaataatacaaagtccttgtaatgaatacaaagtctcaatctacgatgatatctataatatgtctcagggtatttgttaatgagttaattattcttcttggtcaaggagatattgaaatattgaagtttaatttttttttctgtttttgtttagtaaaccttcattgctgaattaccattatctttggaaacttcatttgctaaacataagatgaattattcttttatttccagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaattttgtaagtatgtgtaacactgcttgcattactttaagcactgcttaaagctttcatcattgttttttctgaaaaaaagctgttagggactgaatgtttgtgtcattacccgaactcatatattgaagccctaattcccagtgtgacagtatttggagataggatctttgggaggtatctaaggtaagattagatcttgagggtggggtgctctgatggtattagtggcctaagaagatgaggaagagaaagattgttctgtctccaccatgtgaggacacagtgagaaaacagctgtctgccagcaggaagagagcccttaccagaacccaaccatgcttgcaccttggtcttggatttgtagcttccagaactgtgagaaaataaatatctggggttttttgtttgtttgagacagtgtcttaatcccatcacctgggttggagcacagtggtgcagtcttggctcactgcagcctcaacttcttgggctcaggtgatcctcctgccttagcctgctgagtaggaggaactacaggc

SEQ ID NO: 117396 - DNA, 1056 bp, Homo sapiens
acaaagtgatttatccctggcaagagatgaataaatatttgaatactgttttataaaaaacaaatataaatttggggctccatggaaaatcttcccaaggtatatttttggacttttcctttgccattctcttcttatttctcaatatcatttctcacaaatgtagccatttgcatctacttctatttctgattcttactcttaccgaattatccatgttcttctcccatttttttcaccagtagtcctatctatacacttcaatgtcatagtcctatgtccctttcactgcgaaactccctatcacacagatcccacgattgccctcctctacttcccagcacttggtttctgcttcatcagtaacacattttttttaaagctagatgtatttattttgatctccctcacaagtctatgagttctgttgtctttgtttctttagtttccaggaaagagctttattcagagtagttgttcattaactaggcaaaggaatatcatttgaggatgccaaacctgggcttatccaggagtaaacttttgtccttattgtggtaccttatcctaattgtagtaacattaaaagttagagaggaaaagccattggtctcagtatttcatattatagttttaatctcagtcttgttgctgctattccatttggccagtagtaaaaaaaaatccttacctttccaaatacagaaaaatattaaaggtagggtcactatctgtttctggcagacatgctctgtacttaattgtcatttttggtctttgtttgtaaaccgggggaaggtaaggacatagccatatgccttgtggctctttcatgactatgtatatatgagtcaaaatattatttttcactgtcttaacatttttaacaatgaaagtaaatgcttgtgataaaaattcaaacaataagggctgggtgcagtggctcacgcctgtaatcccagcactttgggaggccaaggtaggtggattgcgaggtcaggagttcgagaccagcctgacctacatggtgaaaccctgtctctactaaaagtacaa

SEQ ID NO: 117397 - DNA, 2001 bp, Homo sapiens
aaagaagtaggtttctgatcattaaaaatagcttacttagctgtgtcagtaaaggacatgtccaataactgattttttccattacaggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccagatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtaagtaggaagttttcacctataatgggccctatataaatatgtaccattctcttttttagctgttctctgaaggttagtataaaagagatcattgttctggatagctctcttgttttcatattctcttaactcataagaaggagtaaaggctaagctccagaaacaccctggaaaggttttatgaagacctcaaataaaagttaaaggatctggttgataagtataagatttcttactgcttagaaggtttcaagccatttaggagtgacttatgccccccaaaggacatatgctgagcctggcagttagggagcactaatccctgagatgttagaatagctgttagaaatagatttggccaagactaagaggaaaacagagaatgtatactttgggtcaagtatgcaaggagaatattcatgcttgagaaacattacatacctagctttggacttgtgaggcatttaattgttttgttttagatgattgtt

SEQ ID NO: 117398 - DNA, 1050 bp, Homo sapiens
acaaaatgatgcagataaactgttgttttgagtgggtagatggataagctgttacctcatttagaatattttctttttgtacatgtagttgattatttgcggtatatttaagtacagcataccccgtagaaatgtggagctggaatgggctttagaaattatcatcgtatcctttcattttacaggtatgggaaacaaatgcttaaagtagggaaataatttactctagggcacacagtcactggtggggagagccaacaccagaaccaacatattttgagaacatttcccatggtactgtgttgttgacaaggaaagaaggacttggtccattgtctttcctcaaaagctttaataatctagatgtaaggaccaagctggcaatataaacttaaaattattttaagagtatgtaactcttggaactatacatttcataatgtgtcttcctctttttagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcagtatgaatttatttattataactagatatctagattgtaatcaaactcaattacagatgtggaagaatcatccattatctttggaattattttatattattaatcaaaattaataatcagaattctaaaaaataattaaatgatagggtatggaagagtattacagaaccttatgaatgaaaagcagtgaaaatgtctgtaattatgtaattaaaattcctgacatattgtagaattatctgaggctgcccatttttttgtgagttgtatccatttatagttttatttcatagaaaagaggtagaaaacatttaaggatggccaggcgtgatggctcatacctgtaaccccagcactttgggaggctgaggtgggtggatcacgaggtcaggagatcgagacatcctggctaacacggtgaaaccctgtctctactaaaaatac

SEQ ID NO: 117399 - DNA, 1207 bp, Homo sapiens
gggagcacactagtagtctcagctactagggaggccgaggtgggaggggtgcttgagctcagaaggtcgaggctgtagtgagttgtgattgtgcctctgcactgtagcaacagagtgagtccctatctcaaatagtaaaataaaaaacatcattgtcacatacacatttctcaagttattgtaaatggttcttacatatattttagtaggtctcctcaatttaagtaacagtttccctgttaggccatttctacttttgcacaattgttgctaccctatcgttaacatcttggcgaattttccagattattttttagaggagattcccagaagttgagctgataaaatcagtggctgtcaccagagttttttgcaacagtctgtggaagggaaaggatacaaagaggaatagtgagaggtacaactggcgaagttaatgagtacctgatgacaaaaaatgtagcgtgcttgccagggagttctgactttgtctttaaggctgtttgcaagttgtactttggggagattaacttggcagtgtgttttgtatatggctgctgaaacgagcacttggtagtgcgttttgaagagactggagtaagagacgagaggtgggtagacccgttagaatggtttagaaaggaaaggatgtatctcaataactcattagtgactaaggatgatctgcctttagagaagacatagatgttagttattcatattgagtatgtcaaaaaataaatagttcattagcaatacatttttattgaacaaatgagtaaaggccattttcatttaccttttcttaagttagacactgattacatttcttcaattggctgcactcacattttgtagtctagccaaagtcatcacacacagtaataagttgtgggtgaactgacatttttagttatttggagaagtatttcaaactttgtataaaacttgaaataggcattatagaactcattaaagattacttttcaagtgttttcatgttttaacgctttgataattctgtaacctaaagcagcagtccccagcctttttggcaaccagggaccctttgtagaagataattttttcacggatggggctggggaggtggggagttgccatggtttcagaggcattagattctcataagagtgtgcaacgtagatcccttgcatgcacggttcacaatagggtatgcgctcctatg

SEQ ID NO: 117400 - DNA, 1517 bp, Homo sapiens
ttgaggctcatgaagcaaaataaagtttaacttaacctatttgtaattttgttaaaaagaaatttgtcattatgcttagtcattattgacttatacttgttgttcttctgacttaacagcatctctcagcagcttgctgatcactccatttccttccccaaactcctcacttacccgaagttgtgccagcagctaccagcgacgttggcgacgcagccaaacaacaagtttggaaaatggggtatttcctagatggtaagttggaactttaaacacagaacaagattgagtagttccttaaacacaattttatatgggttttttagaacctggacttgtattctgtgtattttaagtttgaaactgaaaacttttaaaatttactacatttttaaaattgtggtaagttatacataacaagttacaattttaaccatttttaggtgtacagttcagtgacatttgtttaaataccttcatattgttgtgcaaccatcatcaccatccaactccagaactttttcctcttcccagctgaaactctgtatccattcaacgtaattcctcatttctcccttttcttcctcttgtaaccaccattctattttctgtctttatgaattttcattcataccttgtatgaatgaaatcatacactgcttgtccttttgtgtctgccttatttcatttagcataatgttttcaaggtttatcgatgttgtagcatgtgtcagaaattcattcctttttatgactgaataacattccgttgtatatacataccacattttgtttatccatttgtctattgatggacacttgggttgcttccacttcttaactattgtgaataatgccgctctgaacatgagtgtgcaagtatctgttcgagtccccattttcaatacttttggttatatatccagaagtggaattgctggatcatatggtaattttgtttttaaatttgtgaggaactgtcacgctgcacactgttttccatggttactgtaccattttacattcccaccagcaatgcacaatggttccaatttctccatatcttcaccagcacttattttctgtttttttgataatagccatcttaatgagtctgaagtggttcctcattgtggattttatttgcatttatctaataattagtgaagttgaacatcttttctattcttttcttttctttcccttttgagtcgcccaggctggagtgcagtggcataatcccggctcactgcagcctcaacctccctgggctcaggtgatccttccacctcagcctctcaaataactggaactacaggcttgccaccacacctggctaattttttttttttctttttttttagagatggggtttcgccatgttgcccaggttagtagaacttctgggctcgagtgatccacttgcctcagcctcccaaagtgctaggattacaggcatgaggcaccacatctgacttgatcatcttttcttgtgcttattggctatttgtatatct

SEQ ID NO: 117401 - DNA, 1113 bp, Homo sapiens
gtagaaaacttggaaaacacttttaaaaggcaaaaatatatattagccattttatcagccagaaatacctgcttttttgttttttaaagaaaatggggatcatactattcaaataaatatctcaatttattatagagaattttgaaacatacattgttataggcagaaacagtacagtgaactatgatatacccaccacttggtcccagcaagcactcatactgttcagtagcttgctttttttcatttaatagtatattataaatatgtcactgaatatgcttccaaaatatgacttttagtcactccttgcttctttagatattatgttttagattcttatactgtgtatcaaatcttcacagagctctcaaagcttgttcaactgagtaatagctcttggtgttgggttggtgccatgctattgaaaaaaataagggaatgcaatgagatgagcatgatttcgtttgctatttaaaaggagctgttcatccacctgaatagcaatatattttataactgacagtttcatctttatttatagttcacagcaacccaatggacatgcctggaagagagctcaatgaggacagagacagtggcatagcacggtctggtaatgtcacgttcttgtattcagttttttatgagattactgttggcattgattttcttttttatccctccctttattatcaaatttgttcatattgatattagccttacaagagaactgtgaaaagaccagagcaaagtcttataaatttaatatttttcatgtttacttttaagtgtgctaagtaggataaagccaggatgaagtaaagccagagtaaagtacactggttgaagcttagtgaatataagaagaaaagcattggtcagaaaaactgcttagaaactgtagtaaaaaaaaaacacgtttgcttatatttgcttgctgctaactaaagtttaaattgtcatattgtctcttgcccagaaaagcataggcattttgaatcaatgttatactttttttttttttccaaatatggacctgtccaaaatttgtaggtctagcaaacatttattgaaacatggtggacattaaaaaaattaaagcccagagtc

SEQ ID NO: 117402 - DNA, 1422 bp, Homo sapiens
acacttagaaattattgaggactgcagagaacttttgtttatgtggattacaactactgataaatactttattagaaattacaaccaaaaaattgaagaatatttagtaaatccttgaaaaattacactaataccccctttcatgttattacaggcctccaaaaaattagtaagaagagtggcattgttttatatttttacaaatctccttaatttgtggatgaggatacagctaaattctcatatctgcgtctgtattcagtcttttgtgatattttcgttgaagtgtatcaagaaaatcctgtctcacacagatatgtagttggaaaatggaggacttcgcagaccccctgaaagtctcggggacccaacgggtccttggatgacattttgagaactgctgaactgctgtaggattagatatatggagggtggtagaagagaattgattgtgtttaagtgttgacagaataaggaagttataaggagcatgaaattaaagactagaagtagtaattgatagaaggaggtttttgaagaagaatgggggattggggtcctagctgacttagagttaactttggaagggaggaaggaacttaggattttttaataagtcactagcacattgtaaggcttgaataacatgacagcttaggcaggaaggaggcaaggatggatgagagagtaagttttgaagcagggtgataggaaaaaaaagggttccaatctggttaattctactgtgtgtatgtgcatatatgcatgtgcatactctaggaaacaaaagttttatgctgagaagaagaggtagggaaggagtttgaagaagtagataatttttaaagtaacgagggaaagaaagctaggacgaattaaaaagctgaccattgagacatggaaggattgctgtacatgtgctgtaattatagaagttcttgctacagaaaaataatatctgttagcaatttgaaaactacagttggctggatacagtggctcatgcctgtaatttcaacactttaggaggccaaagcaggaggatcacttgaccccaggaatttgagatcaacttggcaatgtatcaagactttgtctctactaaaaagttctcaaaattagctgggcctggtggcatgcacctgtagtcctggctcatggggagggttgaggagggaagatcactggagctcaggagttcgagcttgcagtgagctatgattatgccattgcattccagcctacatgacagagcaaaactctgtttcaaaaaaggaaagaagaaacatgcaattgtcactttttaaaacagaaagccccgtattccatcctagttaaatgtccttcatggctatttagactattttcatgaagcataactaacaggtaacccagctgcttgctttcaggctataatgtcct

SEQ ID NO: 117403 - DNA, 1027 bp, Homo sapiens
gcctcccaaggtcctgggattacaggtgtgagccaccgtgccccagccaaaaggaattcattttaacaacacaaatccattattacttataaaggtaaattatactatagaggttagatatacttgtcttcacttttaatatagagtagaaaatccattttacatactactgactttaaataatgagcaacatttacttgcactcttttaattgtgaatcaaggattttttgtgtgtgtgtctaccatttcttattttctttcaatttccaatcaatcagtcaatcaatcaataagtatgtggtgagcacctgtaatataccaagcactctgcttggccctgaagatgcagtggtgaaccagacacagttcctgcctcaatggatttatagtgagtggaagtcagaaaagtaatacaacaattacagtatactatagtaaattcttagagttaaaagcagtgtgtgattaaaataaggagaagcactcaattcagtcctggagagtcaatgaaggcttccttgaggacatgaggcttaagcttgaaggattagtcagatggttaggggaagaaatgttctatgaagaagcagtggtacgtacacagacctaggggtaagagatcatagagtatggaaagaatgtgaataaatcagtatgtgtggagcacagagtaggggtaaagttaatgaaaaagaaagaatggagcaaaagctagatcacaaaacacactgtaggccacactgaggaatttagagttaatgcttggtgtagtgtagttgggcaccagtgcaggtgtgttggttcgggtcctttacctgttttttttaacggtttgccaaagacaggattaaacatgcaacaattgtattaggggaaatgactatgtaaaggaaaatgaggaaaatgctgggaaaggctgagagacccatcgaattgtgatgtaagtctgaccatgaatgaaggagagaggggtagaatgttgactggaagtgtctcagcccgctatacagttcaagggagggtta

SEQ ID NO: 117404 - DNA, 1093 bp, Homo sapiens
ttctcactcatagatgggagttgaacaatgagaacacatggacacaggaagggggacatcacacactggggcctgtcgtggggtggggtgaggggggagggatagcattaggagatatacctaatgtaaatgacaagttaatgggtgcagcacaccaacatgggacatgtatacatatgtaacaaacctgcacattgtgcacatgtaccctaaaacttaaaatataataataaaaaaaaatatatatatatttttttggctttgtgagccagacaatgggttgtagtttctcagctctgctgttgcagcatcaaagcattcatacacagtatataaatgaatgggcatggctgtgttccaataaaactttatttacaaaaagaggcagcagactagatctggcactccaggctatagtttaccaacctctgatttaaatgattatgttagttaatttgtaatgctaataggaagaaactgtttttgcacttaaaatttcatcaggatgtacaaagaattgtccttaaaccataaaatgaatttggaattaattttcttctcaccctccataggctacaagatagtcttgaattcatcaatcaggacaacaatacattaaaggctgataataacacagttattaatggactgcttggaaatataggtaaatggttcctttgattttataagtttaaaaaatactagcagggtaacaagtgttttttgaagttattccttaataatgcagatctgtcatgataacaaagaatttcaaatactgtaagtggaagaggcatttaaattgccagtatgtataacatttatttggaaaacatatttttcatatatttgaacacaatatttattttgtatctgataaagagtactgctgtagatatatctaatttgtcttcattgtttttcgttgttaaatttgatgcatctttgaaaggtgtcagtgataagaaaagcccttagtagttcttttggctatttcagctgaggaagactattacaccttcttccttctgtcttccataaccataaaagttattttaaaatgatgcttgtttttgtgacctgtaactcagat

SEQ ID NO: 117405 - DNA, 1597 bp, Homo sapiens
aacattttaaaaggaagaaaatcgagttgcagaacagcgtatacagtgtagaagtacaactcttaatgtagaataactatatcaagaatttttaataaaaatcaacatatgaaatagtcataagcttttaattaacacagtttgttaatatgtggttattgtttagggttctcggtgctcttctgatgccaatatgcttggagagatgatgtttggctcagtagcaatgagctacaaaggatccaccttaaaaattcatcagattcggtgagaggttttctgatttttttttaacgagtcccatttttagatattttcgtttttttagagagaattttatatgatcttcactcagattgagcttgtcatactccatttaacatgttctatggttttaatgctacttcatggctcttgcagctatgctgtgaaacctctgtgacttacacatttttatttataataaatccaaaaggtcattatattttagttttggtctctctctttctctttttcttcatagttcccctccacagctcatgctcagcaaagtgtttactgctcggactggcagcagtatttgtgggagtctcaatacgtaagtgcttatggatacagggggaaatgtatcactttagatgtgcaaagtatgaaaactaaccaactgcttttaggactgcagcacaagttcagattttctgtctttccttaagtttaaaagttcatggaagccagatttcactcttaattgagtttagttgagaaacatgagatgtggtttctgtttctgtgaattgctagaagcagtatctggaagtagaatgttgaatggatttccgtcttagggcaacatgctgatttttcagttttgcggtaccacgctgagttacctgagttaccacaatctgtagggttggtgctcttcaattttcagatcccctacgaaattaaccctaaagacaggactgacctaggtcagccatactgatattgcacatatacactatataatgatagccaccagggtattacaagctattaatgcaaagattagaatagtgaagctgaaacaaaggcaggcctggtgtcaggatcatgggccatgtgccagaacctagtaaattactggggctaaagttaggcagtggaagaccccagagagagattttgcaggtgccatatcagagcaagactcattggctagtcagagcccctgggggtaacccaaggtcaaaggcagcaaggaagctactccagactacagaaattctgtagagcccccattaattgttaatgccttaaaaagacctgtttggaagagttttattagctaagtttctaatacctgtaactctttggaaggaaagtgggaggtagtctttttttttttttttcgagatggagcctcactgtgtcaccacggtggagtgcagtggcgtgatctcagctcactgcaacctctgtcctgggttcaagcgattctcctgactcagcctccagagtaggtgggactacaggcgcaggccaccacgcccggctgacttttttttttttttgtatttttagtagagacagggtttcactatgttggccaggc

SEQ ID NO: 117406 - DNA, 1073 bp, Homo sapiens
gatagttctgtgacttcatcttctgatataaaagaccagtgtcttaagtaccaggtaagatcattgatgtcatttatttattcattcatttataattagttttgaacatcatccagtggactgtggagatataatagcaattagtccttatcttcctagagcttgcattgaagctggagagacagataaacaattatgtttatgaactttgataaatcttagaataggagaagtagaaagctataggcatagattgcatgagtattttctccttatatttcccaattcagatttattgggttatcagaataatttcttattttacatacttttttattattgaaaaatgaagataaatatactaatacagtttcagttgtatgaaattaaagtatgattggaagtatacataatacacagttttatttctcaaaagtaatgtgacttcttgtaaaatatggaattaaacgtattagtaagtataatacataggaacttctctctaaatgtattacattttatataagatcagtatttggtctcatgcttagcaagtgtcatctgatgtaaatttatctgtgtcatccaagtttgcattaatcacaagtattttatatttactcagtatcaaaatagaatcttgactttttaattactggtaatgagatgattgtgttttgatggaaattgatctttatacctaatcaatgggacaagctatgtgaaaagagtctgaaattactaaactccacttggatttactgcacagttccccctgccttcttctattccatctcccctttaggcatgataccttaacaaatccataatagtcctgtgctatacaacaccatcatgacttacaccattttgcacaactttgaaagttttgtgatttttaaaaaattagccatgtgggccgggcatggtggctcatgcctgtaatcccagcattttgggaggctgaggtgggcggatcacctgaggtcaggagttcgagaccagcctgaccaacatggagaaaccctatctctactaaaaatgtaaaattaggcatggtggcacatgcctgt

SEQ ID NO: 117407 - DNA, 1123 bp, Homo sapiens
cttgattgctctccacttttttttttttggcttgttttttgtcttgtaagtcctttgctattatttaaactgaaaaccatttcatttttcacatttccatattggagaaatagtaacaaaactacttaaaaatatgggttaaccttattatgtcatcttggtccatgacatgaaatcagtacatattttcattatgttaaatatacttatgtatatttattaagttaatgctttcaaaaatcacgagataactatattttatatatactgatagttaccagtattatttttaaataaagataattttgttttgcctttatttttactttaaagttttcagccatgaactggtgatatttaatataaagatatatatattatttaacaataagataattttgggctttattatatagatttatttctaataatgtatatggaatatttattaatgtaactctaatggatctttacttttccttacttttctttcaagttggcctttaccagagtttgatccaagccagattcgactgattgtatatcaagactgtgaaagacgagggagaaatgttttgtttgactccagtgttaagagaagaaatgaggacatatcagtatcggtgagcatcattattgatttggttgacttttaatgttgaacattttgataattccagtattatcaaactggataattggggctgagggagaaggaaatgactggatattggggctgagggagaaggaaatgtttggtgaatctaacattttgatttgaatagctgaggagtggtttgatgcttaggagtcatagaattggagacagtcaagcagacagttgaaatccaaggctaacttaacaaatgtgataagcatgacttctttgtatttagactgctgacaacagctcagcagaacttggctgaggctgatttttttttaattatctcgattattttttattactttttcagcaaacatttattgaagtttttttttttgtatttgatagtatcctattgaatttcaacatatgcctctcccttactcttaattttgattaatgctgttcattttgtgtttgttcagcttttctcttttatgttaaacagccctgtaa

SEQ ID NO: 117408 - DNA, 1154 bp, Homo sapiens
tatatggtgtatgactattttatttcccaacaactgctattctcttttttactctctactatccccacatcttaccacctttcccttacttgccttcacctgcttgacaaagaaaatggatctcttagatatggattccctccgcaccttaccttcatatctacaaatctttctgcacccatgtacatctttatctcctttctttccatcctagtgtgagagttattttctttgagctaatgctttcacttgtgctctatatcctgttctctacttcctcagaggccttgtatttctcctccacctcagattctgtcatcagcatatatgtaaacatgttcagatgtgtcattttttaaatagcagaatatctgtcactctcactctacttgaggtttcattttctttctctttttttcttaccagttgtctgttttctctgctcctattcactcttcagtcccctagaatctgacctctgtactctttattccttagaactgtccttgctatggtcaccaatgacttttgcttctctagtggatactttttagtgactcccgtggtagttctttttcttttctaaaatgttctttttcactggtttccgtgagacccctttccctattttcatcctttgtcggtctgttcctttacagtttcctttgcatggtatgaaagcacaatttagtagaaacagttcagtgtgatgcaagtcattgtggtttaaggaggagtctctggtttagcctggatgtctaggtaggtctttatcatttactagcacacagacatttactaaagattagacagaagaaaaccaaaattatattttctgtcaagaatttgggatgaagatgttttatgttgccggttacacatagtttcacatacgttgacagagttagggttaaggctctcttaaggaagtgaagaattgtgcctggtggacaacccacataatggcagaaaatattcacaaactgtacatttgacaaaagtctaatatacagaatctataaggaatttaaacaatttaacaagcaaaaaacaaccccaataaacagtgggcaaaatatatgaacagacagttctcaaaagaagacatccaaccagccaacaaacatgaaaaaatgctcatcatcactagtcat

SEQ ID NO: 117409 - DNA, 6426 bp, Homo sapiens
tcttcaatcaattgctatatggttattccttccccactgcctccactgaaactgttccagcaagagtaccaaagacaccaaattgctaaattccatgaacacttttactcttcataaattttggtctttctgcaacatttgcattgtgcgtgattcctttcttttcatcttcattaacctttttttttttttgacacagtctctctgtcgcccaggctggaatacagtggtacaatctcaatctcggctcactgcaacctttgcctcccaggttcaagcgattctccttcttcagcctcccaagtagctaggactacagacatgtgccactatgcccaactaatttttatatttttagtagagacgagggttcactatgttggccagggtggtctcgaactcctgacctcaggtgatccaccagcctcggcctcccaaagtgctgggattacagacatgagccaccgtgcctggcccatcttccttaacttttgtaacagtgctttaccatgagttttcttttcctctctagtagtctgtctttactgatcttccctggcttctctgcttttcttctctctgttcttaaaatattgatgtatcctaaaattctagtttattagttcttcacattcttttctattttcaattaatatgttctgcctgaagatttcactaccaattgtgtgtcagtaactcctgtgtctggaactctgttcccagccattctcctcagaccatttttctttttctttttcttcttcttcgttttttttttttttaagattgagtcttgctctgtcacctggtctggagtgcagtggcgtgatcttggctcactgtgacctctgcctcccaggttcaagtggttctcctgtcccagcctcccaagcagccagaattacaggcgcccaccatcatgcccggctaatttttgtatttttagtagagatggggttttgccatgttggccaggctgatctcaaactcctcatctcaggagatccacccaccttggcctcccaaagtgctgggattacaggcgtgagccactgtgcccggccaccagaccatttttcatcaatcggttgcacatcttttcttcagctgtctcgcagcccccttgaactcaatctggcaacacccttatcccaaacttactccccctcctgagatattctttatcttggttaatggtatctcctttcatgaaatctgaaagctgagagtcagccattctcatcctttattccccatatagtcttcaggtcctatctctgccttctaaataagatctagctctatccctttctattttcagtgctattccttagttcagggtatataacattcttttctccaggcttctctctatcttgtcagttcttcaagtttctgattttctaaaatgcacaagtgatcttgtcagctattgtttaaaacctttgtttactcattgcctggatgaagaagtctgtatgtgtgtgttgaactggttatgtctgttgatctgatgctccagcctgccttcatagctgtgcctgttgcttcattgcacacttctgagctagggtcactaagaattacagcagatgctgttttcttcttccagagaagagaatgcccttctcccctgcccatcacttgaagctgaaacttgaagtatcacttcctactcaataggccaaggccatacacaatgatttagataatggactgaaagactgcctggaatctaaacccagctttgacacatttactagctagctgtgttattttgggcaggttatttattatttattgtatgtcgtttatgatttttcttcagtaaactcttacctgacctgcttatgcacacctcttatctagattgtaagtttgcctcagtcatagcatgtatcacgttgataaaatcatttgtctgtcttttctgttagactgagcatttcatggtatggctatctttttcttttcatgctgaatgaacgcttttaagtcagtgaatgaatacataaagaatgtgacagagaaatattcccagtacctggcattatgctgtgagtgtggtaaatgtttaatatgtctgttttaggccggacatggtggctcatgcctgtaatcccaccactttgggagaccaaggcaggcacatcacgaggtcaagagatcaagaacatcctggccaacatggtgaaaccctgtgtctactaaaaatacaaaaattagttggacatggtggcatgtgcctgtagtcccagctactcaggaggctgaggcaggagaattgcttgaacccgggaggtggaggtttcagtgagctgagattgtgctaccgcactccagcctggtgacagagcgagactctgtctcaaaaaaaaaaaaaaatctgttttaatgagatgtccataatgtaatgtaacttgatgaatatagtattactttttttagtagtctttctcttttaaaaattgagctataatttgcatataataaaatgtataatttattttgaaaaatatatgcatctacttaaccacaatggcaataaagataaaggacattttgatcactctggaaagttccttagtatacatttctcctccatttccctcactccctatccctgatcactgctttgatttctatcattgtccattagttttacctcttctacacataaatagaattatcagtaggtgccccattgtgtctggattctttcatgcaacagtattttttgagttcatctttgttaccgtgggatcagtaattcattccttggtatttctgagtagtatttcaatgtaggaatatatcgtagtttgtttatccattctctgtggcatttgggtttaaataaaactgcagtgaacatttctgtgagagtatttgtgaacatttattttcatttttattggataaatttcctgtgagaggaattgctgaatcatagctgtcaagcaatattccaaaaatggttgtacacttttacactcctactaacaatgtatgggagttccaagggcttcatattattaccaaccactggtgttattagtcgtgtcagttttagccattttaatgcttgtggccattttttttgtttgtttgtatgtttttgttttgttttgaaacgatgtttcactcttgttgcccaggctggagtgcagtgatgcaatcgtggctcactgcaacctccacctcccgagttcaagcaattctcctgcctcagcctcccaagtagctgggattacaggcatgcaccaccacacctggctaattttatatttttttttagtagagttgggatttctcccatgtaggtcagactggtcttgaactcttgacctcaggtgacccacctgccttggcctcccaaagtgctgggattacaggcgtgagccaccgcgcccggccgtggccatgttttaatttgcatttctctgatgattaacactgttaattatcatttccacatactgattatccattcatatatctccttttgtgaaatgcccaagttgtacctgtacccttttaaaattggattgtttattgcttactgctttgtgggggttgttttggctgtttataagtttttatcagatatgtgcattgcaaatattgtcttccaatctctggactggtctttttttttttttttagatgttcaggtttaaaatttttataaagtccaacttaccaattttttattttatgcatagtaatttttgtatcttgtttaagaactctttgcctaacctaaggtggcataatcacctgtgtttctttatagaagctttataattttacctttttcataaagtcctattttaaattaacaaagaatacaaattcatggctgggcgcggtggctcacacctgtaatcccagcactttgggaggccgaggcaggcagatcatgaggtcaggagatgaagaccatcctggctaacaaggtgaaaccctgtctctactaaaaatacaaaaaattagccggacgtggtggctggcacctgtagtcccagctactcgggaggctgaggcaggagaatggcgcgaaccggagaggcggagcttgcagtgagccaagatcgcgccactgcactccagcctgtgcaacagagcgaaactcttgtctccaaaaaaaaagaatacaaactcacaaataagtttggtaataaagccttttttattattgctgagatatacttcacattccataaaatctactcttctaaagtgcgtgattcagtgttttaggttggtttggttgttgctgtttttgtttgtggtatatttacaaagttttttggtgaccatcaccactgtctaattccagaacatttcatctccccagaaagaaacctcgtacacattgcagtcattatggatttgcctattctggacaagtcatgtaaatggaatcatcatacgtagcctttttgtgtttggctttttttccttaacctaatgttttcaaggttcacccatgtagtatgcattctttttatggccaaatactccattgtattgacataccacattttgtttattcatgagttcatggacatgccttttaactttttaaagaaagcacatttgttttttcttcttctttttttttttttcagattgtggaatccattcactcctgaaatatttagtgcctatgatattacatttacttagggatatgtagttttactcatttaccaagcttgggactggggattcaaagatgaataagatcttccctcagggagctttttttttctagtggaagaaacaggcatgtgaacagataaattacaagacaatctgatgaagatactattagatttataatctaaggtaaagtgtaatcccaaaactcagtagctaactctgcttggaggaatgaataagaactttttagagtaggtgacatttggagctagatctttaagaataaataagagtttgccaggagagtgagaatatttcaggtagaagacatggcttgtacaaaggcatggaattgatatatcttggcacctttgagaagctcagtatgataattatgggtaacatgaaaagagtctggaaaggcagatctgggccagcccatgaagagctttacatctaagcaaaggaacttggattttattctttgggtgtctgggagaccaaaggagtttggctaaatgaaatggcatcactgcttatataaggtctgttagaagaccacatatccagtgaagcccaacttttcattttctccagaaaattttgtccatattaggcaccttttaaaaaatgaatgtattggccaggtgtggtagctcgtgctacctgtaatcccagcagattacttgaggccaggagtttgagaccagcctggccaacatggcaaaaccctatttctactaaaagtacaaaaactagctgggcgtggtggcacatacctgtaatctcagctaattgggaggctggggcacaagagtctctcaagctcaggaggcagaagttgcagtgagccgagatcatgctactgcaccccagcctgagagacagagagagactctgtctaaaaaaaaaaaaaaagaaagaagggaagaatatacctcccctcaacccaaaccattctctcactaccaccttctatcatagtctattgacttacctgaagttatcaagttaatttatttctttgcttagctactgttgtatctttcttccagagaggttcttttttatcttgccctaaccactgcttggcacatagtaggtacatatctgtatttaatgattaaatgagctattctacctctaatatcttaaactctaggatcctgccctgtgattatagcctcctattccttgtcctctctgcctcccactctccttctttgcgttttttcagcactttgaccgtactgcctccattttcttttgttattgttgtcccatcactacgttccctaactagcttagatcaattcagctgtattcttgtcagtcttatactccatttccatagccttccttttcttttgttccgtatacctatcaaaacccttaccttggcacagtctgatccaaattcaagcacatgaggtcctactggagaaaatcacctaactgtagtttgcagccagtacatcgtcctagttcatagtcttcaacgttatgtagatgtacagcattgcctggaaatcttatgttttctattcaacatacactcatgcaccagtgaatgatggggctctgttctgaggaatgcattgttaggcaattttgttgttatgcaaacatcacacagtgtacttacacacactagatggtatagtctactacacacctaggctgtatgataatagcctattgctcttggggtacaaacctgtacagcgtattgctgtgctgaacactgtagggagttgt

SEQ ID NO: 117410 - DNA, 1462 bp, Homo sapiens
gaccagcctggctaacatggtgaaaccccgtctctactaaaaatacaaaaattagccggacgtggtggcggacgcctacaatccaaggtactcaggaggctgaagcaggagaattgcttgaacccggggggcagaggttgcattgagccgagagtgcgccacttcactccagcctggacgaaagagcgaaactccttctcaaaaaaaaaaaaaaaaagtatatataatatgtatatatatatttatatttatattgataaattcaatatggaattattagatgatacatattttatttttaaatgaactgttttattatccttactgttacacttgtgtataaaagatgctttgggattttactttttttcagtaaatatatactgataaatgtttacatgttaatttaaaaagctcagaggaaagattattcaactttctgaaaacatagcatacacaataaataactgtttgccagggggcaaaaaaagctctgttgtcttctagtaccagttggtattacgtaggtttgtttgctgtctcatatcttatttatagaagtttggaactggaaactagatactaaacaaacagtaatgttccactgtagtttatgcattagaatccttctttgatcataagtatttttgcatatgcttccgtgaaactagcaacttcggagaaactggcaacttgcttggatcaaatccatttttatataccttaataccgaagcaatatgtagcacacctaaatgtactgatttgtttagataatatttgtaaaagctttgtaacattactaataagttataaattaatagaagataccatagcagttagagagcatgaggaaacatttatgggtatcatatgtctgactttagaagctttgcagactccttcctctcaagaaaagagcttctgttgggagaaatttcaaattccatgactgtgtttgttaaaatatttcagatatatactaaatattctggtgctctcagaatttgcaagtatttaaaaatcatactagtggataattttagttgtgtgtttattcttttattggtcttcagcagctgtctaaccttgctttcctccttgaacatggagaccaaacattgggatgacttcattttaactagaggttacctttattagttagcctgattactcttttataataacagagaacctttgtgaatgaatttttcaaaatcttacagaacgtatgggagggtgtgaaatgaaagataggtgtgtgactttcaaaagttgatctgaaagagctcttaaaaatctaagacttgttcagtgttacttttttagaggtaacataagatgttatatcggatatactgcctttacactatttggaaaataaagactattttggctttgttttaaaaatgcaaaggaggccagacgcagtggctcatgcatgtaatcttagcaatttggga

SEQ ID NO: 117411 - DNA, 1001 bp, Homo sapiens
ataaagaaaagaaatttataaggctcatagttctggaggctaaaaagtctgagagcatggtgctggcagctggtgatcccgtggaaaaaggcatcacgtgggcaagagaaaatgcgggtgagagcaagggggtgctgaactcacttttataacaaacccactctcgagataatgaccttaattcattcatgagggcagagccctcataacctaatcacctcttaatagtctcacctctcaaaattgttgcattgaggattcagtctctgacatgtgaacttcggggacacattcaaactatagcactctaatcccccaatttctcttttccagccttcattttagtttgtcctctagtggtagcctctaattaggaccatttgatgtttcttgagaataatctgtttcatgtgtttgcaaactgcttggaatactttggatgtgacgtattttacagctccaatagaacccatgtttttcctgtatttcttcattgtggcagatacttgcttgtgttttaattgcatttttatatatctatattaatacttcactagattgtaagttctataagggcacagcctttgtctaacttagtgctgtacttctggtatccagctcaaagaaggcattcaataaatatttgatgaatgaacaaatgaataaaaatagtcactgaactgaaaaagttctaattcatttaacaaagatgcttctgttttgtgttgcttgcctaaagttattcattcaatgagcaatttaagcagatttttctttgacatcattgtttatcaatttaaaggaaaattttatttattttgatttttttaaacattgcaagggtggcctcattttccagaataagtttccagaataagttttggaatcggttatgactcccataaataaggattttgtatgtattttgattaatttctagttactttagaatataaaacacaaactgcacatttgtaaaaaatagacattatttgtgaata

SEQ ID NO: 117412 - DNA, 1004 bp, Homo sapiens
gcagagtcatgtgctaaatgttgtgtttaactttaaaaaaaaattgtcagacttttccaaaatagttgtaccattttgtattctcagtagcaatgcatgaaggttacaggttcttcacaatctcttcaatattgatattgttatttttgttcttttttaattaaaaatttttattgtaaaaaaaatatgaaatttactttttttttttttttttttttttttagatggagtctcacttgttgctcaggctagagtgccatgatacaatcaaggctcattgcagccttgacctcctgggctctagtaatcctctcacctcagcctcctgagtaggctcctaagtatcctcccaccttggcctcccaaagtgctgtaattacaggcatgagccaccatgcctggccaaaatttactgtcttaatcgtttttttattcttttgattatagccattctagtggtatcttgtggttttaatttgcatttcccgaagatcatattcagcatctttttatataacccaggtttttgagtagactaacattttgttttcattctagtataccatgctttcattgctggaatccttttttgggtgttttgttttgttctagtcagcctaaattgttaaatcaggcttgggtgtagttagccattggcaactaactgtagctcagtccctaagaggcagttcctagagtaaccaatatacaaagctcagtaattgtaagccacagcaggactttagaataggagagacttccgataaagaagctttaggaacctttctgtattgtcttttatggttaccccattggaagagatggccaggaaatacccccttcccttgtcttcactctaaggtctcttaccatatcgatttctatgtgcttatctaagattcttgagctggagatgagtttgaaaaatattatggggagtgtattttttcagtcatttatagaattgagacagtaatttgttttctccatttcaagaatttggg

SEQ ID NO: 117413 - DNA, 1984 bp, Homo sapiens
ggcatcgtccccgcgccaccccggcgtaccctctgatggtcgctgacagcttcacaggggaagatcgagactgacccttctcccgctacacatccctagccaccttccagtcctgtcctctcggctcacgccccgcccctgccacgtgacgggacccgccagtgagcctatgggaggcagctccgccccacgcccccaccttgccccttgctccgcgcgccgccacgtgatgcggcccccctccagccaatgagtgccggccttgcctcgcgccccgccccgcgcgccgtggccgtttgaagtgactaatttctgtcatatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcaggtagggcgctgtggggcgggggtcgcggagccgatggccttgtgggctccgggctccaggggtgttggggccttcggtgttccgacccgagcggaagcgccgcgccgagagcagcatctggtcctcggtggggtggagccggctgcgggctagcgccgaagggttggagcgaggtcctaccttttattttaccccacccgcctcgccgttgccccttccccctcctcccgtcggtttgtttacgacctgcccccagccacgcgcgactctgctcctccggacctagcaccgcggcctgagactttgggtccacacgccttcctggcaccgagtagagttgggcgcgggctggattggacctcagccgccgtactccgggccgcgaagttctcccctcctccccgtgaccagttgtcctccgggcgctgcgttccagctccgttggcgttgtggagagagcggcacgtttggccaagcttctgagttgagagaaggctggaggagcgagtaggcaacgtgccgttctttcaggtttcttggacgctaaaattggaggtgtgcagtaaccggaccgagcgaccttaatgttatcgaaggagaaatgtgaaacttgagtttagggttactgccgaaggaagaccaaattgaatgaaatctggccttggaattggctgtagattcttcctcctcgaattgttactgaaaaggagtcttaaaaattgaaaatgttagtagagcattttgtagtgttacaggctttgttaatttttcattgtagtacctgttgctggcagagtaacttttcagaattgtaagatttgatataaacctgaattcaaggtaaaatttagtcgttaaactgcacctgaggagattatgtccaaacagcctttatacgtattgcagtgtggaaacttgcaaatataactaggctaaatgtcaaatgccacacgttttaaacttggtaggatagcaaagagcccagttgtacaacaatagtagaaacaaaaaaataaaataaaaataaaaaaagagaatctgtcaaattttggaacaggcgaagttgccacactggtttaagaaattttgctattcttaaaattattcactctctcttgctaatgcaggtctcatcaggaaaaattcagtaaatgcatatggaattgaagaggtttttctacgtatctgtcttttcccctgaaaaataaatgtgtcatgctcatctgtctctctttaaacatttctttagtgtttttcctttgaaaaatgaaagtgcaggttagataatactacattgagccatctagtaactcaagcgacaataggaaacaggttccgataggatatttaaaaggtggcatttgaatagacaactgctttctatttctggacaaagattgactttgggtacgtaggtttacaaggctctcaagtcactcatatgaaaaaacattttcacgtctggttttcaaaaatgta

SEQ ID NO: 117414 - DNA, 1028 bp, Homo sapiens
aaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctggctaatagaaattttttttttagagattttgctcaggctggtctcaaactcctgagctcaagggatcctcccgccttggcctccctaagtgctaggattacaggcatgagccattgttcccagccaaattcagatattattaaaacacatgtcatatttatatagtaacttacaaaga

SEQ ID NO: 117415 - DNA, 1021 bp, Homo sapiens
ttacaaataggccagatggagtagatagagctggcctgtacttgttcattccatgggagtaagtgggaatgattgcctgctaatggagcagggggctgaagcatccctggtagaatcagccagccatcaatatctgtgatgagtccccatcaagtgtcacagagcagcatgtggccaaggccagagggctcctgagggagaagagatgacaaaggcctagggtggccagggcaggggggaaagatggggaggatgttgcttgacagaaggcaggagacagttcagatggctgctggctgttccttgtcctctgtttccatccctgccatatccacagtggctttcctgatgggtagtgcaccttatctccgtatgcctggtgacagcttcccatctcctgattcctcatgatgtggctgagagaagccatggtttttgtcccatagatatgtgtgagaggaccaaatgtgttcaaaggctacttgaaagatccagacaggacgaaggaggccctggacagcgatggctggcttcacactggagacatcggaaaatggctgccggtgtgtatgtttggaaccacggagctccaaacatttggcagtgggagggtgtgtggtccgggtcactgaggcaggagtcttctccaaatcccccctgacaatgagtcattcaggagcacctctggggcctggggggaggctcttccttccctgagccccagagcatcttcctcttctcactccgtctcatgaaggtgatgagggacctgtgcaggtgggtgtggctgaggtcttggagactgaattcctatccttaatggtttccagaaagacatctgacagtgtgtggaatctgatgtgaagtaggaggaacagggggtacatgtctctaggacgtctgagaagggcaaggcctgcaagccctccaatgctggcccgcagccaaaaggtggcactgagtgaaggggaaagcttggagacaggagggagaatgccttagttcctgtggctttgccagc

SEQ ID NO: 117416 - DNA, 1114 bp, Homo sapiens
gggtcagagggctcagaggactttagccaccccacttgtccctcctgggagcattgttccagggaagcccccaggcctgccctgtcttacccatggacacactcagctgagagagaccccagctgatagcatcttctcagagagtattgcagctttgcagaagtgctttaccattcaagctctgtgcagtacagctccgtttatgaccaaaacacttatgttccataacttttataattcacaaactcctaaaagagaaaacaaaagagtaaagttggggaatgaaactggcatggctcttcaggctgcagatggggactggcctgaggctggccctgagacaggccttgtggaagtacagagggagtgggaggaggaatccatatgtgattatggagacaaggaattctccatatatgtgtcactcaagggaccagcatatgaaaaaactgtgtcttctaggcctttcccattttgccttgggggaggtcttatgtaatagtgcaggtaaggccgtggcatctggagagcatgctttccagctttccagacctggattcaatgccagcaattactgtaaattagttttgtgaccctgggcaagtcatgtaacctctctgagctttgtgttccttacctgtagaaatgccacttcccttatagggttgctatgagcattaaagaaaggagcatatataaggcccctggtgtactcctagtcccattaggaaccagccaggggctcccccttggcctcgcactaaacagcacccacagccaacttcagcagcatctccagtactcatggggcttacacaccttcaccttcccagaattccctggggaaatccaacaactctaagacctggagcagacccattagtaggctgtagtacatctcaaaggcctgagtccccagggaggcccatgtccagggtttgggagtaggtgaggggggcacacgccagtgagaatggctgctttggcatctcccagaggctcaggattccactccatcttctgcttcatctccctgtgcctgagtgggacttggttggaaggtgagggggtgggggtcacctcagatggcattcatcagtgtctcatggcagca

SEQ ID NO: 117417 - DNA, 1154 bp, Homo sapiens
gatgatgccaatatgttagaagcagtagggaaaagcaggtgtaaactccttgcaggcagggccaggttacccttcactggagaaccctgtgtgctgagaaccagtgcagcctggaatagaaggaggtgctccagaagtgtttgttgaatgaatgaatgaatcaactagtgaacccacagcttctgggtgaccagttttgtggaagagagtcttctctgagggctgctgcttccttagagctccaaggttccagtcacctgacagattgggagcttgggccactctgccaagcatagatgagaggaattcccagtcaaggtcctcacctcactggatggtctggtgtgatgctcccattccttgcgttggcctcgccagagttcccactaaccatccactgggtccacagattggtggggttaggggagtgctgtggatgagatgctgctttgagcccttggggttgtccttcaggatgcccaggggtggttcctcatcatttgctcggctgcctcgggagatccgtggtaggtgtggttattcctgggcctacttcctttgtgtagctcctaattcatgtgaatcttggggcctgggacaggcagaaatgggaagatgggaagtggattggaacagaaatttcaagccaagccgagctatctattctgagacccaaccaatactctcagagccagaaggatttcaaatcccaagaagtctcacctgaccctatttgccagctcttcccagagatacccttcctctccctgcacctaagccaggcatgtagtaggggcgtctgggggagttgggaatggcttctgatttgccatctgcccatttaagcttgtgttccgagatcactgtctcctgggaatttagagcaggaagccaggccagtgagggaacaatcagcatcttagtgctcagcccctggtataagcaaatgtgggctggcacctgttagggccaggaacagacttagtaattgatagctattggagaaatgagtgagtaggtaggcccaggttgactgggcagctctgggacagaccctattgaccagtgcctgggaccccgcctcactctcagcacagcctggcccaccagtgcaggatgtggattccaagggactgatcaagactcagctctgc

SEQ ID NO: 117418 - DNA, 1036 bp, Homo sapiens
cggggaaggtgactaccgaacaagacatgctgcctgccctgtgcttgtgggctgcaagtggggtgagtgtcttaaggggtagtgttggtgttggtggcctcagcttgggctttgcttattggccttagattctgagctgggaggcaactgctgccaaatttgctgagactgtctcccttcttaggtttttttctgctgttattaccatccagccatgtaatgtccatgcagctggtaaatgccaaggcagctggttggaaacactcagagatacacaggaagctgaagaaggcctgaggacgaatagctgcataagcaccataggtccaggaccctctggcaaggcttctgagggagcagagtggagagctggaagcagtgaggggaaagagtgtctcaggcaaacaaggcccatatggatggaggcacaggctaaaaccagcatacgggtgtgggggctggctcccttgtcacttgaagaaagggaggcctgtggcacaggggccagaagatgaggctggaggctgggaccaaactgcagaggctcaagcttgagccttatcctgggagcagttgtggtgagcctcggagaggctcaaaccaggatatgacaggaagtgtttgtaaggagatgagtgtgtagcccccttggagagttttgaagataaatagtgataggtttgcagataattaagcaaatggaaaagaaaacaaggcagttgctgaattcaggggaaaaaaagttgtacaagaaaggaaatgtaagtataatctactagatggctcaggtgtaacacatgatataattatgtacacactgagtattactttaactaaaacttatgatttacctgtactggaaaggtgggaggggatgagtttgtgttttaggggtagaataaaagaattccaaagttgaaagtcaaggaatagaactataagcatcttatctagaaaaatgaggttaaatatcagaagaaacagctagaggagtttaatgttccctgggagtggagattagggatgggaaggagag

SEQ ID NO: 117419 - DNA, 1019 bp, Homo sapiens
ctggtctcaaactcccgacctcaggtgatccgcccccctcggcctcccaaagtgctgggattacaggcgtgagccactgcgccctgccattctggttcctttttgatgggcccagtgctagtctggacttttgggatgggtgccctggagggttccctccttggcatcagagtgaggagatagccttagctctctctagatgagagctgcctttgtgttctccaaggcttaatggcctgattcccacctcttgcctctgttttatccataggttgtagggtttatctttcacatgaggagcagtttcctctcccctctgctgagagccagctctaaagaggcatagaggcagtaaagtaacttggagacagaagcctgtgtccattttttccctttatgcttttattgtgtggttattacatgctggggattgtgctgtgtacatgctggtgagcagaacatatgtggtctctcttgtgcttgaggtccaatatgagagacttattttaaacatcagagagattcttctttatctttttttttttttttttttgagacagactctccctctgttgcccaggctggagtgcagtggcgctatctcagcttactgcaaactctgcctcccaggttcaagcgattctcctgcctcagcctcccaagtagctgggattataggcgtgcaccaccatgcccagctaatttttgtatttttagtagagatgaggtttcaccatcttggccagactggtctcaagctcctgacctcaagtgatccacccgccttggcctcccaaagtgctggcattacaggcgtgagccaccatgcccagcctaaacatcagagagattattatgtagttatggagacaggtgctgtgaaccccaggcttggggttcagtggaggcctctctttggaagtaacatatcagttgagacttaaaagttgagtggaaattagctggtagaacatggtttctggcagaagagagagtgtatgtagtcctgtaagagaaaa

SEQ ID NO: 117420 - DNA, 1054 bp, Homo sapiens
tgcctggctaattttttagagacaggtctatgtcatctaggctggtcccaaactcctggtctcaagctatcctttggccccccagagttctcggattacaggcatgagccactgtgcatgcccacctgctgggacttttgttttcttctgtggtgtggtgggagggagcagctgctggccatgaggtgagtccagtgtctgcagacagccagactgggaccgaggattaggactcactcagctcagggcctgttactctgtgctttccagacaccccgtagacagaagaggcttttctgtaggtaccaccatggcaacagggccccacagctgctcattgcccccttcaaagaggaggacgagtgggacagcccgcacatcgtcaggtactacgatgtcatgtctgatgaggaaatcgagaggatcaaggagatcgcaaaacctaaagtaggtgtcactgtaggtccttctcgggtcactgaagggggaaggtcctttttctcatccctagcactatgggtggttggtttgcccatctagccaccctttatccatatctagcatgggcctaccgtggggatacagagatgcttcagactcagcctgaccttgtgagttcatggtccagtggaagaagaacagggtaaccaatgtggacagccaagtgctatcatagaaggtcacgctgggaacagggcaggtctacactggtgtgtcagttcacctggttgggagactggtgcgtgggtgagttttttggaaatgttccataggatgctatgaagctgggtcctgtggagctcctgattaggactgtaaatgaggtgaatgacttagaggagaatgtatatctttataatattgggtcttctcatccaagggcatgacaggtctctccatatctttttaagttttcttcatataagccttgaacatttcttaagtttattccttggtagtttctttgttactgttaatttactttatttcttcattattatttttaactggttacattattttattagtttactattatatgccaaactattga

SEQ ID NO: 117421 - DNA, 1516 bp, Homo sapiens
caccctaaatcctgcatctccctatagctgcttcttcatattggcttgaaactatcttcatggtcactttccagcactccctctacagcagatgacctttggtcataagacccactgaactgatactcagcaaggtccctgccacttaacagccaaagctggcactgcaaccttggctcttggcctcccttggtgtctctcacaccactcccgctccctctgtttctcctatctttagttcattctcagggttattcattgtctgttctttctgggtaggtgctccctggagctctggccttagtcatcttctccattctttcctcagagttcctgcaagctattttcctcacccatggcttggttgccacctaaatttatgttttttatattcagctaatttttccatcctctagactcatatggcaaactgcccaccagacatcttcttctctgtggtccacaggaccttcccactgtcctcaacaatgcttcctggtgggtttctggggctccccctaaaaaggccccttcccacttgggagatggggaatctgaggctaagaggtggctgtgaaccccagtccagggcagggctgggccatctgtctgtgctcactgtgtcagtggccctttaggatatgcagtctaaatgtccgatggagttctgcttggtgatgccccctatccagtggctcaggctttccttgaagtgggaatctctttccctaatccagaggctctttggagcctgacaatttacttcccctgctgtaggaaccaagtaccaggcaatgctgagtgtggatgactgctttgggatgggccgctcggcctacaatgaaggggactattatcatacggtgttgtggatggagcaggtgctaaagcagcttgatgccggggaggaggccaccacaaccaagtcacaggtgctggactacctcagctatgctgtcttccagttgggtgatctgcaccgtgccctggagctcacccgccgcctgctctcccttggtaaggagattctaggggaaggtaagatgggaatggagagtggcagaggaactgcactgtgctggcatctgcctgacccctctcctgggactgagtcagtttaccctgtcacttggccagtgactaatgccttactgactttaggaccagtccagcttcttactagctccttacccacctcaatcctggccttaggtttgcgcagtcgctgatagatacgctcaggcctgtggcacttgtgggcctttttaataaggactctgttatggtgtatctgtcaccatgcaggactacacagggtggaacctttactacatcaggagcagctcaggagtcaggttgtactttaggattgttacagtgacaaacagtagcggtgctattagaggcctgaggtctaatagtaggacttcatatggcattgatactttgtgtgccttgtgctgttggactgaagaaggccaaaagcactgtgcctttaaaactcatctaccttttt

SEQ ID NO: 117422 - DNA, 1099 bp, Homo sapiens
cctactctgtcttaagcaagctgtgggcatagttatgagatgggttggaggttggcctttcccacattgtggggcacagtccctctcggatgctgcctcctcccaatctgactctaattagaggactttttgtacagagccttttgagttaaggggcccaggcttgggagaaatggggtagggctccagagtacccctgccagagatgtcagtgttgatgtggtagtctgggagctgctgcttggaggtgcccagctctccaggctagcagagttagttatccccttctcccaccagagcaagactttgcaggctcttggtaggtaagtcatctgtaattacctgtgattctttgaggctctgcccaaaccccatctgtgattctttgaggctctgcccaaaccctatctgtgattctttgaggctctgcctccaggctgagattcaagaatgggctcagtctaagccagatcgcacattccagagaaatcacagctggtattcatgtaatgaagaaacctggctttccctgagtgttgtgaggtatgaaccgtagatgataggagcagaatgatttgaaaggaatggacagacttcctccctggaatttatctggcctctaaaaaggtatgcaactgcaactggagacacacctgggtagagatgctgggttccccacttccaaccatgtctggtttggaacctgcctgggccctgttctcccaccaccccagctctgaggagcagtcagctggtccctttctgatcacagatacatcctcccagctctatgttttcactgtcccctccctacatacatacagaaggtgctgagcctgagccagtcaagccttttgaggaacaagaaacagacacccaatcccttaggtataaggggcttgtgtaagcaagagagaagccttctgaaatcctgggatagagaagacagtatagtaaggccttggagcagacctgtggctagaaccaggagggcctggactctgcctcagggcaagcccaggcttactcactttctcttgatgacttgctctcttctgctgctctaactccctaatggaccccttagcacaatacgccc

SEQ ID NO: 117423 - DNA, 1078 bp, Homo sapiens
ttggttcagagggctcctcacacggcaggatgggccgcaggtgtgccagtcgggcccatgaggaggtatctgagctggggcagccccatcccccaagtgggccctccatccctcctcgggctggagcaccgcccctaaaagcgacttcaaagggccggtgtcgacagctgggtttgggtccgcggcctgcagatccaaggcccgagcaggatccaggccgtcggggccgtccgaacgcggggatctctgagagctgagtgggggtgccgggttgccggcagccggggctgagggcgggtcctcagagccccccgaagtgggagggtcgggctggccgcggggccaatccaggcgcacagggagcgggggcgggggctgggccgagtggggacaggggcgggcgggccgggggcgggcgcggcgtccaggcggcggcggcggctgcggcggcggcggctcctcctcagagtccggctcaggctccggctgcggctccagcccgcgatgccccattccgtgaccctgcgcgggccttcgccctggggcttccgcctggtgggcggccgggacttcagcgcgcccctcaccatctcacgggtgagtctggcggctgcgtggcggcagggcggtcccatgtctgagaccgggttctcgcggtccgcccgggacccagatcccctgtgtatccgaggcttgaaggcggagggttggcctgggcgccccgcatgctgtagaggcggcttccaggcagaggcaggcagccccagccgccctcctcccacgctgggcctgtctgcccgatcccgcgaagaatctcccaagagttcacgcacccgcctccccgctggcctcatctgggggagccactgtggacccgggaaggacccgcggagatgggccaggggtctagacagctctacagaggcccagaaactcttcagactcaccccctgcctgaagatctggggcaaaatgatttagagccccccttcccctatcaggggtccctgccggcagagcttggtgacccagggaggtctggggtcctcgctgaatctgagaagacagaggtccatcc

SEQ ID NO: 117424 - DNA, 1039 bp, Homo sapiens
acagagatgccttcggtgccatgcccagaacccatcttaacccttgatccctcaaatctcacccagtcccactctgacccctgacacttgatccttgggtcttagctggttgcattctgactcataagccttaccagaccccaagtccacagggtgaaggctggaactgcatcccttcctcctctatttctttctccctcccagcgctgacccagccagaggcctcccgcggagccgggactgcagagtcgacctgggctccgaggtgtacaggatgctgcgggagccagccgagcccgtggccgcggagcccaagcagtcaggctccttccgctacttgcagggcatgctagaggccggcgagggcggtaagacgcctgccacctgtccccatctgccttcccactccctgcagtgcccaggttgccccctagcgaccccacgtcccgcctcgcagtcacctgccctcttcggtctctgcggcccggtcccacgcccttgctacaaccttgctacgccctggcttcccgattccctctccaccccctgtcgctgcccctcaccccacgcccgccaaacccgttccccagtctcgggtgccgatggcccgtctggcgcccaaccaaacaccccgcagaaatggagttctgacctcctcaccccgttcatgccacctacgctccgggtttcaggggattggcccgggcctggcggcccccggaacctcaagcccacggccagcaagctgggcgctccgctgagcggcctgcaggggctgcccgagtgcacgcgctgcggccacggcatcgtgtgagtaaccgcccccgctgcccctcccggaccctagccttccagggccctggatgcgggcgcagtcgtgaacccatcagtcactcgacgctgtcctgtctcgttccccccatcaggggcaccatcgtcaaggcacgggacaagctctaccatcccgagtgcttcatgtgcagtgactgcggcctgaacctcaagcagcgtggttacttctttctggacgagcggctct

SEQ ID NO: 117425 - DNA, 2751 bp, Homo sapiens
ccaccatcgccaacttctcggcgcttgggctggagccggggcgcgacgtggacctggggcagctggagcaggagagctgtctggatggctgggagttcagtcaggacgtctacctgtccaccattgtgaccgaggtgggtgccggcccctgctggggctgagaccagggctcggaggacctgtcgcggtccttgaacccgagctcctctctcccagatgcgcactggacgctgtcactccccctcccccaacggtcaacaccctagcgatggagaccctccagccaggtggcttgggaacgcttcacgaggtgacctccagccacagtgtgctcctccctgcacaggtggtcagtctggcctcccgtcctgatggccactttgaagagggtaccaggaaggtcctggcggtccctgggcgatgctctatggccctgtgtgtccaggacttactctagttggggttgggggtggtaagtagcagagccaggacttgggccaggggctatcccgtttttcctctagtctcttgatttctttttagaagagaagaaatacttctctttcctgaacttttaaaagttaaataaagcatgtgtatacaactgcctcttccctttttcctctagttactccttcccctaccgtccacaacccaaaaacgacaatctggtcatgccctgtaagtaattgtttgccttttcccatggtcagttgtcagtcttttttttttttgagacagagtctccctctgtcaccaggctggagcgcagtcgtgtgttcttggctcactgcaaccttcgcagtcgtgcgttcttggctcactgcaatcttcgccttccgggctcaagtgattctcctgcctcagtctccgagtagctgtgagccacgacgcccagctaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcatagggtgtaggggagcctttctcatttctcatccccttggattttccctctgggtggttttgtctgtcccctccgaacctgttggagcagttgttggagctggatgtaggaacatgatgttaatgatgtatgtgttttgtgtcttttttagacactggcactctagctccctgaagtttcagcagcattgagtaagtagccagtgaatagccctcattgatagataggctcactaaatgtgcagatgaccaattcgcaggttagagaaggcttcccagaagaggaggcctctccgtgagcctagggtgttcagctcagcataatagtgagctgaaggccccagtgcagcagcaagaaaccacccagcaggacggcggagttcacagagaggggagagttcatagagagggagagtgccacaggccctggcacagcttcaagccctgctggatgttggtgctgagcctcccctcctggagcctcagaggggcttacaggggctctggagatcccaactgtgttgcttcttggcgtcatcacccttcaatggagtctgagagctaccctgggagatccaagtgtgtgtgcatgtgtgtgttttttctttttggaaatttgatgtccccagcatttggacctgctttctccacatatatgtagtgggagtgtgaccggagccccactgggatttcttagctagtgacatagcttcagtgtccagaggcatcatggcttgacaaaagaggcactccttggaggtagccaactgtgctttctggcccatgaatccacaggaaattggaaccttcagttgccacaaatcctgggtcctagcctcacaggtgggtgtgttaccttcccggaagccagtgagtactatgaaagcagaggctgtccctgaggttgcaggcagaggccacagaggggaacatgacacaggaatccctacaaattctacttggggctgcctaaagaagagggaagtagtgaagcaagaagaagcacatggcatctcttggagttttacattgacccctgagggttccccggcttactctagtcacttgttcctgctttgctgcctccatcccacattgggctgagtgatggtggcattgatgagctcccaaaggccagctgtgccagggggtctgaccttatcttgctgccaatgtcagccttttgttttttaatatttagactatttatttagctgtcttagcagtttcaaaggagttatgtgccctttcacctacttatatgttgtcagtctttgcagggaggccagattaatgcttagatctttgttttgggctactggaatgcttgacttgaagttcagagctgcttgttcccaggtgaacagctactgctggaagttgctgcatcaacattctaatggctttttctatggcctgttgtctttcaacccaaacctggcctgctgaccactgcatctagtcccatgcctgctaaatgtctctaagcctgccctctgccccaaatcatacataaaggtgtttgtaagtacactggtattgaattactagtcatattttttccactgaagactggaacctcaggtgtc

SEQ ID NO: 117426 - DNA, 1062 bp, Homo sapiens
tgggaggctgaggcaggtggatcacaaggcaggagttcgagaccagcctggccaacatggtgaaacctcgtatccgctaaaaatacaaaaattagccctgcgtggtggtgggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagacagatagtcttagaagatgggagagccctcactgttatccccaaagctgcctggaggaaaagccagagcaacctgggagctgggaccggggctgactctgggcagcagagacccgagagacctggagcttgaacctcactgttacgcctttgttgatttctctcactcaggggacacacagaccctcatccagccttttgcagctatatggcaaggcagagaagccacttgcggggtcccgtggcccactatgcacgtacatagtagacacatctggccatgagtggtcagattgagccactctctagctagctgacacctgtaatcctgggtcaaatttctgacagttgacacaaagcagggggtcagggagccaaaaaaaaaaaaaatggccaggtgtggtggctcttgcctgtaatcccagggctttgggaggccaaggtgggcagataacctgaggtcagagttcaagaccagcctggtcaacatggcaaaaccccgtctctactaaaaatacaaaaattagccaggctggtggtgcatccctgtagtcccagccactcaggaggctgaggcatgagaatcacttgaacccaggaggtggaggttgcagtgagccgagattgtgccactgcactccagcctgggagacag

SEQ ID NO: 117427 - DNA, 1041 bp, Homo sapiens
tgtcagacaggtaaggtgtctgtcttctggagcaccaggggacctcagcactgaggaagaagcgtgtgcctggcccttgatttcagttggtagtattctttcagcgcagggccctgtattttaaagaagaggaagctatgtctgtgatatagactccatgcctagtaagaagagccaacaaatctgactccgtaattcttgctaagtaaagaaacctgagctgtctaagctgaatgtatctgtgacccggttgactaggtaatatgccatgattcacttctgcagtagcctggcttgcctcccctgggtcactgtgactctgtcatgcccctgagcatgggagaggttgacatcatgcacacatgcacatgtgctagattgtagatctgtagtagtgccacggtgtctgcctctgtagtcccaagaagaccagcattctctctgcaaagtgaaaggagctctcaccagccactagtggtatgaaaagcagaactcttttgtccacaaggctgatgccccttagctaagtggcctgtggttttggcatttactttatgacaggagggagaatagtgttttgatccatttcttataagcaggttatttgtataattctaaagcttttaactcaaggaaacattaacggcttagagaatcccaaacccctcgaaattatatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatgacacatgtgagaacaccccacaaatcggtgggttagccggtggaaaggagtcccagcatcttccctggtttttaattcctggcctcaagcaatcctccctccataacctcccaaagtgctgggattacaggcgtgagacaccatgcgcagccagatattttttattgttgttgtttttttttggaaaaggagtt

SEQ ID NO: 117428 - DNA, 1705 bp, Homo sapiens
ggattacaggcgcgagccactgcacctgcccagccagatttttttttaaaaagcaggttaacctgtttattattcctactttacagatggagaaagtgagacagagggattaaataacttgcccagggtttcacagctggcaagtggcagagttaggatttggacccaggtagtcttgctcctctattgtgtatggactactgttctaggtccctgctgtcctaaaacttgctttctagcaaggtggaatgtattaaacaaccaagtgaggaagtcgttgttgtccttggccatggtaagagatacagagaagtgcagggtgccacaggagtgtctaacagaggaggtcaggggcagcatccctgagaaggtgaagcatgagcgagagtgggaagatgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtccttttttttttttaaagatgctttgacaaccttgtgaagaaagaattgaagggaagcaaaaggtgttgtagagagaccaattaaaaggttgtcacagtagttcatgccagagatgatggtggcatggcctagcatgacggtggtagaaatggagggaagtggtaagaggtaaaatcaacaagacttgccgatgggctggatgtcggaattgggggaagaaagctttctggcctgagtaactgggtgaatgaaggtacacttctctaagacagagaatgctggaaaagaaccacgttcatggatattgagttcaatttgtgtgtactaaatttggggtgactatgagacccctaagtggagaagtagagtgtgaagctggctgtatggatatggtactgcatgagaggttttggctagagaaacacatgtaggatttgtcagcatatagaaccctcagcagagccccagatagggatgaggttgcctggggagaggggagtggggaggggaggggggaactgggggaggattgtgctatgcttagaggccacctgagtggacatgggagattccttctcacggagctaagtgacagctgcggctcagaagaatgcccttgatgtgaaaaggagataccccaagttcagagtagaaatgcagtgtatttttctgggtcagctgtgtcatgggtcagcttaagaaccttcttgccatgtgacacaatgattacctgaggaaagcatttaagttccaaaaggtctattcccagggaaactggaaacaaaatttgtgagtgtgtttaggaccactttagtctacagaagggctaatatagtgtttttcaaacctttctaaacattttggccacagaactttcattaaagtaggataatttaagtctagtaaatgaaatacaccctaagtggctaaaagtatggctgttctgcctgcagcccctgccttcaattcccaatgccctgcctcaagcctgtctgtgcccccttggaaggcccagggccctg

SEQ ID NO: 117429 - DNA, 1114 bp, Homo sapiens
gcactctctttaaaacaaaccaaaataaacccaattttaaaaactttttaaaatgagcacggatacagaaaaccacacagaacaaatgtgtagcttaatgaatttttttcagagaaataaccttatgaccaccaccaagtcgagcagtagaactttgctgtccactaagaagccctgtccatgtgccccatcccaattacagcatcctctctctctccccattaagtaaccgctagcctgactcctgtaataatcacttccttgtgagtttttttagttttattatcgaaatatgcatccttgacacaaatttagtgttgcccacttaatatatttgatgtcttttagtctacttaatctatggattctccttctatcgccttctatgccttactgattatctatgaagaacctgagctattccacctatagaatttcccagtctggatttgttgattgcacactgatgatgcagttcagcacattcctctatgctctgcatttcctcaaaattggcagttggatccagagacttgagattcaggttctgattcaggttcagtccttttggccagaccataggaagcatgcaattcctgactgtctctttatgatgttaacagtaattagtatataatgcatagatctattaatccattgggggctataaatggtattattctaattttattaccttttcatttaaaagttagaatacttttgtacatgatactacctcttatctattattggttgctgttcacatagtttacaaaggaaaatcaggacaaatgtttctttctctttatttgccagttttcatttataatgaattgtttctctgttattctccaaatttggcagattcttttttaaaaaaaatatcattatgaatgtatggattaaataattgatgtatttcagtctcttgcaatcattatcataattgtagcattgctttttaggcaaccctggtacccaggctgtacatttgtcatggggagtggggagggggagaaatagcatgggcactgtgagaccgagactgtccctggcagccagtattctggcaacactgttcacacccacttactggatggatcttgagaaagcc

SEQ ID NO: 117430 - DNA, 1048 bp, Homo sapiens
ccaggcattatgctaacctcatcacagtctctattttgattaatcttctgtttgcccctgcagatccactctccgtcctctctacctgctctgggttgggaggctgacctgaatgggccacatcactcatctatcttgcctctggattctagttagatttggtccatggggagcattagcaagagatggaaggactcaggaagatgaggtcaggagttccccgaggagggcaagtggttaagttattcccccgggtccctatcaggtcgctttaggccaactgcatcctccactggagcccacagctcctgccagacacccttccaatagctgcctcctttgggtccccttacccatttattcccttccttcataccttcaggttacaagtggtaacagctccccattgttgctagcccccatatgcttcactgtctcatcttgatttccctgagccctccccacacctttgtaaacagtcccagtccaagttcaccatctgtttcctacccaacttgatgatacaacgaggtaagcactgtattagcccatcttaagacaagtaacctgagccccagagaagtttaataacttgtcccagaacacacagctggtaaaccacagagctaggtctcaaatccaggtgtttctgattccaaagcatgggcacgtttcgtcattatatcatattgcttcccatgccctaaagatcgtctcccccagacttcatgaaacatcagtttactctggtatttttcccaatcagcaaccatttaaaaagagcaaacactagaagtaaatgctttcaaataaatcgtgagaggtaactgatgctggtctggattgagaaaggcacaataactattcaaaataggcctatgaacttcagaagcctgtggaatccacacttgccgtgtcctctgcactttccttctctgtgccttctgaagggtggtggcattgacatcaccatctgtgggagctcacataaagtcctgaatctgccaaaagacataacttgaggttgcctaacatcacccccatgtag

SEQ ID NO: 117431 - DNA, 1033 bp, Homo sapiens
gggaggctgaggcaggagaatggcatgaaccccggaggcagagcttgcagtgagccgagattgcaccactgcactacagcctgggcgacagagcgagactccgtctcaaaaaaaaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgtttatgttcacatagacaatggcagaaggaggggacattcctgtcataggaacatgcttatataaacatagtcacctgtccttgactatcaccagggctgtcagttgattctgggctcctggggcccaaggagtgttaagttttgaggcatgtgccataggtgatgtgtcctgctaacacacagatgctgctccaaaaagtcagttgatatgacacagtcacagacagaacagtcagcagcccaagaaaggtcctcacggctgctgtgctgggtagcacttgccatccagtttctagagtgatgaaatgctctgtctgtaccgttcaatacagtaggcactggcactagccacatgtgccagctaagcacttgaaatgtggccagtgcaataaggaattgaacttttaattgcatttaataaactgtatgtaaatagtcacatgtggtcagtggttaccatattgaacagtgcaggtagatactggactgggggcagatctgagggagaggggtttgagtagtgggaggacactggggataggggcttggggctatttacctgccattttgagtagtttgctattttagcagccaacaataactattggtgctgaataccagccctgcagtgtagcatgagacaggtccatgcacacatgcattaggaaaacaccttcatgaagcaggattctgcctgggctgatgcacacaacctctatggagggtaaacagtgttt

SEQ ID NO: 117432 - DNA, 1077 bp, Homo sapiens
gtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctattataaaatcctttcggccaggcgcggtggctcacacctgtaatcccagcactttgggaggccgagatgggtggatcac

SEQ ID NO: 117433 - DNA, 2592 bp, Homo sapiens
aataacagtaagaccttagacttcatatttgtcactgtgtccctacacatcctctggtttttaatcctcaaaattttgttggatatgttttctcatttccgagaagagaaaactgaggggcaaagagatacagtgacaatgccagggttacacagtgttcaccatccaagtctagcccagagctccctcagtggtatgaccaggaccccctgtgtaagagcccatgctcccaggtgtcctgaggagtcctttctaatggaagaagttcttacttccatgtgggtgcttacaagccagagagaaacatcccagagcttcaaaaccagggctttgggggagggtgccctgtgtgggtcctagcacatgtgtaacaggcagagggaggtctttgtgagctaataatgctgcagctcatccaaactaggtgtccctcctgagagatccagagtggtctgtttaagccagcctcaagatgggtgtccaagccagatgtcaggggaaaaaaggggaagtcagccttttctcagacctgtctggctgggcaggcctgggtctcagactcagccccaaagtctgtggtctctgacctgacacagccttatgtgtatgtgtgtattgttcaggaggagatgatcttccagatcccatggaagcatgctgccaagcatggctgggacatcaacaaggatgcctgtttgttccggagctgggccattcacacaggtgtgtgcctgggactcaggcctaggaagcccagggtagagacaagaggaggcactcacgttaacacagaggctcttcactggggtccctgagctccctgagacaacatgcagaattactgggaagaggggctggtggcagacttgtgtttctggagaagagagtcgatcatctcagcaaattctcaaagggaaaagccaagatcttagaaagtgtgtggcttcagggggtttgtggctagatgaaagttctccctggcaaaagcatctgtgaaaagcagctgtaagccagggcactgaaagagacccaggtctgcctttttcttcgtgttgaccaaggcccttggtccaagcctcatgtggttggtggcctcctttatccttgagagatggagctctaggcccatctcagaacagtcagcccacccatttagtaactgttctctgctgcccagtctgtgcccactctaccctctggctgctgatagcccaaggaggaagactgggcatagtctgagacacagatagtacactttggggatatggggactctagtgcttctggctgggcccttcactgaggcccgctagatgtgtttaagccaagcctgggcatttgagaaggcccagggcctaggacctgcagagtgtcaccgggagtacctgctggtttgaccactgtggctctctggtagcataagaggtcaggggtaccttgccttcctccttcaggccaggggcagctgaggatccctacccatggccctgacgatcctcttttttctcctgccctctaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaaggtatccaaggactctgggtccttgggaagccctcagggagggagggtagaaggaggtcagctggggctggagagcctgcaccaaggctgacagcccgtctgccccacagaaagaaagtcgaagtccagccgagatgctaagagcaaggccaagaggaaggtgagtgtggtcctaagcagccaggcctttggtcacctgtgggccagggtgagcagtggaagaaatgctaaggtgggcctgggcctaagctgctttctccctcgacagtcatgtggggattccagccctgataccttctctgatggactcagcagctccactctgcctgatgaccacagcagctacacagttccaggctacatgcaggacttggaggtggagcaggccctgactccaggtgagctggtccaggtctggcaggagaccccacaggtcagtgggatgactctttctcttggaggcatggtgctggcacatggtggcccattagtgcaggctgcagggttggtcggagggcgctcgatgtcttgcaaactaagaaagcacacaaccttgacctgtggcttctgctgttccccagcactgtcgccatgtgctgtcagcagcactctccccgactggcacatcccagtggaagttgtgccggacagcaccagtgatctgtacaacttccaggtgtcacccatgccctccacctctgaaggttggtgctcctggggcctggcctgcctgcttgactgtctgggtcctgtgaagggcttcctgagagagaaaagatgatcagaactccacctggcactgaattgattgagttgggcattgcccagtcttagccaccatagggggaggcaagcgacggggacactaggaaggcagttcagagtgggctgcagtaca

SEQ ID NO: 117434 - DNA, 1029 bp, Homo sapiens
gaagtccgctgcccctggcaacagcacccagcacctagccctctgcttcgccgtaccgcacccggaagtcggagctgcgcacgcaccgcgggactctgatttcccggcgtgccccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacggtaagtcttcagtagccgccttcagtttacaggtcgctacatctttcggagaataaaatgggaagttgagaactctccttaggagcagaagcgtccctagggctccacaggtgtaggcccttaaagtgccttagggtgtggcctgcaggctacagcgaccttaggagtttgcctgaagcagtctcggaaggatgtccggacctggcctggggacaaggtttacttaagaatcccacgataccgggagctgtcgccgctcactcagagttcagttcccactggatgccctttggtctgtattgatgtttttaacgctgtctccttgctttcaaagcatagcattcacttcccagtagttgtcccatacaagaattcctttaaaagttataaaatgatacat

SEQ ID NO: 117435 - DNA, 1020 bp, Homo sapiens
aaaccatcaggtctcgtgagacttactcactgtcacaagaacagcatgggaaagacctgtccccatgattcaattaccttcaactgggtacctcctgcaacatgtggaaattcaagatgagatttgggtggagacaaagacaaaccaaatcattctacctttctataaacttgcaatttttaaggataaaaaacatttttgatgcttacagagataaaattcatttatttgaaaaatctgcatacctgatctcctaatgatgctgaataaaggaggtagatagtatatcatttttgtaaattaattaaacagtattcttctatattttggatagcatgtaaaaatatcactcattttggatgtttttctttttgttccctcattttgggtaagattgcttatgcctttttctcagaaccaacactggtgcttattaaagtaacataagttttttctgtgttttccttcaaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagtaggtgtttatatgatatttgaatttctgttcattttcagtcttttaggtctgtaagttgatggttgttttctactataagtttaggggagcatattaaatttttttcaatagactttagactttatttttttagagcagttttgggtttatagcaaaattgggcagaaagtactgagcttccattttctccctacccccacgcacacacagcctcctccactatgaacatttgattttttgtggatactatttgtcagttaaatagaatgatcccatgaaagacttagggttatgttccattctcttgagtaatttctgaacagttgctgaattgaaagcacataatcactcaaatacaggttgaatgagtaaaaaattctagtgtcatgttta

SEQ ID NO: 117436 - DNA, 1079 bp, Homo sapiens
ctgtcatcaagaagattctaattggcctttaagtgaaggaaaggctttgaagcaaaagtttgatgagattttttcagcaacaaggtttgtaacccttaaatagactttgtagtccattaagttattgaactgtgtttgcaatttggatgcttctttttaacagaaaaaatttaaaaagcagaaaggtcatcagttactacctctcatccagcagcaaccattgggcatattttctttcacttgtctttctgtgcgtatatttatttacctgattgacagtataaatgtaatttttttcacttaccattatgtcataggcattttacaagttattaaaaactcattgtaactgtaatcttagtgacagcataatatcccactgtatgaatatataccataatttactttgccagaaatttgatttttgtttcatatcttcaaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaaggtaacttgattttatttttaattgacaaaaattgtatatctttatggtatacagcatgatgttttgatataagtatacatcgtggactggctaaatcaagctatttaacgttcattacttcaatttttttatggtgagaacacttaaaatctactctcttagcaattatatattgttattaactaaagtcacagtgatgtacagtagttaatttcttgtatactaaataggtagtcctttttttgctatagtagcattctccccttatttgtatatgaaactgaatggcttgtatatttcttgaattatcagggagctaatgttttaggtctatgttagtctttaaattgctgaaagagcttggatttgaaagaaaacaaatttgtagcatcacactaaattagtagtatagatcactaggtgttaaatag

SEQ ID NO: 117437 - DNA, 1444 bp, Homo sapiens
gtcctctgtggttgagcaagctttggattaaagtatactcttcatgtaaatttgcctataggctcagaatgcattggtaactcaccatgaatttctagccttctcagtagtcctgacttaaaaaaatacattaaatagttacctttttaaggattaagtaactctaaatgcccaatgaatgaataatgacttttgtggcaggtgttgaggacaggacatggtgtttggagttagaagtggaatttaattcctgcttctctctactagctgtgaggacttgggccaagttacttaatgtctctgaacttcagtttctctaggcctgctctacagtgttattgttagccttaaatgagatcacttttactaaatgcctggacctggagtatcttacttgtcttcatctatcagccatgtaagctatagtgagttttatttatgtaatgtttctttattttcagaatcgtctaaaagaaattgaacataatctctctaaaataatgaaacttgacaatgaaattaaagccttggatagccgaaagaagcaaatggagaaagataatagtgaactggaagagaaaatggaaaaggtttgtggtggtagaattttgttctgcttcaaaattttgggattattgtaatgaactttatttgaatccattttgccatccacattggaaaaaaacaaatacagatcttgttacttctatgtatatgttaaaatgaaggatattgaataaggtttggtttatatttgatacctcaaagtgatcatattttcttatgtttgtacattaaagctttttattttggtgttacacaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtaggacaaaatgtttatttggtcgtttttcctactatgatgttatacattttctgtatgaatgaagaatctccaaggacttatgctgagtgaaaagccaatcttaaaaggctatacacagtatgtttccatttatataacatttttataatgtcaaaattttagaaatagtggagaaattagtggttgccagggatactgggtaagagaaaggacaggagggagctaggtatggttatgattagaacaaaaagagagtccttgtagtattggaactgttcagtatcttgactgccatagtggatatatgaaccgacacaggtgataaaattatatagaacttaatatacacacatccacatgctcaggggtacaaataaaattggggaaatttgaataagattgatgaattatatcaatatcagtattctggttgtgatattttactgcagttt

SEQ ID NO: 117438 - DNA, 2419 bp, Homo sapiens
caccacagtaataattattgcaagcaagatctgtcagtggatactaaaatcagtaggcagaaagttgagaagcaagatatttacatagtctcaacatttctctcctaagatacttgttaattacaaagactaaaacagtaactttacagtggagaaacctggccaacaccatctaagccaagtgaataaggattaacatcatcagtaataagacatattgatatcatgattccatatccactgatatgataccctgaaaagaacacaatgtcacttctgtggtattcttcctaaaaatacataacctcagtctaactgtgagaaacatcagatactttatttttaattgtgttttctatttaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccaggtaagtttattgtagtttaaggcagaataaaacttgttccatggtggcttgaatttgaagtgtgagagttaaaaatagtagctagtattcaggtacaggttgtgtttagaattccccatcctgaatttcagataccctcagggagaaactgcttagtttacatccctgggtttaaactttttaattcataaatttaaaaattaagacagttctgtttgtttttcatctttagtcagcttccttttgtttacatcatttgaattgctgataattaatttcacttttatcctattaaactttgctaaaattgtatctagaaatggtttataagtttagatttaaaaaataaatgataagagcaattaatttttaaagattttgaataatgcagtaagtttattaaaggaaatcattttgttatattcttaagatggaacttaaagatgttgaaagaaaaattgcacaacaagcagctaagctacaaggaatagacttagatcgaactgtccaacaagtcaaccaggagaaacaagagaaacagcacaagttagacacaggtaatacagtctgtgtccttctgtactcatagagactttgacattgcgagcacatgccttttacagtcaattttatatctgttacatggacaacgaagttccttcctgtccacatatatttgctctttttttctgaaaagcatcacttctctttgttctcttactttgcacaacagattttgaacagtaggagagtatgaaataagctgtattctcttttccttttttttttttttaagatagagtttcacttttgtcgcccaggctggagtgcaatggtgcaatcttggctcactgcaacctccgcctcccgggttcaagtgattctcctgcctcaccctcctgagtagctggggttacaggcacacatcactatgcccagctaatttttgtattttttcgtagagatggggtttcactgtgtttgtcaggctgatctcgaactcctgacctcaggtgatccacctgcctcagtctcccaaagtgctgggattacaagtgtgagccagtgcgcctggccatgagctgtattctttctcattcatacctgccctgtaagctttccctgtgagtggccagcagggaacatcaagctgatttgagaactagcagggttctcattgtatttttgttgcagtgggtggggcccacagaaatagcatttgtggattccatagaccgataaaaatgggaagaatgatacaaatagtattttctatgcccttacattaattactgtgataatatgtttttgtgtagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggtaagaatatccatacatgttttttgtaaaattattttaattatttatttttatttttattttttgagacagtctcgttctgtcacccaggctggagtgcagtagcacgatctcggctcactgcaacctccatctcctgggttcaagtgattctcttgcctcagcctctggagtagctgggattacaggcgtgcaccaccatgcctggctaatttttgttcttttagtagagacgggttttcgccattggacaagctggtttcaaactcctgaactaaggtgatccgcctaccttggcctcccaaagtgctgggattacaggcgtgagccagcatgccccgccccattcttctctt

SEQ ID NO: 117439 - DNA, 2061 bp, Homo sapiens
atcctgataccaaaacctagcagagacacaacaaaaaaagaaaatttcaggccaatatccctgatgaacatcgatgcaaaaatcctcaataaaatactggcaaaccgaatccagcagcacgtcaaaaagcttatccaccacgatcaagtcggctttattcctgggatgcaaggctggttcaacatatgcaaatcaataaatgtaatccatcacatgaacagaaccaaagacaaaaaccacatgattatcccaatagatggagaaaaggccttcgataaaattcaacaccgcttcatgctaaaagctctcaataaactaggtatcgatggaatgtatttcaaaataatacgagctatttatgacagacccacagccaatatcatactgaatgggcaaaaactggaagcattccctttgaaaaccagctattatgaggatcaaatgaaaatggtataataattatttgtgtggttcctaagtgatagaacttgtactagtaagtaaagatttctggaagaaggagtttgccataataaggaagaactggctgcctggttaagtagtaaatgttattggaggtggtcaggtggtggttggttaattctgtataaggattcctgcttgtacaggaggtttgtcttatctgcagatcctttatctatggcggtcactctcagtcatagcactctttccatttgattccggatgtggtttcagaacccttaccaatacagtgagcaggcactcagttgccactggaatgcatttgacatcccttatatagattaatcacatctaagactcaaccagttataaacagttataaacaatcttacctaggtttatataattatgcgtactcattcaataagcactaagtatattactgaataattactataaatttttattaaattttagattacaaaatatcagaggttcagaatataatataaaatagtacttgcatctgtataattttttactatttataaagcactttgacattgaaccattcagtgcctcagcaaccctatttagatgatgaaatctctttatagaaaaattgagatttacaaatgtctcatgagtgcctaagtttatgcagctaataggaagcagagttgattttctgatagatcttttgacactgagggcatttgacttcctaacacaccataccacttcccagtatgataaaatagacctatattgaagtaattactaaataattgtatctacctctatagattcactcagtacttcagaatcttaaagtgcttgaggacctctgttttgaactgtggttatcatataactacgttgtagatttagtgttacaaggctaaataatggggacttctatttagtaaaatagtttattacttgaaagccccgttccttccaaaatagttgtggagacaccaacattagtttaacagtatgcttttattaccatgaaatatctgcgtagccttagcaggctaagcttaaggacagaagtgtttttaccatcatgttttcatctgaaaaagaaaagtctggactgaatgagctttcctattctttgatcatgcagcagtgacgggcacctataaaatcatgaaaactcatgcttgaagccacacgctaatataattgggagcacatggcctagattaagaatcaaattagtggttgatgcagtatagcatgcgtagtggttaagagcgtgaactctggagctggactgggttaaaatcttggctgcttcatttactggctgttgtgaccctggacaaatcattctctgtgtctgtttgctcgtttgaaatataggactgaaaatgatggtactgtcctcatagggtcattgaaaggagcaaatgagttgacttttagagcctggcacatagaaagtgcttttattaagactgtgaagtctgacccctaaagtaagataatggaatattatataatactttatcttttttatatttttaggatgctaaagagcaggtaagccctttggaaacaacattggaaaagttccagcaagaaaaagaagaattaatcaacaaa

SEQ ID NO: 117440 - DNA, 2001 bp, Homo sapiens
ttatttcacatgaaattaaatagcataagataaatagtattttcagattcatggtataattttgacattagaaattcttgttagaacaaggatttgatgtaaattattttgctgcttgatctacaatagaagttaagaaatgagactaattaatcaattcctataggtgagaaagggacttgtctgcgatcataaaattcagtagtggtggaaactggaacccaatgttcataacttcccagccagtgttttactgtgctctcctgttatgtgcccttaagtacaaccagtgtaaatttaatgaatatttttctacagctgaatgatattaaagagaaggttaaaaatattcatggctatatgaaagacattgagaattatattcaagatgggaaagacgactataagaaggtaatttaaaacttaaaattatttatttgattgtatttttattcatgtgcttaaagaattttcttttttgtagcaaaaagaaactgaacttaataaagtaatagctcaactaagtgaatgcgagaaacacaaagaaaagataaatgaagatatgagactcatgagacaagatattgatacacagaaggtaggtctgttttgcttatgatatcacttacacctatgacattcttttctatagttttattttcaatagaagatccattgaatagaaatgcaaaaaggaaagaggccaagcgtggtggctcacacctgtaatccctgcactttggaaggccgaggcgggtggatcacttgaggccaggagatcaagaccagcctggccaacacagtgaaaccctgtctgtactgaaaatacaaaaattagctggccgtggcggcgcgcacctgtagtcccagctactcgggaagctgaggcatgagaatcacctgaacctgggaggcagaggttgcagtgagctgtgattgtaccactgcactctagcctgggcgacacagcgagactctgtctctaaaaagaaatgcaaaaagtaaagaaaaataattccaataacattcttacttcatttattttttatttttattttcagtaaaagactcatggtaaaagttcgaacataaaggcataaaagtgttcctccccttctcctaattctcaatcttacttctacatgtcattaactgttacacttatttgttcttaaagaagttttttattcatataccagcagataggtagataaatttaggtgtgtgtgtatatatatatatatatatttaaatttacttttatggatggggtcgtatcatgttattctgtaccttttttcacttaacataatttgattttacctatcaactcacagatgtatcacattctttttaatgattataaaatagtccattttgtgtatataccagcacttactcagattgatttcatttccttatcacaaactgtgtgacaatgaacatctttaacatgtatctgtatcttttcttattctaacatatctttatgtagcataaattcacaaaagacggattaaggtttaataatcttgaaagtaatctgtaaggaaaatatttatatattaagtcattttccagttgattcctatatcatttattttctctattaaagaaattaatttctatagtataatcaaaatcatattaagaagccatcatcacatgctttatgcaagcatggtagttaatgcctttaaaaactataccatttctctgttcttactgttttaaacaaaatttactatttgaatgccttaaccacttggttataagtggttgcttaaaatcatttggaagattagttacattagttttctgctgggtctctttctgtaccaccaagaatttcaaatatatgaaatatcagtcaaagggagatcaaatctctgcctggcctaatacatattgaataactgtataaatttatgatgcatatataacaaaataattatcactagcttttatgtagttgcctatataaaaatcacaatctgtaaa

SEQ ID NO: 117441 - DNA, 1029 bp, Homo sapiens
atcagaagattgtgaatttgtaatattaatcaccagagtgctttacttagcgtctaaaggccaggaactttatcagtgatcacatgctatgagggttctgtaatacacaaaattagctatttagcaacctatgtgcggcagagatatggaaggaagagaggggttttctttagtaccaaagccctaaataataagcaaggagagactctgttataatatactgattgctaaggagaatgatacttaacctatctaaagaaatctatgacttttccacttcaggttgttaaaagctaaaaaatggtcctcatttgtcatttttcttttttacagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccagtaagtattagactggggattttcttattgcagttaatattaactaacatactttagtcatcttttctctcatttttttctttttttcttttttattttttgagacagagtttcactcttgtttcccaggctggagtgcaatggcacgatctcagctcactgcaacctctgcctcccgggttcaaatgattctcctgcctcatcctcccaagtagctggtattacaggtgcatgccaccacgctgggctaatcttgtatttttagtagagacggggtttctccatgtaggtcaggctggtctcgaactcctgacctgaggtgatccacccgcctcggcctcccaaagtgctgggattacaggcatgagccactgcgcccagcccctcattttttctctttaaatatggtattttatgtataccatggattggaaaatatatgtatgtatgtatgtaaacacacactagctt

SEQ ID NO: 117442 - DNA, 1216 bp, Homo sapiens
ttttcttccagagaaaagtagtaacaggtcaggaaaatcccaggcgaaggagtaagccttctatagttgaacagtttggatattaaggaaaactcaataaaatatttatacctgctttagtgagaacttctgatctggaagaaactagttcttgtattcctgtgagtccctaagccagacctaagtgaggagtcaggccatgtgtccctactgtctggagaggagaagagactcctgcctggctggcctgaaggcctggggccacccctccacttcctgcagggtagctggggccctgacacacagcacaagttcatgtgtctgacaaggtttgcggtgacttttcaaatcaaagaaggggttatgctctttactaataatatgttctgaatatattgttgcaggataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcct

SEQ ID NO: 117443 - DNA, 1107 bp, Homo sapiens
gcaactgtgaaatgcttggttaattactgtgtatgtaactgttacataattacatagtatagaattttttcctttaaaagtatgctgtgaaataaaatactttaatgttattaaacaaaaattttagaaaaactctgaaaaatatattaaaactacttgatgtaaattctgcctgatattttcatctgtgcattttatacctatatatgacttttattcacttgttttatgtgaacttggggaagatattttaaggagtcgcttgattttatacttggttatcaggaaaaagtaactgaagaatcatgttgctttttttttaacctatatttgttatctggggacatatatattttttaatttggctttcctgttaatctttcttttcctattatttagctcatctattttgcttctctttcgcttttgttcttagttatcattgtacaattggacaacagtttgaatttagcaatgagttataaagttctaggagcataataaatggaaatgcatgatattattggtttgatttccttaaaatattgataattggttttgtattattgaggagtgtaggcatttctatattgaaggaggtaatttatataagtctgaaacattgattcattttagtgattgttgcaattaaatgattcaaataggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccagtgagtattattgaattgagatgaattcatgatttaaatttctgttttttcctaggatatataaaataggaaaattgaatagtaattaaaagcttggatttttgtctccagtgtagctattttggatagaagggtccattgtatatagtgtatttctaaaaactagatctattttggttattttatttccgtgtgataggaaaacatatcaatgaattagaatgagttataaattaagttagaaatcgatactacacagtggtgtaatttggcagagatgttaca

SEQ ID NO: 117444 - DNA, 1047 bp, Homo sapiens
caagaagttttaattcctatttgcgtacctagcacataatttttttcttgtaatgtgggcgtgttggtgaagtggagagatggttgtcctagcatgtggttgctgtgtgtaccttcccttttaaatatctcaatggcctttttaaaaggtgtttcttgcttgagtccttaattggcagtgactcctgtagaatcattgtttataattacccttaaaaatctactaatagaaggaatgtaagtttgttactgtacaggtatacttcattttatgtaataattttattttctggaaaaaaaaaaaagcccttaatccggttgggaaatcggatgtattgggagaacttgtgtctttaaaaattcttcattagacctttctgttaatcaaataatcagtggaaattactgtaatctaatttatctgttggattggttcaggtttttgtgttagattttcttaaagtgaagcatgcctataatagatccatatactaaaagaaatattgaattgggacatttttgatatggacagtgtgaattttgtcactttaaatgtactagttgttaaaattgccttaattttctgttttgcccttttagattacttcccagatcttagcaggttcctaattccatgtcttctgttagcataaccacatggtgttgaactgtgacctttgcaggacttggggaatcagtgtgagatcttgagattgacttgagttataatctaagactaagttaactttaatattcttgcttaaatgacatctctcgttgtgttgaatatgctttctttttacatgggctctatttcagttttgataacggtttgatttttatttctacacttaaatgaatgctattatatatttttctttgtttcacaagagaaataatgttttcctttttttcctcctcatctctgtgcgtattgcttcctgtctgcgatttgcttactacttcttattgcaagatcaagcaggttggtgtgattgatttgcactccacatggtacaattatttatcctataaagaactatgttat

SEQ ID NO: 117445 - DNA, 1131 bp, Homo sapiens
tctgagtgacagggcaagacctcatctcttaaaaaaaaagcatgtaaagtacatgacctagcacatagcaaatgatcagtaagtgacagctgatgtccttataaagcttattttttatttaataatttaatgtgtctattctgaaatgcagtctatgagctcatgatattttctgcttcaagtgcagtgttatattcctaatagcagagtttgaaatacttagtcagtttgaaaaaattaagacttttttattcccatgtgtaaaaaatggcttctggtatgattcatttattttcacggaaaagtctgaaaagtgtgttatgattattttcacaaaaaaaagtctgagaaaagttgaggttaactgaatagagtagtattagttgaggaaccgttttcatatatgccatcacatccaaggctatcttttcttactacactgtgtcctgaccaactactccagccctctgtttccccacatcgacccttggttttctccaattcttcatccacaatatagccatagtgatcatgatgtcactcctctgattgaaaaatcattctatggcttcatgttgcttttaggataaggtctaaaaagtttaataccgtccttattatactgtgtgattatggcattgtcagtttctctagctctgcctgcatccatcttccctttccatctctgtttcttccattctggtctcatttcagtcctcaaaatttccattctttttcttggctcttgctgtccacactgttcctatctgattcttacttgtatttcagatctaaaccttacctcttctggaaagtcctccctgaccccctctcctttttcccattacaattcctgtgcctagttgatgtccctgactcccatctagaactccctgtttctcattctgaatactcatcatcatgataaacccaagattatacacatcataagattagggattgtgtttgtcttgtcactgtgtctctagtgcctagcacaatgccaaactcaggtgtgtggtaaatgtttgttgaatgaatgaatttgggtatttagaaagttgagattttatctttagttacctgtaataattgtattgtcatctttttgttaactctgtttcttacagc

SEQ ID NO: 117446 - DNA, 2622 bp, Homo sapiens
cacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttatt

SEQ ID NO: 117447 - DNA, 1036 bp, Homo sapiens
agacccttggcctgcttttccttcctcccccgctcccctctgccccgctccccacgccggaatcctgggtgcgactccaggcaggtcaggcctcagtggtcgggtctgcggcagccattcgccaggagctggagggattccagactcagcccagtgggcgtttatttgggctccagtccaggtcctcagaaggttgatgtccctggtggtccctgcaggggtctcactgggcctgagcctgccgacagccaacttactaaaggctttcataattcactcgcgggagggaggcctttggggggttgtatctggacatcccctgctgtctaaggctggatctgggtgtgtctgggaggctaggctgtgacagtgaaggaagctgtgtcctcttgccagcatgtaaggccctggtcggctggaagggggaggagggggagaaggaggaggaggaggagggaggcccagggctgttggagggaagggggaattctgaatatgtgaacgataacgaattggttctggggctaaataagggagccaggacttatgtaattaatgctataaataccgtcatcccaatttatatatgtaaattttccatttaatctgaaaatacatttcttattctactttggaaatgtgcatgactaaagcaggagctcttggtttcataatttctagactcgggtgttttattcccattggagagggggtcgtatgtcagttaagtaagtttaaatacatgaggaacagattcagaggctgggctactcagagattcacttcgccccgtattataaattggaatttatgtaccggaggagggcagtgcctgaatcctaacagacctgctgattagctggaggccaagagacccgtgagtgcctgggtgtctctgcatgtgtgtctgtgtgcattttctgtgcccagctgaccagaaagttatgtctgggtcttgtctgtggccagaggtttaacagttgatgttgcaggtgggagaggtatgtagagaaaccagaatcagacagcctgatag

SEQ ID NO: 117448 - DNA, 1031 bp, Homo sapiens
agcttctttctgaagcatgacccatctccagagatgggatttgagaaatcagtgagagcttcctataaagaactccaggagacaggcctgaactctagagggaacttgaaatccagggtcaaaggttaaggggcagcagctggtctggcccctgaaagccttcacctgatgcctctgcagctacacaatcccaagacagagctagagcaagggtctctttaaatgttgaaagatgttaggttgtcagctttaagatatgtggtggttttgtaatttgatgcttttattctgtttttaaattgaaatgaggtaatgcaactttcgtaataaccttttggaattatatttttccacttttaggcaaagtgcttagacattttcaattttttttttgctaaatactttggaattctatttaaaaaatagatgatcaagatctaaaggaaattaatcccaaccaacaaacttaaaagtttatctacctcgttttaggcaatcaagattctggagagtcttgaacacagaataacgattgtgaccattatgaatgtaactaatttcagttgtactgtgaatgctaaatatttgcaaacaagtacatcttgaaagtaaaggtgacttagagaaaagagacattttgacagatacttttaatttgtggttgtctccatcatgaaatagaaacgtgtttggcacttgtgggtggctattttgatttggcatgactacttaattttttaaaaaaattgtggtttgtgaattgcacctttgtgccatgtttctgaatctggttttcaaatccagtggagcctttcagtgaaataggtgactattaaaaaagtaatagtattacagaaaaatgagcgattaaatagtaatggatacaattaaggagcaactattttatatgactgttctgtacaaacaaaaagtatgtaatacccattttaaaaaaccatttgaaagtagacaacttattccaaaatagcaaatgcagaatctctgctcagtgagcttggatgagtggctta

SEQ ID NO: 117449 - DNA, 1803 bp, Homo sapiens
cagaaaagccgagggctgaggagaagtgtgagcgcctccgcctgtccactgtcccccaaagtcagttcaatccccgacgtcctccgctaggctccaccccaccggcccgggcagggcctccaaggcacctcccacctacgggtcacccagtcagcccacttctttctgggacaaaggcgtcatcccttagagacagtaggaaaatggtatctcccggaagttacctcacgacctccaagagcggcttccaaccttgccggaaatgacgaacgagtcaaccggatcggtgactgtggagggcgagctgagccctgtgcgtgagtggggtctggttgtgcagtgttcgtggaccctgggaggctaggggcgccccgctgggctgggaaaggataaggagtgcaggggcaggagtctggggttggggatggacccccgcggggactgcggcgcttcgcgaaagcgagccaagcgcctgtccaccctcggtcctgcagggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcgtgagtgccttgggcccgcgggagcgggaggctggaccccagcagcagcagcagtcactgcgcctcccctctgagcgctggcggccgggcaggcgctctgtaacttgccgtacacacctttctcattgaatattcctgaccgcccttaagctggtcatattatcctccccatcttacacggggaaaactgagctacagaactgaaatgactggcccaaggtcactcgggtgattccagcatgttcctctgaggtcacctttatttagttcttaccagtggtgaaatgctttgtgttaaacgtgcagcagatagtgatgatagttgcatggccttggatatgctaagaactactgaagtgtatgctttaaagaagacaagaggactgagacctttttttttcttctatatgtcttatatgtgtgctctctgtttactctcttaatttttaaagagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcactgttgtgatattacatttttgtgagtagaatcctgtgtgaccactaatattcaagttcatgaagcgcccctcctcagcatgagtcttgaagttttgcctggtctcgggttttggtgaaagagcagggctccccctttgttccattatctacaagaaagtagctgcaggtactcctgcatctaaccatttgtgggtgacatgggctatggcgagtgctggttcttggccctctgctcccatagcaacaataaagtctactaactatattgtaattagtatgtgtcagggacgcttttattttttattttttgagatggagtcttgctctctcacccaggctggagtgcagtggtgtgatctcggctcactgccatctgtgcctcctgggttcaaacgattctcctgtctcagcctccgagtagctgggattacaggtgcaggacaccacacctggctaattttttgtatttttagtagagacaggtttca

SEQ ID NO: 117450 - DNA, 1229 bp, Homo sapiens
agaactcctccatcccagctttattcttaggttcatgtgtccccttgtcactcctctgcccagcttcccagggctctctggcccaaccctgctcccaggttcagggagtacctgcatagccttgtgatacactcagaatcatcccggcaggaggctccaataggcctgagggaaacccctctccaaaatggggtcattctccgtggccttctctttgccgaactcacttctggtattggggagccatctatctgtaagggcaaagacattcagatatgaaagtgttgacaccctgctgcacaccttggaagagtgatcattccattccgcagatgctgtagactcagaacagaggaaccattcctcaggactgaatctagctttcaagttccaccaccactatcatctccacactccacacacacacataagtatccttccctccttacctggcccaacagcaacaggaagatcatgaggactgcacaaagtttgaggtgccacatcttgacagggggaggatgttggagcctgaaagccagggacagttcctacttccttttatagactgacatcaactcttgcattgttactgggtgagatgggggcaaagtttatatttgtaatcagaatcaatttaataagttaatgtctaccggaggaatgtgctcaagggccacctttcaggcacgttgtatttactgatccctcatctggactttgagtgattgtgttgctggcatggaccctttcgcccattttaccaaaagtcagcactgcccttccttccctttgaaagccacgtgaaaccattgagggaggtcaggcaactagccacatttctattccaaaatagctcagtgagatcactcccatagaattccaataatgaagtcttcagaaataatgttggcccctttcagccttgtctaggaaagaagcactgatctattgtgtacagccaattggataaggcccttatctcctttctgtgggaggatgcttcagcaaggcctacagttccccagatcgtccacttgcttagatggactgtcaccctaatctgcacctctttatctcactagtaaaatgaagacccagctgtggaaagttcaaagtctggcctcctgccctctcaggggaatggctggatgtgagacttatttggaccacaggtgaattgaataattataggtttctttttgtttttaagcacatgtagatgagga

SEQ ID NO: 117451 - DNA, 7221 bp, Homo sapiens
cgtgcctcagcctcctgagtagctgggactacagatgtgtgccaccacacctggctaatttttctactttttgtagagataaggtctcattatgttgcccaggctaggaatcccaacattcaacataaagctgtatttataaaaacataatttgtggccgggtgtggtggctcacaccttgtaatctcagcacttcgggaagccaaggcgagtggatcacccaaggtcaggagttcgagaccagcctggccaacatggtgaaaccccatctctactaaaaaaaaaaaaaaaaaacttttttgtattttatatttggctgaggcagcagaatcgcttgaacccaggagaccagggttgcagtgaaccgagatcgcgccactgcactccagcctgggcgacagggagactgtctaaaaataaatgaaaataaataaaaacatgggatttagttatcagttggttcatggcatatgatggtagccgaaagtttgatataatcttaagtgtctaacctcacagaggctgttacaggaaacaggcaaagaatgtcctcctttttgtgtcacttgcttcttatacaaaagcaatgcacaaaatgttttgagtaatcagtagcacattatggcattaaatcttcattttaataatatctactgcataatagcaatttatcatttccattcatggaatcctgcttatatataacacttaatttctgaccatacattctgtttaaaatgttgcatgacttagggaacaaatgtaacttgagagactatggaatgatttgctctaaaacatggacagtaagcattttagtgtaggaggaggtattttttgagtttatgaatgctgttttataatctctactcatagttttaaagcagtgattcaaaagagtatatatcatttaatgaatgtttttggttttctagaattctttgctgaactggataaagtaatgggccctctcatctttaatgcaagcatcatgacagatctagttcgttatacccggcagggactgcactggcttcgccaggatgccaagttgatatcttgaactgaacacattctcgttgcctctgattttctccacaacactgtgtcacatcacgaaggaaaactgccataacataccacctagtcgacactaagaatgaggaatagttttctcctcgttggttcatgtgttgttgtttttgataatccaaagcgatcatgtcagttggccctttaatatttccaatgtgaaagattatttaaatgcttttaaatctgcagcacattgataagatggtttccgtgagctatgataagattgaaattccagttgcaattcataactaatgaattgaaattttatttattttaatttttttaagttcccagattggggctagtttaagacttagttatttctgcctataaatttactctgttgaatatttagcataaatttaatgtagacatttttatttatataccttgggagctttattacctaatatctttttgtggtagctgttctaagagtaagaattggttcgtctaaaataaggacatattctttctacacctgctacctgacctgatatttgaaatcttaactccaattttattattgtggaatttacagttagtattaaggatattcttctacacatgaaaaaatcacttaaatatgagaaaatggcattctacatgtatgtactatgaaatgtgtctgatttggtatgcattatttcaaaaactgtgaatgtgtgttaataacactacagcaatcacacagtgactatagcttgcatttaatgcattacaaaagagggaggacaaactttctagaagaagcatttcatgttgaagggtttcataaaaggacaatcctgaacgttacggattttattaaaaccatatgttattttttgttgctaatcatttgacacttaatcgaaacagaataagttactgtggaaaaaaggatgatccaactcctgaggattgccgcctgtgtgtctttaattgattatctttgatagttagagttatttttcagatttttccccctcatactggattgtgatgctctgatatgagcatgcaatgactgatacagaaataggctggagcttcggtgtgtgcttttgctatacagcttacagttctaatgcctgatgtagagatgatgaatttctcctttttaaacctatcttctgtttactccttttgcattatgaaggccctcttcaatgatgtatgtttctgatggaatcagaaaatttcacactagaaaagtgtacctaacttgattcagtgtgagctcttgggacagggagtggagccaggggtagagcttaaagaagctggctctgtaagagttgtatatcaaagtaccttttgctacaaggtgcatatagaagtctaagataagaaatgtaccctctatactttatttttcatgcccctatcatgtttggtgtgccttaaatcttacctttaaatgaagactctatggattgtttacaaatgaagttttacactaggaccagatcgtccatacatgattggtcttctacaataataatgttcaattctttcattttaaatctttctttagggtcatataaagattagttctttcagaaaagctattgctttggtacatgacttagtctaaccagttgggtaatgctgctttgaaaaatagtttgtccctctccccattccaaaaatgaatccattcagtcagaaaaaaagattatcctactatttgtagatgattgctaaggcttgaaataggaaaggggaaagaagggatagaaaagtttcaagtccagtagtgcagtgaatcctttgtgtttgagacttttttacacttatttctgaagttagtgaactttcattgtccctgtggcctcatatttatagagcttcttaactgttttgtacctcagattgtttttagatgtcattgaagattgagatgtacaaattatgttgaatttaacctgtttctcttggagaaattgcctctgatatctttctaacttaatcttagtgtgttctaggaacagttttccataagaggacaacttctcaatgatcatgatagttatttagtaagaaataatggttgttaatcaaatacatgttatgtcttgtccttctctgatttttctgacttggattccttaatttgcagtgatgtcttagaaatggaaaaagtatcctctgggctttcagactttcagcaacaacagccagtgggatacctctgagttcttgtgttctagtctcttgtatgtcctgaaaggcagcaggagcatttttggggtcacactgatattttgttaaagcagagtttcctgcatggtttatggtgctgctctaatattttctctttaaaactgtgtcaatttttggagaatgaatttttcaaccttttcattgtggaggatttttcccacaaggtagtaatgggcaatggatcaaaatcctatcataaatgattgaattttcaatgtcatagtgtgtggaaatactactccctttcctccatgtctatcttcttagatgttctgtctttgtcatcatctgctccagcacatactttggactcctttacaggtgaccttcccccctccctcctcaataggtgtcctcagtgttttctaagcatttaaaactgaatttgacaagtggctaaaaacttagtctgagacttgtacttagtatatggttaattatagaaacaacaactattttaaacagttactctgttgactgctctttatgactacacttgtatgccaggaggcagcagcctatacaccattagactctttacaagcaaccaacgaaccaattgcagtggttgcagttgtcacagtagtcttgcctgggccagactgggctgggctgtgggaagcattccccttcaggggagtttccacagctcagcccaggctccagtctggctagagagcatccagcccattccttgcctcagtgccacctttttctgggcaagtagccaagaagtgactttatatgcagtgagtacttcagataaacttacagctacagctgccgaagagtggagaaggttgaccaccatttatttaattctctagtgtaaaaacaattgagagcagtgtgcgtgagcccacagacacctgtgtttctgggagctctggcagtggcggattcataggcacttgggctgcactttgaatgacacacttggctttattagattcactagtttttaaaaaattgttgttcgtttcttttcattaaaggtttaatcagacagatcagacagcataattttgtatttaatgacagaaacgttggtacatttcttcatgaatgagcttgcattctgaagcaagagcctacaaaaggcacttgttataaatgaaagttctggctctagaggccagtactctggagtttcagagcagccagtgattgttccagtcagtgatgcctagttatatagaggaggagtacactgtgcactcttctaggtgtaagggtatgcaactttggatcttaaaattctgtacacatacacactttatatatatgtatgtatgtatgaaaacatgaaattagtttgtcaaatatgtgtgtgtttagtattttagcttagtgcaactatttccacattatttattaaattgatctaagacactttcttgttgacaccttgaatattaatgttcaagggtgcaatgtgtattcctttagattgttaaagcttaattactatgatttgtagtaaattaacttttaaaatgtatttgagcccttctgtagtgtcgtagggctcttacagggtgggaaagattttaattttccagttgctaattgaacagtatggcctcattatatattttgatttataggagtttgtgtctgggtcccaggaacatctactggggatgactgttaggcagcttgtgatgatgttttttaaaaaacctaagtaacttggggagacagagcatttcaaacccatatagacacctatcatacctgtatatcccctaatacatggaacataaatttcatttcagctttatgcattaatgtattgaagaggcaggctttttttccagtaataatactgtacatctaaggttgctattcagtaaaactaatagaagagataattattgaataccttggaatatgtagtgagaagaggccaaatttttcatgtttgtgagcatgtctttcagatactcgctaatggagaaattcactttagacctctagaccccaaaaccaagttagcaagtgacaaaaagtaaattattaatagtctgtaaagtggatgctggtcttacaaagctcctattcacatgaaccctatggttaattagaaagaacttgctgtctccagaaaagggaatggaaataataactatgtatcttcttttcatgtaatttggtcacagaataaggtattcaagttaagtctaatccaagtcttagagatctttaagtatcctaaaatagcagcctaagtagtcatcatgtaaagaagttgactttcaggaatgtcagcattgacctctccttgccactgttactcagctaaacataacttgccattcttaaaaataaaaaagctcccacccagaaactctagtgatactcagttttgacctcttactgcttccatgtgggacttcttttcagcttttaaccattggaattttctacctgctatgttcctctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgggggtagggggctcaccaacagaactggccagttgacattgcctgaaaaggcaccacctttaagggccagttgtggggttggtaagcacagttatgaaaatttctatctagcctccgttttgaatggttttaagaaattttgtatatggaggatggaaatgcttatatatttattgaaaatccttttatttgaaattaaaattatttggtatataattgtttgatatttggggagggttttggaggggagataatgtcactgataaattaaaagcctgttgattttgcagaaaggtactgttagtgactgataaggatgcctttgttttgtacatgaaccaaatctttgttttacatttcttttatccaaaatatttaggcatctgacattttcaaccagaatttcaattatatactgtgatttttatttgttgcaatacattacaatttcagaggtactttggggctcaaaagctaggatttctaagtcagtatgtgcatttcacacgataaagctgttaatggtgagcaaagtattatatactaactagatttttccacatctgtatagtatattatatgtattttgtggtattgagagtatagaaagtttagagtgtcaaacatgcgtttaatgtgtatttttaaacaaatttatggcaattaaaatatttggagacaagggtatcacatttcaatttgtaaagatctttttaactctactgtgtcattaagatgctttgtacaatgccaaaccatagttggagaaactaagtttaataaatatcaaatagattttctgtattaaagttactgaacactgtactctttatatttcttcaactctgagcccttttcatgcaattcctgttttgtgtcttaaggtccgttactactctttaaaagtctgttcccaccagctgaggtctcattttctgattacagaaattctgaacttgctggccatgggtccttgtgcatatgtcaaaattcaccttgtcccaacagaaatcttaaatctcttttggtgcttttggtggcttgggctttcattgctttattaaactagatttttctctctgttctgccttatcttcagacagccatagacaaacctgggtgcttcattagatggcaagtgcttgaccatcttttttttttttttttttttttgagacagagtctctctatgtcacccaggctggggtgcagtggcatgatcttggctcactgcaacctccacctcccaggttcaagtgattctcctgcctcagcctcccaagcttgaccacctttgacacct

SEQ ID NO: 117452 - DNA, 1064 bp, Homo sapiens
atgtaattatatgcccgaacagatggaaagtgttgagcagagagtgaggggatctggcttttaagtctttgaactgtaacaaggtacatgacttcttcagttattgtccatctcttgttttgttgttattcattaaaacaaaggctacagattctaagataacaagattatgaattacaagattatagtacttatttagaagaaattgtagctctctgaaaacccatctagtttaagagaatctttacattttaaatgctttcatgtagaaagagctagtagtacttgattttataatgcttaccatgtccatatgaacaagcttcctatttctgttgtgtagcaaagctgtggggatgccttcccctgtttctccaaagctgtcaccaggcaattcaggaaattattcatctggggccagtagtgcttctgcaagtggttcttcagtgaccattccacagaagatccaccagatggcagccagctatgttcaggtcacatccaacttcctctatgccaccgaaatttgggaccaagctgaacagctttccaaagagcaaaaaggtaggtaggtttctggataaacttcaagggatggaattgttagaaggaacttttataatttagttaagtaagcgtttagtctgtatttagttttattatttagagttaatgataatctgtttgttaatagtcttcattgcttagcagttaaacaataaatgaaactgaatttggtcaaaagatacctctcatgattctggtgacaaaactaaactgaaaatagttcttggactaagacaaatgtgcttatattctggcacattaaatgcagctcataccataaaagtaataaaatatatgtcctaccctaggatggttaacagtaaatttggcaataggcataagattacatccaaacatctgtacatctgagaaggttaatgtataagaaagcatgctcatactggatttttaggtatattggaagaaacctgtgaaataaaggagactagggaatgaatagaaatttttttttttttttttttgagatggagtttcgc

SEQ ID NO: 117453 - DNA, 1067 bp, Homo sapiens
tggaaaggaatgggaaactttcaaggaactaaaagaagaccagcgagaagtgggtgtgactggagagataggcagggatgatcctgcacggtctttataagctatgttgtggtttgtaatatttgcagttcagtttcctagtttttgttttttaattttagattgtttacactttggtttggaaattctaccccttcgtaatttttaaaacttcatgacatgttggtgtcctatggataaggtttggattttggaatgtcagcaaataatgagagcctagtcctaggcttcttagccatcttcccctccctaggatgtgtaccacaataagaacacatctgttggttttgcctaacggttaatgttgtggcctatgccatggtcacatgagccagtctcctgcacaatgcaaaggctgtctgtgcaaatctggccagagtttgctgtcctggtaaataagccgcccttttccattggctagcctgcgatgcgagtctttgctgtacctgaggctgttcaaactgaagaaggaaaatgctctgaagtactcaaagacactgacagagcacctgaaggtaagtatgcaaaagcacaaggtccgtttcctaggagacagaatttgtagtctcccatccccatctgagaactgccctcatgtttatgcaaaacacaccaggggaggagctactgtttgggacttttcaaataagtttgaggtttctttgagttttttaatctacgtgtatctgattgtagaactcttatagccatgtgcagcggctgtatttactttttaaatgatcttttgttttcggccgggttcggtggctcacgcctgtaatctcagcactttgggaggctgaggcaggcagatcacgaggtcaagagattgagaccatcttggccaacatggtgaaaccccatctctactaaatatacaaaaattagccaggcatggtgccacacgcctgtagtcccagctacttgggaggctgaggcaggagaatcgcttgaaccctggaggcggaggctgcagtgagccgaggtcatgccactgcactccagcc

SEQ ID NO: 117454 - DNA, 1096 bp, Homo sapiens
actcacattttatttatgcttaatcttacaatcaacttgagtaacttagtatttgatactagggagcttgatttctgttttcctaattaggtttgccatgagttggtcaaaacaacttatgcttttaacctgatataaacatttgtcagaaaatactgaaacaaattcttagtaacagctcattttctttgcttgaggacataaaaactgagggatactagatactgaaatgaactagtattatgaaaatatttactattctatttataatgaaaatttgtcttgcagaaattattcagcagaccattatttacaagaagcaaaaaagctaaagcacaatgcagatgcattggtatgtagatattctccttacacttacgtatttaatcaaattaacttaagtaatcttctgatgtttgtagccatagtagatcattactcattacttgcattctcctttcttcagtctgataggtttgagaaagctgtatactatcttgatgctgtggtatctttcattgaatgtgggaatgcattagagaagaatgctcaggaatccaaatccccattccctatgtattcagagacggtggatctcatcaagtaagtggaaaaacttggcagatcattggcaataacattatttctctggtccatcaaggaagaggctgatatatagtaaactgaagagggtgtataatcctttaatgtccttggataaaggagaagtagatacttcaatgagtatttttgcttttatttaggtttgaaattctaatgttttgaggacaagtgaaatcataagatcaaggtgaagtattctgtttgtcatttgtttgttattgtaactcaacagatacactatgaagctaaagaattacttggcaccagatgctacagctgcagataaacgactcacagtactttggtgagttttctgtgttctagcctctgctagatacaggaagttctataataaatagtgctgtgtgtgctcttctgaatgttttccttgaatcagacttctgtaatcctgtcttaaatctgttcctgatgggtcaagcaggaagtaactcaaaattcctactgaaaggtt

SEQ ID NO: 117455 - DNA, 1029 bp, Homo sapiens
ttatcttaatagcagtacttatttcataggtttgttaaaggattaacaataatgctaagtacttagttaacttagtgcctggtaagtagtaagcacataataaatattagatgctattaatattattgctgttttcattgaccagtaactaccaataaatgttgccgtaagtagtgctgccattttcatactaggcttttgtcttccttatgttttaacaactgcctaggccagtgcctggcatatagtagacccttatataaatattagaatgaatatttcagttatataaaatggaccctttttttttttaaagtttacattatgaagtttataaaagttttgtaacaaggaaattcattatgaaaggcaatgaaattttgtttcctttttaccagtggctgaagaaatgctattagtttcatttttaatctccttacggttttcattgtagttatatatttttttggtcaggaaaaggctccaagtagctcctctaactgtcctccatctgcaccaactcttgattcttctaagcctcggagaacaaagcttgtctttgatgacaggtgagataatatgattttttgtatctgtatttaagaaatgattccagtcagcatataagaaactcattttcatttctatcattggccgggcgcggtggctcacgcttgtaatcccagctcttttggaggcccaggcaggcagatcacgaggtcaggagtttgagaccagcctgaccaacatggagaaaccctgtctgtactaaaaatacaaaaattagctgggcgtggtggtacacacctgtaatcgcagctattcaggaggctgaggcaggagaactgcttgaacctgggaggcagaggttgcagtgagccgagattgtgccactgtactcccgcctgggcaacagagcgagactccgtctcaaaaaaaaaaaaaatctatcattgatcagaaggatatatacttacgtatgatctgcagaatattcaggtttcaatttgaaaagtacccactagtcca

SEQ ID NO: 117456 - DNA, 1086 bp, Homo sapiens
gcttgaacctgggaggtagaggttgcagtgagctgagatcgtgccactgcactccagcctgggcgacagaacaagactccgtctgaaaaataaataaataactaaataaataaaattaaaatttcattgtggtaatggttgtacaactctgaatataccaaatgttatggaattgtgcacttctaaagagtgaattttatgttatgtaaattatatcttaattataatttcacagatactacctcccaaatcattacattgaaaagatgccatcttagagactgtaggaaatgcgtttcagtctctgggttttgtgtatctaaaataggcgacctcagccttaaaacctcatcttcttgaatattatttaaatgaattatagtacttctcttttatcttctttctgatgcctaatcatggataaactctttgtgggtagctagtgctggaagctgaagttagttgaataaaaatcagaccacggtttctatttttcatctagaatgaagatgataaccgagccagtgagagcaagaaacccaaaacggaggacaagaattcagcaggccataagccatccagcaacagagagtacgttcccaaaacatgttgcatgccagtgttgttaatatatgtatatcatttgatagtgggtactttctgacatgctctgagtgttccttttagtaagcaagtgttatataaatgcatacacataacatatgccaaatagtgggagctttcacttttagctaatagggatggaaaacatttaacatttaattagttcttcctttattcattttttattggggtaggggtgagtatggggggagaattaaagtaaagctatgccactttctggttagatggcaaacttatctgtaatttccaagagactggttgccaacttaaaagtggtaatctcttcattcaccattcatcaatttgttcaatcattcagccaatatttattgagtactactgagtggtaggtcagtttttggccctggatttacaaccacgggaataaaaacagagaagatgcctaccttcatggaatttacagtcttattttgttttata

SEQ ID NO: 117457 - DNA, 1851 bp, Homo sapiens
cagtggctcagttttggctcactgcaacctccgcctcccgggttcaagtgattctcctgcctcagcctcctgagtagctgggattacaggcgtgcgccaccgcatctgactaatttttgtatttttaatagagacaggatttcaccatgttggtcagactggtctcaaactcctgatctcatgatccgcccacctcagcctcccaaagtgctgggattacaggtgtgagccaccgtgcctggccacttatcttcttattcagatgataagagctaatagtcaatactcagccctttgctttggttcatagagaaccatttgcttttgttgcattaggcattgtggtttttcctcttctttgaggttgtaaaggagggagaacgaaaaaagcattcagtatcgaaaaaagcatacatatttctctgtttttcagcctgaacccccgccaacaaacaaatggcaacttgataattggctgaataaagtgaacccacataaagtgtcacccgcctcttcagtggacagtaacatcccatcatctcaaggctacaaaaaggaaggccgagagcagggcactgggaatagctacactgatacaagtggacctaaagaaacgagttccgctactccgggacgagactccaaaaccatccaaaagggatcagaaagtgggcgtgggaggcagaaatctcctgcacagagtgacagcacaacacagagaagaactgtaggcaaaaaacaacccaaaaaggctgagaaggcagctgctgaagagcctcgtggaggcctgaagatagaaagtgaaacccctgtagacttggctagcagcatgccctccagcagacacaaagcagccaccaaaggctcaaggaaacccaatataaagaaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccccgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgaatcttttgactagaataccaggaaagccttacaaagaaacagagccgcccaagggggaaaagaaaaatgtgccagaaaagcacacgagagaggctcagaaacaagcctcagaaaaagtttccaacaaaggcaagaggaagcataaggtttgtgaagggtttttgttgtttgttttgaaacatcagaatctgaaatgcggtggaaatctcagtaagccacaaagtaacaaggtgggtcataagctgtgaaggaaaatagtgggtaaacccaaggcccaggcgaggctacatgtggaacagtctcttgaggatttctgtgcttctgcctgtgtccttcagtaaagcagaatagttgctaatgaaataagaaatgagtcagtgcttttcagcatgtgctggccagtgtagaggttagagagcagcagcttgcaaattggcatttgcaacattctcaacattttggttttaggtgtttttagtttggatatgtactccccgtattgttataatccctaccattctcttctgatgtacacccagaccaagtcacacttaaataactaatctgctatgcacctctatgccccagcttattttccttaacaaaggtcagaactaaaaatattgctggcttatagccagctgtc

SEQ ID NO: 117458 - DNA, 1074 bp, Homo sapiens
taaaagctttgacatattcacatgtgtaaacaagttcattgagctgccattgttaaatcataaaggccgagagaattcagactaagtacatttccttagaggaaaatcagtcgtagagatagatgcactaagcccctgtctgaaagaaaactcttttttccctgttctgtttaattgggccagtcttaaaaatcatctggttactttatttcaaggtggtgtttaatatgtaatattttgaacttagggtcagatatagaaatgttggttaaactttgaggaggaaaagtacaagtagttaatagagtgaaagaagatttccttctcactgattggagattgtaatgaaattttaagaaaggtaatggaattactgataatgagaaattagacattttcctagttgtagttctccctaagctttgtattaatttttcctcccatgtaaaaagacaaggaatgttttgtggactgttacatagaaaattttaagtttaatggttttgattttatggccttaaaagaaaatttacatctttaattttgctttcaaaaacaaattccagaaactgtcagcttatagtatttgtgtgtatgtgttttaattgatttgaagtttgatcaacggagattttggaacttgggagttttttttgttttgttttgtttttttgagacagagtctcgctctgtcgcctaggctggagtgcagtgatgggatgtcggctcactgcaacctccagctcccgggttcaagcaattctcctcctacctcatcctcctgggtagctaggattacaggtgcccaccaccacgccaggctaatttttgtatttttagtagagacagggtttcaccctgttggcctggctggtctcgaactcatgacttcaggtgatccgccaacctcagcctcccaaagtagtgggattacaggcatgagccaccgcacccagccagaacttcaaagttttaaaaatatatacatagccatttctgctatatagccaggacttttacccaaaatatttatttctacagagggcactttgtttcatagcaaggcatttatga

SEQ ID NO: 117459 - DNA, 1092 bp, Homo sapiens
gaaaatagctaactataggccagagaatttacattttctctcttctttttgtttccttttttttctcagcttgttttccctagtcgtcatcttttaagaatgcttcatccttctactcttctctcattctcttttctgaaagctgttcacaaatgggatcataagctgcctctactcattatttgtgtttttcactttgttttagagctatttctatatcagcataaagctctagctcattgtttaaccttaaaattatgttataatatgaaaatatcttaatttatttcactagtcccctatcgatggacatttttttccagtttttgccattacaaaccaggctataataaacattcccaagtgtgtgcttgtgtgttcgtgtattcctcaagattatacctgtaatgtaaattcctttcattggaattattaagtcacttagcaatataattacagtactgagaaggtattaccagattgcccttcaagaagatcgtatgagtttatagtcctaccagcaacatatgcacatgcttatttcccctgtagtcaccagtatctcatattattgggcttgaaggtgttaccagtttggtggttgaagaattatatttcattgtttgatttacatttatttgagggtattttacatagacattttacagtctaaatagccatcctttagttgctcacttcattctttttgttccagaaagatataatccttctaaaacttcaaatgggcaccagtctaaatcgtaagtttattgcttaatgagtttaatatttatcatttttgctaaaagttacctgtaatatctaggtattttgaacagtatttagaaatattgaggctgggcagggtggctgacacctgtaatcctagcactttgggaggccaaggcaggcagatcacgtgaggtcaggagttcgagaccagcctggccaacgtggtgaaaccccttctctactaaaaataaaaaaattagccaggcgtggtggcgagcgcctgtaatcccagctacttggaaggctgaggcaggagaattacttgaacctgggaggtggaggttgtagggagccgagatc

SEQ ID NO: 117460 - DNA, 1718 bp, Homo sapiens
gtggtatacttttttttttttttttttgagatggagtctcgccctgttgccaggctggagtgcagtggcgcgatctcggctcactgcaacctccgcctcccagggttcaagtgattctcctgcctcagcctcccgagtagctgggactacaggtgcacgccaccacgcccaactaatttttgtatttttcgtagagacggggtttcaccatgttggccaggatggtcttgatctcctgacctcatgatccgccagcctcggcctcccaaaaaagtggtatacttctaatggataaaggttatacagctatcttcacctggtacactgtcttcggtattacctttagttttaaatgaagtgttttcttaagaccaagaattttaaattgaaattagttattttataaagggctctaaataaggatatgactacaatggatgctgctgaaagaattgaatgataaagattattaggtggcttaatgctttttgtattaatctctgggaaagtccattattgatcccaaaattgccaaggctgatcagacaggatcattacattctttctgtgctttttcaagtacttgaagtgtttttatgtaatttaagcatttttcactaatctttcttttttagtgtaactttgtataattttatgttcctttttcttaggagtctcagcagtccaattttggcactggagaacaaagtgagtatttctttccctctttgttttcaaattaagctatttattgaacattcagttttcatggtcacaccatatataactttagtaatacctttacatgtcatatcctttttcatttttgttttctttttttttttttctggagtgtagtggtgtggtcgtagctcactgcagcctcgatctccagggctcaagtgatcctcctgcctcagcctactgagtagctgggactgtgggcacatgccactatgcctggctgattttttaaatttttagtagagatagggtctcactatgttgcacaggctggtctcgaactcctgagctcaagtgatccacctgcctcgcctcccaaagtgttgggattactggtgtgagccaccatgccctcgtatcctaatttttatgatctaatgggtagtagtgggttgagctgaaaaattgttatgctttaaaaaattcaagaactgtaagtcattggagatcaaaatacactacttttattaagcatttgaactaatagttcatgaatacaatttgatgggcacctcgtaaactcaagagttattcttctttcttttaacttacttcatgaagatacttggctctatgatgataaaactccgcacaagaagggtcattttatttagctgaccatggcccttttcttcttatatttgtacagtccctgttttttcttccttggttttctgatctgggtagaaaatctgctgcctgctataccctcacctttacccttactctcttggcctgtcagaagaattctagggaagatagtcttatggtcccaagagattgtggttgtgtagattgagagtggtaagatcaggaaccaatgcaaatgtctgggctttaccgtatacctctgtaacaaaacaggtattctttttgccaagagcagtaacttcttaattaaggtagatttgtactagtcataaggtattttggaaatgaaaatgtggaactttttgatccttagtttatcttca

SEQ ID NO: 117461 - DNA, 1028 bp, Homo sapiens
gtaaaacacttagcacagtgtctggcccattcaaggtacacagtaaatgttagctgttttccttatcattgtcccttcctcccactctcctagcaagctcttcctgattagcgttttattatgtgccttgtatttgattacaggctgatttctgtaactattcacaggtttcataatttgaattgtaaactcctcaaagccagggagcatttattaatcttcttattacctacaccatagtgcctagcacacaattgtgcttaatatttattgactaagtatgtagaattttggaggagctgtcatgaaaccagtatttataaatacaaatctggtttttagctgtataatttttatccttgacctggttgaaaacaaactgtaataattacatttcaggagatgacgcattcatggcctccccctctaacggctattcatacaccatgcaaaacagaaccttccaaatttccttttccaactaaggtaagtaaataaaatgtatctttcataatgtaagaaaactctaaatggcttgactaaaatcatatggattaaaaattgtcttgccattcctattctagtgggagacagacagtaaataagtgaataaatagataaattcagatagtgacaactgttatgaagataattagcagggtaatggaactgagagcatcttggatcaagaggtattaagaaagctttgaaggcaatatgcgagagagatttaaaagacattaatacagccggacacggtggctcactcctgtaatcccagcactttggaaggctgagccaagagactctcttgaggccaggagtttgcgaccagcctggtcaacatagcaagaccctgtctctaccaaaaattggaaggaaaaaaaaaaaaaaaaaaaaaaaaaagcttggcatagtggcacaggcccgtggtcccagttactcgggaggctgagatgggaggatcacttgagcctgggaggtcaaggctgcagtgagctgtgattgcaccacagcacgccagcctg

SEQ ID NO: 117462 - DNA, 1300 bp, Homo sapiens
accaaaaagtacattactctattggaaaaagagaaagtccagtgaattagtgaatgacaatgactactttttgcttagtagagaaaactgtcagtcacatattacttgtattttcttttttatttttttttgtgagctcctgaatttgtgtctatacttaaattcactgtgaacacctttgaaagactacctgcattggttgcttccactcttttctttcccattccttcctttagcccactataatctcccttttacctctgccattttgctgaacctgtttctctatggtcattatctttctccctccatccagaggcatcatttgagttcttttttattctttctgctatgtattttttccttctgcaaacattcttctttccttgactgtttttatgcttcattgtttttatttgccttccacctttcttgcctctctttctttgccctttttggaacccttgtgccttctcttgtttcttaagtgcaggtgcattcttctagcctctgctctttgacttgccttttccaccattcttggctttatctcttagacagctatttagtctttctgtcctacactggcctttgggttttggtttgtctcttaattgcttcttagctgagtttccatttggatttatttctctttgcctcttcagactcaacatgtctaaagccatacttatcagacttccttggattagtagtacaccgttttcccatgcttgtaactgtagaatcctaaatatctctaatttcttcctcatgttctatgtagttgcaaaactagatgtagactttaaaatttttgctttttaaatatccattcctttcttcccgtttctgccgccttgagcttcagtaattataacagaggcctcattcagcctttctgcctccagaatctccctactcatatgtcttttgcattgctacctgattctttacttcaggccctgtggtcttcataaattaatttttccctaaaaattttcagtggctctctaagattatagaaagaatagtatccaaatttaatatccgcaggccaatcctaacctctctcattactgactgaccgcttttgctaaactggtttccctaagccacatacattctttctcttttacctccttaaataaagtaagcttggaatgtatttctcctccctcttcagttatatatagattttttttccctgtaatcccaatgaaatacttcttcccccgtatcagattgtgagaccacagtgatagctctttcatttgaatctcattcatttcttagttgccat

SEQ ID NO: 117463 - DNA, 1972 bp, Homo sapiens
caggtgatctgtccgtcttggcctcccaaagtgctgggattacaggtgtgagccactgcacctggcctttcaaaatactttgtgtatttaaaagacagtcttgctatgttacccatgctggagtgcagttgctcttcacaggtgaaatcatagtgcactggagcctcaaaatcttggaattgagcaaacctgcctcagctgcccagagtagctgggagtacaggcacgtgccactgtgctcggattatattttactatggttatttttaggcacttttcaatgattttttttttcactacagaaatgatatatttggagtttgcttcaaggtattaacgttaagatatgaggtaaagcctccctttgaaaagcccctttccattcgaagtttggaaaattagttcagaattatattttatttctgattatgctcattttataattttattttattttatttttttgtagactagcaaagaagataagttatcaagtcgtattcagagtatgcttggaaactacgatgaaatgaaggatttcataggagacagatctataccaaagcttgttgcaattcccaagcctacagtaccaccatcagcagatgaaaaatctaacccaaatttctttgaacagagacatggaggctctcatcagagtagcaaatggactccagtaggacccgcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgtaagtcacacatttagagcttttaacattgtgactacgtgaagcaattgactgatcatgaaattacgattgaacttgaacactgcttccttgccttaatagtaaggaatgtaaaagttgaaagatgaaaaaaatgtaaagacagacttgtgagttactcccaagtggatgcgtagatctgttaactcgtcctcttgggaaatggagaaaatgtcattcacagttttcaaatacttagatgacaagtcagttatagaataaaagaatgactaattgatatcttagatttctgcattttgattttatagaacaatatacctttgttgttgtttaaaaacaaaattaacttttctatgcttagattgatactaatgaatgagatgcaggtgatggtttatggttatgataaatgggacttttgggtctgtggaaatagtaatattgtatactttgaatgctatgatccttttctctggttatacttaaaggattaagacagctgctccaggttcatagtgatggtttgaaatttaaattgaattgcttaccaaagcattttggaacatttcattgtgaaatagctgaaattatatctttttttttcaagatgggtgtctcataatgttgcccaggctggtctggaactcctggcctcaagcgatcctctcatcttggccttcaaagtgctaaggttacagacatgaccat

SEQ ID NO: 117464 - DNA, 1352 bp, Homo sapiens
tgatttatgaattataggccagaaatgctccacacatataacctgattgtttctttctgggctccagtgagcctttttttttaaaaaaaaaaacaaaaccaggtctgattatttaatctgtctccagggaagagtgttgcagattccctggtaatccctagtgccagagtttgccagcctttactaccattgtctgtttaatcaaaatccttgctgctataaattggctgtatttctcttggtttgttctagtgaaaataagacaaactgtcctgattatagagatgggacttccattttcccctcactccaaagacttcctttttcaatacaagtttagttgctgttactaatccaagttaatttttgattctatcactgaaaacctgggttttgccatttattgaggtgttaattgaaatattaatatatttagagcagaaatgtcgttttttagggaatctagagcaacagcaaagctgaggtcaaactaccgtaaggatggacaccaaggaagctgtgtttgggacaaaaagaaatcaagataaggtagatgcaaagtagagaaaagaactggaccctggggggaagggtggtagttgggagtgggttatatgcttctaagggcaaagaataggcagatttctgaagaggagggcccaaaaggaaatactgaggatttgtgttcaaatactacgttccctctgaatgtacaagtttttgcttttagctaacagagtacttcaaacattgataaggttaagtgttttgttggggtgggttctaatattctgggctagtgtttccttggaatagttgtggaagacactattggtatttgttgataaaaccattaccaaaacccagcttcagcactaatgcctgttattacttggaggtcaaaagggaatctgtgattgaagtgttaagctgacaaaatctgtacagaatatttaatttttccttttatttctgtgatacaaagattgtgtttcttttcatagcaacatgaaccgtgaagaccggaatgtgctgcgtatgaaagaacgggaaaggcggaatcaggaaattcagcagggcgaagacgccttcccacctagctctcctctctttgcagagccatacaaagttgtaagttgcccttctgtgaatgtttttttcccattagcatgacatttttgcttttaaaatgtttcacacttgaatgtttatattagaaaagaattactatgaataccacttaacatttttttcctgtcctttacatagaagatattttttggggataaacttttctttggagtatattatgcttacagaaaaatacacaacataggtattatggcttgaag

SEQ ID NO: 117465 - DNA, 1576 bp, Homo sapiens
atgtggtatgaacatttaaggcagctgatgccccaaacaggcaaagtcgaagaaggtggcctgcatttggaggtgattttgcatccaaaaaggaattcgctttcttgatttcaatgactgaacactgtaaaacatgtcttcttcctcaaggccaatgatgcttcagataccaggtggtttcatctttcagtcatggtctatagagagggttgcattgggccaaaattgcaatcagccaaaagagagtggcaaactgaacaggtcaccatcatggtgatgataactccccagttaggccgcttagtgacgaactagggcacaaagaagccaacaaagccccagaacatgctcgtcactgtgaggccatgataacgctgtgtttgctgctggagctgcctctctctgatttttagtattgttttttaatctttgtccattaagacaaggttatttgtgaatgaaaattaggattgtggggagtcacagaacttcgtgaaatacttgtgaggaatgggaaagaacattcatcagagaaaaacagtacaatttcactttgggaggctgaggtgggcggatcatgaggtcaggagatcgagaccatcttggccaacatggtgaaaccctgtctctactaaaatacaaaagattagccagacatgttggcgggtgcctgtagtcccagctgtttgggaggctgaggcacgagaattgcttgaacccaggaggcggaggttgcagtgagccgagatcgtgccactgcattccagcctggcgacagagcaagactccatctcaaaaaaaaaagcacaatttctgggaaactttgagggacgagttgagaatgatttatgaaatacagtaagaaattcacataatacataaggatgtgatgaagaaagcaaaaatgtgtggaattgttatctttgttttcacgtttttcactacattattttaaacctgaaggctatagaagtctcatgactaactttggggcaaaggtccttctgtgctaaatattgtcttgggacctgatgttttgttattggctttgatctgtaggtgtacaacctttgtttccctgacttgtaggaagtgacctcttcagactgtctcatgggtagagaaattctaccaaatgaggccaagagggatttatgtactgttgaggctttgtgctttagcatagtgcattgtggtaaagttacagtttaatagcagttgtaatatactgggtttgaaaataattgaaatattagctcaaatctcattttgactttcagagtttaaatcactcaataatcttatagttgaatgactctgtttttcagtaggatagttattttaagacactaagtgaaaaaaacaaaaaacaaaaaacattgtaacaaattctgacctccacttgaatgggggatgttagaatacacattttacactaaatagttttaattttttgttttcgaggcagagtcttactctgttgtgcagcctagagtggagtggcacaatctcggctcactgcaatttttgcctccgagattcaaatgattctcttgcctcagcctcccgagtagct

SEQ ID NO: 117466 - DNA, 1018 bp, Homo sapiens
ttgatgggtagcacaactgttcactgtattggtccttatcttttagggtaacattttataaaatgagtggttgctgaggaggtggagaatcaccaaaagtccttttgagaagcttggctggagagagatgtggggccaatgaagacttttttttttttttgagacggagtcttgctttgttgcccaggctagagtgcagtgtggcgatctctgctcgctgcaacctctgcctcctggttcaagcgattctcctgcttcagcttcctgagtagctaggactacaggtttgcaccaccacgcctggctaatttttgtaattttagtagagacagggttttgccatgttggccaggctggtcttgaactcctggcttcaagtgatctgcccgtcttagcctcccagagtgctgggattacagcagacatgagccaccatgcctggcctttgttaaaatttttttaaagaagaatatgtttgaatgctgatggaaaggattcgtaggattcactagagatggagaagttgaagttgttggagaaaaaatcgcaactgctaaaggtctagaagatagcaaaatgaggataattgttctttgttaggaagattcgagtttttttcctttgtcactgggagggaagagaatagatgtagacgctgatagtttgaaagttgatggttgattgataaaaatatttttcttccattgttttttatttttattttattttatttttgacatggagtctcgcaccgtcgcctgggctggagtgcagtggcgcaatcttggctcactgcaacctctgcctcctgggttcaagcgattgtcctacctcagcctcccgagtagctaggattacaggcgcccaccaccatgcctagcttgcttgcttgtttatttatttatttattgagatggagtttcgctcttattgcccaggctagagtgcaatggcacgatctcagctcactacaacctctgtctcccgttcaagcgattctcctgcctcagcctcccag

SEQ ID NO: 117467 - DNA, 1813 bp, Homo sapiens
tgataaagagcctttgtggtctgtgagtctgcctagaatcatctttggtcatacgtgcataaagaagtgttggcaagtggccacttggttttcaacaaagctggcttctttaaatttctcagattcgttttccttattatcactgcatctttcagctcctaaatataagaaaaattcccagtaagttattttaagttatctttcagagttaacttactaaaaacctggaagcagtcaaatttttctttttttattaccagcagtttcattcaatttgcggtggtttgcaggctggtactttgatttttgttaactctctagaaacagtaggcaaattttactttaaataaaattttgcttcaagtggggacaagatggggtgtctgaaaaaagagcccagctgtgttaattggaacatgatctacagtttgggagtgtaaggtgaagctgtgtaattaagaattcttaaagattgaatatttttgttctgagtcactttctacttgtcagattctcacattcaggttgatacattctcttctgtgtactcttgagttattgtaccctttttgtagcaatatattctgcagccgggcctggtggttcacgcctgtaatcctagcactttagcactttgagaggccgaggtgggcggatcacctgaggtcaggagttctagaccatcctggccaacataatgaaaccccgtctctactaaaaatacaagaattagccaggtgtggtggtgcacacctgtagttctagctacttgagaggctgaggcatgagaaccaaattagccagacatggtggtacatgcctgtagtcccagctactccagaggctgaggcacgagaatcgcttgagaatcgcttgaactgggaggcgaaggttgcagtaagccgagatcacaccactggaatgcagtggctccatctctgctcactgcaacctctgcctcctgggttcaagcgattctcctgcctcagcctcctgagtagttgggattgcaggtacacactaccattcccagttaatgttttttgtatttttagtagagacggggtttcagcaggttggtcagactggtctcgaactcctgacctcgtgatccacacgcctcggcctccccaaagtgttgggattacaggcatgagcactgcgcccggccaacctaggcgatgtctcaaacaagcagaagcctactatatgttttgcactgtaattttctttttttccctgtctcttgcagatattgagggatgcataataattttcttacagatctgttacagggtctttgaggaagtactatatttattcctctttttatcttcctcagtattttacacaattactagattgaatttgaatgtgataatattttgaacttgaaattgttgttctatcaacttatctaagatttcacaaaaaggtaatgtaaagaaagctgtatgagcaaaggatcagtatttgaaagggaaaaacctgtcagtttcagaagatgagacagaagatgaagctttctaaaagttatatattttgccttttttgagaaggtaaggtaaatgccgtagttttatgtgtacctgagaggaacaaataaaacaggtatttcttcctttgtggccatccactggtttagaatggagttcaaaatctatgaggacttttctttgtggtatttttaataaaatcaaagaggtattcttaagtattgagagcacacctggacaatgacccagaagtacagcatgtactataaaaaattgatgacttagatttttttttactttagctttattctacagat

SEQ ID NO: 117468 - DNA, 1108 bp, Homo sapiens
ctggaggtaagaagggccgacagactgacccagggccgggccgggccgcgggggttgtggccggggccgggtgggggtgggggcccgcaagttctgcggggagcctcggggagaccctccgggctggggctgctcaatcaggcgtcacccctcctctcatctgcgcgtcccaccccaccaccttcccgcaaagataagaaaataaaaaaagctaacccaatcctaacaaaaattcccagaaatccatccgtttagtgtttctcctttcctctttctttcctcagacgttccatcggctgatttgttactttttcatatcctcctcaatttcaaattatgtctaattaaagagaaaataggcccagattctggctaacattacccagctagttctcgctttccttctcgcgatcctgcgcacctctcccacacccccacccccgcaaaaaaaaaaaaaaaagaaggaaaaatttccgccttcgacttgcgaaggggattgactaaaaatgggaacgtgggggtataatactcgaataccctcccctacaacttctgaatcggtctgttacctagttatcccagtagcttgtgcgtggatattgatgtttaggcctttcctccagctgcctgtgcttggggttaatctcgtaattgacgtcagtgctttgttccttctactttgctgttccttccactctttgaggatggatcatggagtacaggagttttgggagtaaccttattgccttttcgtttacaaacagtattattttcaggaagtggaagtacgaatctgaaatgtttgtatatggagttcaaggcgaagagttcgatttagggttctcgtagttttgtcagttgtaattcagaattatgcggtttcttccctgctggccacatggaaattttatactaaggccagtcacttttccattgaccagtgtttttcttgatggaatctaagctataggtgtctgtgaatagactgtaaatgtaacataaaatgtgtgctgtttttcgggctcagatatgaaaagcgcaaagcttcgtttctgtattgattctgcacttcataaagtgctttttaaaacttaactggtctttaact

SEQ ID NO: 117469 - DNA, 1050 bp, Homo sapiens
ccaccaccacgcttggctaatttttttgtatttttagtggagatggggtttcaccatgttagccaggatggtctcaatctcctgacctcgtaatccgcctgccttagcctcccaaagtgctgggattataggtgtgagccaccacacccagccggaaactcctatttttaaaaccatcagatcttgtgagatttattcactatcacaagaacagcacaggaaagacttgcccctatgattaagttacctcccaccaggtttctcccacaacatgtgggaattcaagatgagatttagatggggacacagccaaaccatgtcattacacttattatactttgttgtattaaatctcacaagggtaaaatgttgatttttatgaattggaccataagagtaaacataattttatcctttatatttttttatagtttttagggtgaaagtcacaagacagaattttaaggcttgtattctgttttttgttctgtagtgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaaggtaggtttacatgtggtatccaaaggaatatttttttaatgtgtatatagaatttattaaaggaccaaacgtttcatggtggttctccagattttaattataatgttactaatgtttaatagatgcttactgtgtgccaagtactattctagggtctttataagtattagcttatttaaacctgatatctacactattaaggtaggtagtattattgtcttcattttacatatgaagaaactaaagcaaggagatgttgaataacttactcattgtcatacagctagtaagaagaaaaagtaagtgttaaatcatgcagcctgtcccccagattcatggtcttaatcattttgcttttttgcctcaactgtcaatgaaatgacaattgaattaac

SEQ ID NO: 117470 - DNA, 1897 bp, Homo sapiens
acatctctatgcagctgtgcagcgccgcaggttccatgcgcaggctcggttggctaaatgcgctttccagccatctttcagccacccagtcctttcccaggttctcgagccaggacgtgacgtattcagacgtactgggggcggggcctcaaggggaaaagcgcctgagccgggatatcgcgagaacatcccgttctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccgtaagtgtgggccgggcctgccgcgtgcactggggttaggagataatgcttgttccagtctgggaccctcgctgcttggggaacgcgggccgaggagtcgcctccgttccgagccgaggtcccggtaggtcagggacccccagtaggtattaggacactaggggccgcggcccactatgagcgtgggtgtgtgctaagcgcgagggccttttccccggtggcccgtcggccgaagaaaggcttctggccggtactcggaccagcggagggcacgggtaggaactggaaggactgcaggcctaggatgtaaacggatcgcggtccttttcttgagggcagagaccaggcccaggtcgtactgagtcttttgagtccaacagaaagctcagaactttgcacacagcaggcgcttaataatagttgaatcgaacgggttctggggcttgccagccgcgagaccgtggagcggtcagcgtcccacgtgagtgggggcggggcagcgcccggaagagagcgagctggagcagcctcaggcacgggttccggatggactcggggtcttgagattgggttggcacggataggaatttaataaaatcggtgctcttatgataactttgcaatcgcttttgttttccacattatttcgggatattgtgctatattgggtcactctctgttttgtgcgcgttaacccctcaatagggttgcactttaacgataatgcattctaaccagtgtgttggccacaattgttagtggctcaagggcccgccttgacttctagaacccatagtaagttttgggaccagcatagacacagttctaaaaaatggtgggtcactcaggtctttcactggttacagtgtctgccttttgaatacttgtagatacattttaatccgttgtcgtgttcttagacaaaatcttgtaagaagttctgtattatttgccattcagggtctctcttctttttttttttttttttttcttttttgagacagacagggtctcactctggctgcccaggctggagtgcagtggtgcgatcttggttcactgcagcctcgacctccctggctcctggctcaggtgattctcccacctcagcctcctgagtagctggcgttgcaggcgtgcgccaccatgcttggctaattttatttatttttagtagaaatcgggtttcactatgtcactcaggatggtctcgaacttctggactcaagcagtcctccagcctcggccttctggagtactgggcttacaggcatgaaccaccgtgccctgcccaggggctcacttg

SEQ ID NO: 117471 - DNA, 1054 bp, Homo sapiens
gtgatatatatgaccccatacaccacggaattgtgataagaaaattccatttaaataattttccttacatgttttctttatattttccttcatagttttcattaacttacaggcatgccatacatttcaagtgatttctgaactgtatgattttgattcactttgattactctgttttggagtcttgggctaaatagaaaatggtagcaggaaggttgatttttttttttttttttttttttttttttttggtagcggttatggaggaatggatttggagctcatatgtaaaaaagactgcatgttgtgggtttgttttaacatgagagtggaaatgagatgcaagtcttagagggtttatgatggtggaagtacctcgtttcagatatgggtgtaacaatctggattaggtttttgaggagccagtggagtctcatccagaagagacccttgattttccacccaatttaggcttccttcattttatcagatgttgagtgcctctgatgtggtagccatttttctaagcactggaggtactgtggtgaacaaataaggtcatgccattatggacatggctggtggattaaaccaaatactaaacaaaaatatgtagtaattactaactgtggtaaagggcaaggtggaaaagtacagaatacagtgagagtatagaataagcgggtctaatttaaattggatggaaggacctggcacgatagctcatgcctgtaatcccagcactctgggaggctgaggtaggaggatcgcttgaggtcaggagttcgcaaccagcctggccaacatgctggaaccctgtctctactaaaaatacaaaaattagctgggtgtggtggcgggcgcctgtggtcccagctactctggaggctgaggcagaagaatcgcttgaacctggtaggtggaggttgcagtgaaccgagatcatgcactgcactccaacctaggtgacagagcgagactctgtctcaaaaataagttgggtagaaggtgctttgaaagaagtaccatctgagacctgaggatgagtaggatt

SEQ ID NO: 117472 - DNA, 1205 bp, Homo sapiens
gttttttgttttgtatttttagtagagacagagtttcgccatgttggccaggctgatcttgaactcctgacctcaggtgatctgcctgccttggcctccctaagtgctgggattacagacgtgagccaccgtgcccggtaaacgattactttttatttgggggctggggtgggttgagaaggctttacagacaaaataggtggaatttctagagaatacgtgaaggtactaagcatttcagacgtcaaaagtgacataagcaaagcaggaagattgggatactttattcaacttgtgttgattgtgtggatgaaatacagctggaaaatgggattgggttgggagaggccttaggttccatattaaggaatataggttttatttgttggtagttggttttgtttggaaggtaattagaagcaagacagtttcagagttactgacatagaataggaaattaacccttcagcaggatttgcaggaaagttggggattgtaattattttgaggagataaaggtttgaaaaagggctgcaggaaacaatggaagatgagtaacattgccttttagttatgttgtgattggggtcatggtgggatataccttagaaatttagatctggtggtatttagaaagatggaggtgtgccaattattaggcttatgctaggcagcctttttgaggtggaggaagtgggtaagattgccttgggcaatttcctaaagggtaatatgggctttgagaggagagacatttacgtggtagtgaggatttttttttatttatttgcatctagtgtctaaaacagagattttatttgttttagtgattggtggcatagttgcagaaaggctgagcttgacacctttgcttttgaggggctactcccagcactttctaggcccaaaagcttaggatttggaggaattctgatgaggtcctagggtgtaccatgtttgttcttcctgtcatttaatagaagtcatggcttcctgtggctgccctgggagattggcttacaggggttcttagccattggttgtgaaggaccactgaagcccagggaggcccagcattctgccagtttccacagggctcttaagtttatgtttctaccaaatcagtagttcatctaatttagtcagatttggaccaaggcagtatggttccagagctcttatttactctgttgacttggaagaat

SEQ ID NO: 117473 - DNA, 1004 bp, Homo sapiens
ttctgcatctgtagattcaaacaactgtggatcaaaaatatttttgggaaaaaatacaacactggaacaataaaaaatacaaatgaaaacaatccagtgtaacaactacttacatagcatttacattgtattaggtgttataagtaatctagagacaacttcaggtatacaggaggatgtgcataggttataggccaatactatgtcattttgtctaagggacttgagcatctgtggattttggtctaattcaaggagtgccctggaatcagtcccctgcagatacccaggaaccactgcttcagtgagaagcacctggccttaaaatagcattagcagtataatctgtttaatgcaaactgccagggtgtattttgtccagatcttgttaagcaaggcttgcttgttccttgatattttacatgctccttaagtctgtcttgttgggcctttcatcttactcatatataaggtaagtgttgatcttgttaaacaagtttctcaaggaaggaaagcatacctctagaaatacattaaaggacttgcttttagtttactctgtaaaccaggaacctgacgtagttgctggtttctgaataaccagagcagcagaaccccaagagttctgttattctaagtgtctgagatatctgtaaaattaaggagttgcatgtttgaccttcttatggttcagcctggagcaaccctatagggtgaatctgtttttgaatggggcagggcctaaaatttattagcctaaaaaagtggtgcttggccaattggtttttaattaagttggatgttttatagttcattttcacagtgttcgagatcttttaggagacagcaggtagaaaatattgggccattttgaaatctcttccttctaaaatttgagcaaatcgctcctgttttttaaacctgcttttcatgattgagagacagttactatactaaactggctgcccagttctaggttgatacagttattgtgttacagagtt

SEQ ID NO: 117474 - DNA, 1446 bp, Homo sapiens
catgcctcagcctcctgagtagctggggttacaggtgcgcaccaccatgcctggctaattttttgtatttttagtagagacagcgtttcaccatgttggtcaggctggtctcgagctcctgacctcaaatgaggccctggcttctttcaaagtgctgggattacaggcgtgagccatgacacccggccttaactagaatttctaaatcaatttatgtattgctgagttggttcctggaaactttcaaccataaactatgggcaatttttaaaggctaaaagttattttatgtaaatgtttattagaagtttaagaacagaaaatacttatgcaagtataatgacctgacttcatgggatataggaagagcagggctctatttttagccctgccactctgagacccatgcaaatccctcctccctcacttcgcatgctagtgggcaccatttagaaaagtttagggtctgaagaaaccaaaaccaagaaggagactctatataaagttaaaatgttgctaatttaatctgaggctgttgaaataaaaaaaaaattagtagtagtctttccactctttgatattctttctcttaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtaaggttgtcaggttaatgccttttaattaaaatgcattattatattttatcagttcaatatctatctgtacttttctgatgtcagattgcaatgaaaatgcttacagttgcttagggaaagcttttttctagtaaagactatttgacaatttttgaatgatctggatgttggttgggagccatgagtggtgctcttaatatgggttggagacctgggtagtgatggtttgaagttaatactgccattgctgcttgttttgctcactgatgcagtgggctttttagcatgattttagggaatgacttctggaagagcaggcaaagcaatcacagttttttttttttttttttgagatggactctcgccttgtcacccaggctggtgggcaatggtgtgatcttggctcactgccacctctgcctcctgggttccagcgattctcctgcctcagcctaccaagtagctgggattacaggcacgtgccaccatgcctgggtagttttttgcatctttagtagagacggggtttcactgtgttggccaggttggtctcgaactcctgaccttgtgattcccctgcctcagcctcccaaagtgctgggattacaggcgtgagccaccgcacctggtaggaatcacagttttaagtcactagcagatagatggacatactcttggagataggatttaatttagaaagagatgttct

SEQ ID NO: 117475 - DNA, 2056 bp, Homo sapiens
gagttagggcagcagctaaaagaagagagcaacatgttctattctggattgtaatttgggaatatgggcatgtaggatgggttgggattgttttaggcagtccttcaatatttaaaattcgtaactgttatcacatttgcagacttttatctggaatagggctttatcttgaagctttgttcattattgttacttatttaaaatttttttttttttttgagacaatatcactgtgtcacctaggctggagtgcagtggcacgatgtaggtttactgcaacctctgcctcctgggttcaagcaattctcatgcttcagtctccctagtagctgggattacaggcatggaccatcatgcccagctaattttttgtgtttttagtagagatggggtttcaccattttggtcacgctggtcttgaactcctaacctcaagtgatttgcccgcctcagcctcccaaaatgctgggactacaggtgtgagccactgcacctagcccatcttttattatttaattcaaccagtatatattgtgccaggtcctgttctaggtgctggagctatggcagtgaacaatcagacaaatgcatgtcctcatattagattgaatcctaattgtggagatggataataaacagtaaacacattaaaatacacatagtatgtcagatagtaaaatagtttctaccagcagcctctttatggagggacagtgtgggtcatggtgagctacactgatttgtctttgcaaaggaagttgtcttaagatttgttgttttacactgtggtccttcatctccaagtatcgtgtttggttgaaagctaaaataggctatgcgtggtggctcatgcctgtaatcccagcactttgggaggccgaggcaggaggattccttgaagccaggagttttgagaccagcatcggcaacaaagcaagaaccctgtctctgcaagaaaaaaataaattagctaggtatggtgacatgtgcttttgctccccgctacttgggaggctgaggcaggaggattgcttaaacccaggaggttaagtctccagtgagctgtgatcatgccacggcgctccagagagagagaatgacagagagagagaccctgcctccaaaataataataataataaaaaaagaagctaaaagtgaccttcaaggtattacttcgaaaactagctttttttttttttcaatcccctcttgagataatgttgcattgataatgggaagcattgttcattttagcttttaggactaggacatgaagaaagaaatataataagtctaggcccctttgttgttttcttgcaggtgacatatatggaggaagagcgaaattttaccactgagcaagtgactgccatgcttttgtccaaactgaaggagacagccgaaagtgttcttaagaagcctgtagttgactgtgttgtttcggtgagtttgatccctatacattattgggaatttgcatgaagaagcagagagaagaaagctgctaatttcaagtaaacttgtttttttgtctcaggttgtaatggttatttaaaatgtttgtcaggccgggtgcagtggctcacgcctgtaatcccagcactttgggaggccaaggtgggtggatcacctgaggtcaggagttcgagaccagcctggccaacatggtaaaaccccgtctctactaaaaatacaaaaattagttgggcgtggtgatgggcacctgtaatcccagctattcgggaggctgaggcaggagaatcacttcaacccgggaggctgaggttgcggtgagccgagatcatgccattgcacttcggcctgggtgacaagagcaaaactctgtttcaaagaaaaaaaaaatttatgaaactagtcttcattttcttactctcttctgctgcttagcttttgctcaggcctcctttgttattctgcctatttaaatctcttctgtttttcaaggtgcattcatctcagcctgcccacttcttcctgtatttttttcatcgcctagcatagcacagggtagccactcatttgttgaattagtt

SEQ ID NO: 117476 - DNA, 1063 bp, Homo sapiens
gtctcaaaaaacttatccaaaaaacaaagacatggcagcagttgactttatcttttgcatatccctgttaagatggaagcctggctactgtagttttgtgctttagtttggtggaatccttagggactgttgaaatatgtgtggttacattggctttgccaccgaatctcctcattctgtaattgttacctgatactttagtttcatggcctcttttgtcttaatgttggtgcattgattggcaaagcaaggactgttaggtggctttttcaccccagagtctgttgcctggcggatttcttggtccttggttattgtaaagtagaattgacatttgtcagaaagaattggattatagttgtgtacaccattctgggggtgggctttattctttatagaagaatgaaaattctgtgttcctttaaaaagctcagattcagtgaccttgattccccagtggctgatacaccagatcctgtatttcttagatgtttcctacctttcctcagctcttccattggtctcccagatttgtttccattcctccatctagtgcccctagctttgatcctgcataacactctgtgtgggagtaaaatttatgtaaaatattggaatgcgtaagtgtcttccagttttgggtatcaagttaaaaggtgatagtgttgagtcatgtttgggtggggcctcaagatcacactggagttttggtaatttgcttaggagggttcacgggccctagcgtatagctattctcatgctaagatttattgtagtgaagggatacaaagcaaaatcaacaaagggaaaaggcacatgaggcagagtctggaggaaaccaggcacaagcttcccagagtcagcctgtgcttaactccagcaacaggttgtaacaatacgggtgaaatgtcctctaccacaggagttctgcctagcctggtccagggttgtttttttttttttttttttttttggagactgagtttcgctcttgtttcccagctgggagtgcagtggcatgatcttggctcactgcagcttccacctcccaggttcaagcctc

SEQ ID NO: 117477 - DNA, 1050 bp, Homo sapiens
tggggaaggagaacacttagcgtgtggagcagtgctttgggttaaagactggtcttctcttagacttgtggactggtagagtcagaggaatgggacattaagcagcatctcatggacagaacatgcggggatgttaacatagcataggggtagaaaagatccaggaaaatatatttggaaaatgggggaaatggcttggagaaaattatgccaaagtccattggcaactgtaaggaagtctaagtgaatatcagtatttaactcttggaagataatctttttcttgaataaattatacagtgcttataaagaatttgatttctaaaacataacacatgtagttgcattcgttatatataaaacctcttttttcctgcttaaatgaattttatttacttagacgttatttttaatttttgtgttttttcttctgtagttgctcttgcatatggaatctataagcaggatcttcctgccttagaagagaaaccaagaaatgtagtttttgtagacatgggccactctgcttatcaagtttctgtatgtgcatttaatagaggaaaactgaaagtaagtatatattttttttccagaagactgttagtagtatggtaattatgaaattttgagagacaatgattttttctcatctacaatatgggagaaacaatgcataccttacagggttattcagaggattttttttcttttctttcttttttttctcttttttttttttgagatagagtttcgctcttgttgcccaggctggagtgcaatggcgcgatcttggctcaccgcaacctccacctcccaggttcaagcgattctcctgcctcagcctccctagtagctgggattacgggcatgtgccaccacgcccggctaattttgtatttttagtagagacggggtttatccatgttggtcaggctggtctcgaactcccgacctgaggtgatccacctgcctcggcctcccaaagtgctggcattacaggcgtgagccacggcgcccagcaggaggattttttaacatgtagttccttgg

SEQ ID NO: 117478 - DNA, 2343 bp, Homo sapiens
tctttttttaagttaacatactaagaaaatttcccccatgacgtgtagcattctttgaagagattgtttttactggttttattccttcataaggatgtcatcacttatttagcctaacttctattactgaatctaattagatctagtttgcttctaatctgttagagatttgaaaacgggtaacccaggctaattagacttccaggttaaatagaaacacattgcggtgagctaaggctttaaggaatcctttggtagtaaactgcagagagttgagcctttggtattactcagttttgtgatactgagtagactagaagtatgtacatgacatgttagtatattttaccttggacatgtaactgctattggttgtcagactggtgtagtggggagggcatggactttggaattaaggagatttggctttgaattccacttctaccacttagtagctttgtgaactgcagtttatctcatctgtctaggtctgtagcattatctgtaaattggggattatagtgcctatttttacagtgtggggtaataaggattaaatgatgtatacattgctttgttttaaccttaatgtaaccctccctctttttttttagataaacaacttaccaggtaaatatatatcatctgtttcaaaatcgattggttaattgttagattaattctcattttttccttaaggttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaataggtaagtatattactatttcgatgttaaagtgaagagtgagttttctccacatatattaacctttaattggctaattgttaaaataatcacggaggttatatgataattttggttctattttaaaaattagaagccattcaggaccctgctttttatgtaaagttgggtctggttaataatgtagactaatgtttttgttctgataaattgaatattccaacatgttgatagttctttacatatgcatttgttatacacgagatttcagtttccaaaaaatcagggcaaagggctgtaatgcagaattaaattgaatttaatttacccagtgactaagaaattgtaattttttttttgagatggaggtttttgctgttttgcccaggctggagtaaagtggcacaatctcaactcactgcaacctccacccccaggttcaagcgattctcctgcctcagcctcctgagtagctggggttataggtgcctgccaccacgcccagctaatttttgtatttttagtagggacggtgtttcgccatgttggccaggctggtctcaaactcctgacctcaggtgatccacccacctcagcctcccaaagtatgaggattacaggtgtgagccaccgtgcctagcccgaaatttttctttttgaaatattcgggttcacttgagggtgacagctctttttgtatagtgctgcaagaattctgggtaattgacatttcggggttatcctcagaaactacccagagtgttattgttgcctggttcagttgcttggatgatgggagtaagatgttcttttggctgtgaactctactggtagaattcaggcaagactgatggtgtatttggagacatgggcctgagctatccgtaaaaaaattgaaatggtgtttattgttgctttgtatccaaatttttagtcacctctccccctacttggaagagatggctttcgtttttgttaagcagcagtcttgtgtgtgtgtatgtgtgttccatgaagtctggaggtaagccagtatgtttaagaaattgttagtgaaatgttacgtgtttgtaagagctaagtagatacttattaagtagtttaaattttttaaaaactgaatttgcctgtgtgctgttgtttgaaaatagttgtggcctggtacggtggctcacgcctgtaatcccagcagtttgggaggcagaggcaggcggatcacgaggtcaggagattgagaccatcctggctaacatggtgaaaccccgtctctactaaaaatacaagaaattagccgggtatggtggcgggtgcctgtagtcccagctgctggggaggctgaggcaggggaatggtgtgaacctgggaggtgtagcttgcagtgagctgagatcgcaccactgca

SEQ ID NO: 117479 - DNA, 1050 bp, Homo sapiens
tgtacaattccagggttgtgcaactgtgaccactatttaattctagaatgtttttatcaccccaaaaagaaaacttgtacccattagcatttactctccatttccctccataccctaggcaattaccaatatgttttctgtctctatagatttgcctgttcttttttttttgagacagagtctcagtaggtcacccaggctggagtgcagtggtatgatcttggcttgcttcaacctccacctcccgggtttaaatgattctcatgcctcagcctcctcagtagctggaattacaggtgggggccaccacgcccagctaattttcgtatttttagtagagatggggtttcgccatgttggccatgctggtcttgaactgctgacctcgagtcatccacccgcctctgcctctcaaagtgcggggattataagtgtgagtccctcttttgtttttgtgaaatattttaaaaatgtggcttaactttctgagatgttttccctccctcttttgtgtttactgtgttgttctgcttagtttggattttttaatcagtagtttttcttcagtgagttcttttttctttgaagataactttaggtagggcccagtttgctgtggttcctgaataccttatttgaggaccttttatacttgttttggaggatgccaaacccctgctgatttcagctgctgttttcaatttggctctctgagttaggttattctggagttttcaggtcaattatatacccttttgtttccttctgtttattttgtacagagctgatactaagcaggaattgtagttgtgggtggtttgtctctgcctatatgtattttgaggtttgtgggcatatttcattacctagttttgttgcaggattgtttaagcccaggagatggaggcttctgtgaaccatgattgtgccactgcgctccagcctgggtgacagagggaaagcctctcaaaaacaaaaccaaaaaaatctgcatcaaattatcacatcattcagcagttgtatttctagatacatattcaagagaaatgg

SEQ ID NO: 117480 - DNA, 4104 bp, Homo sapiens
tttgtcattggtagccgctcgtctcctttctctggatatacctattctgaatatttcacataaatttttgttcttgtttgactttaacccagcataatgttttcatgtgttgtgatatgtattagttcctcttattgtattcattcatttgtatcgctttatacagttgataggcatctgggttgtttcagctgcttgtgaacgttgatataccagttttgtgtgtgaacatgtgttttctgttcttttggctatatacctagaatggaattgctgaatcatatgctaactctctaacgtcttgaggaactgccaaacacttttcccaagtggctgcaccattttcattttctattacctgggaatgtatgaaggatccactgtctccacattttgccagcacttgttgttacctgttttttattatagccatccattccacataaaagtggcatgtgatttaatgtactgtgttttttgttttgttttgttttttatagaggcaaatttctggagatgtgcaatgatctcttagctagagtggagccaccacttcgtagtgttttggaacaaaccagtaagtatttttgtgattgaatttgtttgcgtatctcagactgtttggaaattgttatttattatcttacttttgcaagcagtgatagaaatttttattgtatgaactaattcagtggtatatattaaactttttttcaacctgtatcttccccctgcccaaagtaatcttttgaaatgtctagggaaatctaataaaagtttctccaagaaactgaattcagactgaaagttggatataagcctcacaattatttaatggtggtaaaaattgtcttttgcgatgctgatatggtagtcttataagcttttctgtcagtgaattcttccctagctggatgagagctacagcaaagtgggaaggtaggataaccacatacttatttaacaagatgctttaattttgtctcaggctaaaaggtgactgtttgatttaggaatatatactaattttcctaaaatctttctttgacaaaccatttacctggacttcactgttgtgttgattgctatttcagagtgttgggatatactgtcagcttggcacaggctttcctctttagtgatgatggcaaatgggcttatttccacactgggaaagcccatttctttaaatagcccttctcaagaagttatcaatggttgttagataaaatgtgaccaggaaatcaggtgatattaagaagtattttatgagcaatagcagatcctttgatacacaccttctttctgatacgaagaaactgtacctgtagtttattttttattttatttttattttttgagatgggagtcttgctctgtcacccaggctggagtgcagtggttcaatctcagctcactgcaacctccacctcctgggttaaagcaattctcctgcctcagcctcctgagtagctgggattacaggcatgcgccactacttctggctaatttttgtatttttagtggagacggggttttaccatgttggtcaggctggttttgaactcctgacctcaggtgatccgcccacttcggcctcctaaagtactgggattacaagcatgagccaccatgcctggcctctacctgtgttttaacgtggactatgtttatgccttggattagaacactggagtagctggatgtgattcttcttttttttcctttaatgtcaggtcagaataactcagtggtttgaggccctcttattttcctgatggctagcgtgtttgaatgtttggtctgttgatgttttaacacttgtttgtgtgagattgtgtgagaaattcaggacctgtacactgcagtacatttgaggattcctggccctcacctcctaaatcccactagctacccttcccccattattttgagaattaaaacacctacttgtttccagatgccacctgcctctgtgagtgtgggcatgagtatgtgtgtgttgcggaggtgggtgagggagttggaggagttttgttacacatctgagttatttcatcatggtaagatgttattgttctttcatttcattaaaaaaatctgtctaattctttaaaaatagagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcaggtgaatattctttcttttataggtaaccatttataaatcattgtaacaagatggcagtggtttatgtatctaataacctgggattagctcagggtgacttcagggtgttgagattccaaaacctttgttttaaaatagaggtgatgttcctaaaaataattgtactctatagcacataagatgaattaattgactagaaacataggtaactctgagcctgaagtatgactggaagtttggcctgttatgtatgtctgtatgaaatagtgtacattaattaaataagggttggggttaatagaaaaataaggaatagctagattatataggtaattgacatgatagaagtttgtaaaactgttcagacaccattaaattactaatataaatattttaaaaagaccattgattttctgaagtaatttgtatgtttaagtgatattatcagtttatattgtctatacttgttaaacggaatttttgaaaattattattctagtgtgccatcttatcgcctgctttcaaagtcagagaattttctatcactgatgtagtaccatatccaatatctctgagatggaattctccagctgaagaagggtcaaggtatcatgtttattaatcatttacatatctaaagttaattgactattaggtctgagtaatatgttgcttttcatttcagtttacataaatctgtaacattttatcatagtgcatgaaggaagtggtcatttattttagtcagaataaatttgtgtccttaattagtttctcacacttgattctgctgaaatcatcagtgccttttatgtgcagattgacgtatattccttttttactgactttatatataaagattcttgggaactcttataatctggaaataataccaattgaaaagagagagaaactaacactgtacaataattacaaacctagaacacatgggtaaaagtgttaggaatatcctgaatttgtgtttttgtctttttcctccattcagtgactgtgaagtcttttccaaaaatcatgctgctcctttctctaaagttcttacattttatagaaaggaacctttcactcttgaggcctactacagctctcctcaggatttgccctatccagatcctgctataggtaagtaaagagttggaaattaaaaaagaaaaaaaaaaaaaagcacagtggctcacaactgtaatcccaacactttgaaaggctaaggtgggaggatcacttgagctgaggagttcgagatcagcctgggcaacatagtgggaccctgtctccatttaaacaacaacaaaaaaaagcttatctacttggagagttcgcatagtagaaagaacaagtatggtattctgaaatttaggggctttagattgcaaaagaaaacctcttccagtctcgttagcaggtttagaaccagccaaatggctgttatttaattggatctcccattgtatcggcagtttttcttggttagcgcacattgtaattataacttatgtataaggtggtgctatatactataaggagttaacgaaattcagtttggaccctaacatacagttataagatgtatatagaaaatagccaggtgcggtggctcacgcctgtaatcccagcactttgggaggccaaggcgggcaggtcaggagatcgagaccatcctggctaacatggtgaaaccccgtctctactaaaaaaatacaaaaaaaaattagccaggtgtggtggcgggcgcctgtaatcccagctacttgggaggctgaggcaggagactggcgtgaactcggtaggcagagcttgcagtgagctgagatc

SEQ ID NO: 117481 - DNA, 1100 bp, Homo sapiens
tagttatagactctgggaaactcttatctggaaataatactagttgagaagagatagaaactagttatagtataaagacctagaatatatgggtaaagaaattaggagtatcctgaatggcatttagaagctgtggaaagttaacctattcttttttccccatctgtaaatctgtaaaaccaggaataacaatgataattcatactttgcagagttctgggaatgaagaaaatgtaaataaaaaccttgtacagtcactggacctagaaatggcaatttactgataaacgacaagcagagtggaatcattttttttttctgttttgttttttgagtagagaatgtgacaaatctgttttaggaattaatctgaaagtagcatataaagataaatggaaataagaaattggaagaaaggaaagaatcgggagatatttgagttcttaattggggcaggataagataataagagactgtgaaagaagaaagagaaatctgatgatttaataagattctaaaaggaccgattttgcttattttaagcatcatgttactgagctatcattgaaagtagacataatctagcaatgtaggcatatattcatgcttgaattcatcctcttaggttatgtgttcttttgtctctcgtatgtccctagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagaggtaatctagacattgtataccacttgtgatggcccagaggtgacttgtctagaaattgtagcaagcagacttggtggcaaggccggagcattgtgacagagctgctgagtgagagtgggtttgtatgtttgcccttcccccaatataagtgaaccagcagtagatttttatgcagaatttgtatagaagtggaacacaagttgatttcttctttcagatcatacacttctcaacttgagttattcctgattctggttgt

SEQ ID NO: 117482 - DNA, 1179 bp, Homo sapiens
tgcttgggtttcatccccacagattttactgaagttggtctgagctgaggtagcagtagttttaaaagcctctcaggtcattctaatatgttgcaggcattgagaagccactggttcaggctctccacaaaccttctttcattgttatttttaggctttgtaattttaacgtgttcgcctccccgagcacatgcagtggtcatacttttgaggatgaagagaggctgacttaggaactatttgaaaaagttggaacttttgagagaaaatacctttgaggaagcctggagaagcttatgctctcttcaggttgtattttgtagattgtattaaatgatgccacattgtgaactgtgagtacttaatggtgtacaaagcagttccacagttattcttgtgtatgtaagggtagggcagggcgagtgttatcctcattgtacagatgtattaactaagatccagagcggaaaacttctgtgtcctaggtaatgtggcctacctggaattttagcataggccttctgattgctggtaattcagcaggaattacataactatgtgactttgtcaatgtgtaatgaaggttgtttagtcttcctaattgcaggatttaatttgacctgtttttcagaagatgcaagtggaccaggaggaaccacatgttgaagagcaacagcagcagacaccagcagaaaataaggcagagtctgaagaaatggaggtatgcattgggtggtgttttttttttttttttttttttttttttttttgagacagagtttcagtctgttgcccaggctggagtgcagtgacatgatctcggctcgctgcatcctccacctcctgggttcaagtgattctcctacctcagcctgctgagtagctgggattacagacgcccaccaccacggcagctattttttttttttttttgtattttttagtagagttagggtttcactgtgttggctaggcaggtctcgaacttctgacctcaggtgatccacctgtcttgtcctcccaaagtgctagtattacaggcgtgagccaccacacccggctgagttgtgttttagagtatgcactgcagtctttttaaagtacatggttttggctgaggggcagtgtcttgaaagatagttatactagaaactcttaatttatttgaacaattttttt

SEQ ID NO: 117483 - DNA, 2183 bp, Homo sapiens
tcataccctcctcctcactaacttcatttgaatgtctatatgtttaaataaaggtagaaaaatttttaatagtaattatatattgatacgggattgtaggagatatgtattttataaaatttaccatcttaactgcttttaagtgtaccattcagtagtgttaagtagatagacattgtggtgtaaccaatcttcagaacttcatcttgaaaaactgaaactctatacccattaaataactttccattattcccctcccccatcccctgacagccactattctgcttccatttttatgaatttgactgctctagatacctcattgtatttacttattttttattttctagatgttatggtagtcctaagttacttagatcatcatcaaaagagaacgaagtaaaaaaagcaaaaacagttttccaacatgactcattttgaagtttaaggtagtctgtatatgtgtttgttcttaatgatttctattgttttagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgaggttgttatttaaagtctattggaacaatgagctaacaaattaatgttaccatagtattcagactctgtgtctagtgactttttgcatttttgattgtttggacttagagaaaataaattagacttttgtgtggtattgtaagggcaagttgaagcaatagatcccatgttatgtcaattcttttatggtggtactaagatgtctgtattgctagaagctctgttatgaaaattttgacatataatgtctttggtgtaggggaggtattgttcatttttgaatacgtgggtatatttgttcactagagattgggatatttgaggttggtggtcatggaagttattcagtaggagaaatcgtatggcattaatggtggcagtattttgcttattcctttccgttgccagtcagtatgtaaatatagtaactcttactgagtgatgcaaggtttgggatttgtgagcacatttattgaattaatttttgtctatgaggtttcttaccaggtttccactggatcttagaatagttttgtcttatggaaacttcagcatttatactgcgtgaatgaatttgatttttcttatctcatattaatacagcagaggatatcacttagtgacattgaaccaatagttttttaaatttctcttgtcttaaattctttaattttgcttttgagtgtctacaccttgatatttctattgttcttttttttaatcccacctacaaaactctttttgatattcaaagtctgtcaaggattagtcttcccacttacctttgttatgtgacttgcagaactaaaaggatttggggaagaaagagtctctacttttataattatattggtatttaagaggaaattagttgtcctaatgtctgatttatacataatatttattctcagggtaagatgatcatgcaggataaactggagaaggagcggaatgatgctaagaacgcagtggaggaatatgtgtatgaaatgagagacaagcttagtggtgaatatgagaagtttgtgagtgaagatgtaagtctgccacaatatgcctaactactgtgtgtcttctgtgaacatctttaagtgggttagaagggaagtgtgcagctatatgtgtatagtagaattattaaaaatggagtttttctggggggggcaaaattttatatttttttatatatttctctattagtacagtgtttagtaaggtttggtctttgtgcatcacgttcacaaatcacttttgacacattcgaatattgttatttatcttgtatctttcttttcttttcttttttttttttttttgagacagagttttgctcttgttgctcaggctggagtgcagtggcgtgatctcggctcactgcagcctccgcctcccaggttcaagcagttctcctcccccagcctcccgaatagctgggattacaggcatgtgccaccaagcctggctaatttttgtatttttagtagagatgggatttctccatgttgatcaggctggtctctaactcctgacctcaggt

SEQ ID NO: 117484 - DNA, 1327 bp, Homo sapiens
ataataaaactccccatacctatcaagtagaccaacatttgccatccttgttttctgtatctcccatctccttactccccctgtatcttatcttattttttttgaaatggagccttgctctgttgcccaggctggagtgcagtggccccatcttgggtcactgcaacctccgcctcctgagttcaggcagttcccctgcttcagcctttgtagtagctgggattacaggtgtctaccatcacgcccgggtaattttttttgtatttttagtggagacggggtttcaccatgttggccaggctgttcttgaactcctgacctcaggtgatccacctgcctcagcctcccaaagtgctgggattacaagtgtgagccactgcacctggctgccctctgtattttaaagcaaatctcagatacatcattatattctatgcctctgactgtattggggatgtaatttttgattgacctaattataatattttctttatcattaggatcgtaacagttttactttgaaactggaagatactgaaaattggttgtatgaggatggagaagaccagccaaagcaagtttatgttgataagttggctgaattaaaagtaagtgactcttgagagcagaggtatccagaacccttgttgaagcttcctctgaggagctcaaatttgggaggaattctcaagtaaagacagactgaaaatgatgtttgatgaactaaaataaaccctttatgacttaggctcattatcattctcacttttagaaccttgtaataacaaaatgatttttctgaaaattgactttaggtttgtaatgtttcactgaactggatgtttagtgcattcttggtgtcaagagataaaatgactgcaagacttagtacctgccctaaaggcacagggaatgcagctggagcagggctgtttctgtttatgtagtttggattcttgataaaagcaaagcatctggtggtttattttttattattttatttatttattatttatttattcatttatttatttttaaatacacagtcttgctctgttgcccaggctggagtgcagtggcgcagtctcggctcactgcaacctctgcctcctgggttcaggggattctcatgcttcagcctccagagtagctgggattacaggcgcgtgccaccatgcctagctaatttttgtatttttagtagagacagggtttcttttcaccatgttggccaggctggtcttgaactcctgacttcaagtgatctgcatgccttggcctcccgaagtgctggaattataggtgtgagccaccatgcctagccaaa

SEQ ID NO: 117485 - DNA, 1050 bp, Homo sapiens
gtttatgaggaaattggatcattggtcctgtaggattttcctctagttggattttgctgattttcacctccctggtggtatttaacattatttgttaaattgatggttacatttagaggctccatcagattcagatgtttaagattttaaattaaaacattttttatttttggcaagtatactttatatttagtactgtgtatctccattaggaggcacctaatttttggtggtctccctgctgtgttttgagggctcaggtgacaaattgaagcgattccagatggatcagtgttgaggtatagtttcattcccctcctgaagtagcttcatatttccaaaggcctggagaaatatatttaacttcttatatatagcacacggagattaaatgtactttatcactagttttagtggaatcagtactctggatcgttgaactgccgtatgaagactgtgtattcttctgttaagaatctaggtcaacctattaagatacgtttccaggaatctgaagaacgaccaaaattatttgaagaactagggaaacagatccaacagtatatgaaaataatcagctctttcaaaaacaaggtaacttttttctttgtcctactcttattttagtaaagttaactttttttttttttttttttttttgagacggagtcttgctctgttgcccaggctggagtacagtggtacaatctcggctcagtgcaacctccacctcctgggtttaagcaattctcctgcctcagcttcccgagtagctgggattacaggcgtgcaccaccacgcccagcttatttttgtatttttagtagagatggagttttgccatgttggccaggctggtctcgaactcctgacctcaagtgatccacctgccttggcctcccaaagtgctggctggtattacaggcgtgagccactgctcccggccgtaaagttaacttctgaggcatttacatagcatttttttctcttgttctcattaacttgtttaatagcactttttattttggatattaatgtaatgtgtaatgt

SEQ ID NO: 117486 - DNA, 1561 bp, Homo sapiens
ccttcttcttcttttttttttttgagatgtagtctcgctctgttgcccaggctggagtgcagtggtgtgatctcggctcactgcaagctccgcctcctgggttcacgtcaaaggccttcttttaaaaatagtattcattatagttttggttccgaactagcatgctgaaacttcagctctcatatctaatgtaatttttttgcattgtgaaattatcttcctaagattttgtataaatcgggtgctgctgtttatcttgttgaagccttttaattgataccttatgaattttcttgacctttaaaatttaaatctatcctgagtgtattcaaaaattgtggttaggtttcttttgaataattctgttcagattgtgaggctaaatatgctttattttttgaaagattataagtttttgaaaaatggcagaaactagacagtagttgcggggagggagggtatcacacttttagcacttgtttgactgtctcctggttgcaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggtaatttaagacttttttttaatagtcttttcttgacagccttattattaatagtcctcaagtgacacttaggagggaactttattatagtgttttagcttctaggttgaggattgggtggtgggagagggcggatttgggtttagcatggcttgtaaaatttgttaattttataagaaaccagttttctgtcttacccattccaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggca

SEQ ID NO: 117487 - DNA, 1248 bp, Homo sapiens
ctgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaaaaaattttttttttttttttttttttttttttttttttttttggtgtgtgtgtgtgtgtgtgtggggaagggtgtgggtgctgggatgggggtgaatttcaagttgaaacacgatgatgtggtctgcttgctctctgcttagacaggctttaagaccaattggattttcatggaggccaggacagagagtggtaattgatggcttgtgtacagacaagcatttatccaggttgcgttatccaaactgatttgttaaagctccaggtcacgttcttacactaagaaaatcattcagtaaacatgagacaagtttaggaaaaactaataaaataaacctgtcttaaacttgaatggtttccttaattccataatgaaggctgctgggtgtgtgtgtgggggtgtgtgtgtatgtgtgtgtgtctgtgtgtatgtgtgtgtggggtgggggcggggggtgtgttttcaataaaaatgttctctaggagtaggaaccctctgagctaaatttcacttaacatccgttgaagacttccagtctgaagagtgacagctgaagcacactgcctactttgtgagaaaatgttgcctaatttttctgtactcaaactctccagttgagtcttggcccagttcctttggtgttaggaatccttgtcttgctcctgtgactgggccttactttgagggttttgttagcagaaggcgggggtt

SEQ ID NO: 117488 - DNA, 1081 bp, Homo sapiens
gagaactgctcataattgcctcatgtgtgttttcagttctcaaatttaaaaccatttactgctgggaacagatgttaaattcaggacgcttgtcaattgttggcgcgatacacaaaaaaagatgcttaaaattagaagcctgattgaattttaagtacagtgatcacagtggttggaatgaaaataattgaaagggtaaacagcttattgtgagagatggaagtacgcaatggaaggagaagctgaatttgaaattggaaaactcatgatgtggaattgtaatagggattctacgatgatcattaagttaattaacagttaattgtaatagaaactctctaacagcacttaaggaacattaataccagatagactcattcataacttaggtgatcacaagaaaagccatgtggattcaataatgataacaatgattactcttatgtgttgtgcacctactatgtgtcagataatggacttgaacctgtatctatctgattagcgtttagaccactgattgttcttggagaccacgaagaactggcagtcccttgctttggccaattgaaaaaaatcatgctaaaatgacataaaatttaccattttaattattttgaagtgtaagattcagtggcatgaagcaagtttacaacactgtgcaaccatcaccactgtccatttccagatccttttcatcatttcaaacaaactctgtacatattaatattaaacagtaaatttccagtctccctcattcgctggtggcctctactattctttccatctctatgaatttgcctgggccaaatttggtaacactaatgtcacctctacctcaccccaactcccaaactgctcattgatgacaaggtctgctgtcctcattgtgctgatccctcatggcatgcagagctgggcaggctggctggaaacacctctggacccccagaacgttctcagaggcattagaaccagagcaacttcatcttgaataggagctgggtaaaataaggctaagacctactgggctgcattcccagaccgttaggcattctaagtcatggaataatataggaggtcg

SEQ ID NO: 117489 - DNA, 1084 bp, Homo sapiens
ttgtattttttgttgagatggggttttgtcgtgttgcccaggctggtctccaactcttgggcccaagtgatccacccaccttggcgtcccaaagtagtgctaggattacaggcatgagccaccaggccacccacccccaactccgcccgcccccgcactccagtattcttttataaaatgagaatatacagcatgcattttcttatatcctgaagaaatgtgagtgagcttacctagcagtgcatcaggagatgctgattcagattgccctgcaggttccagagagcctgatcagtgggagcacagggcctggctccttttagggttccccaagggtctggtttataagtcacattctctgtcttgtgccccagggatgctgaaagtctccctgttgttgctctacctgggagtgcatcctccccattgcatacagggtgggtcctgggggtcgtcacttcccatcccttcttcctgggccgcccagttccactggtcactgctgaccaatatctcctgcttggtaactggatttcactttggcaggagactctggttcaaggggaggaactctgaacatggggattatggccagtggccttggataagtgagagttaaggaagcataaactaattttctttggatggaagtttacacataaagatgatactcacctagacttgcagataatatgatgtactatttattgcataaatacatttgattttaaaacaatattaattttagctctgggcatatccagccttagctaactgaaaattgtagctctgggaccatctgctggctactctccagactgccacactggtctgggaagctggctctcttgggatggaggttagagcaaagcccctgctataggtagcttttgcttcccggggtctgcagggaagtgaggctggagcagctgcagttcagacattttcatggtggtggatatctcgggcagcaggatcagcagttacagtatgcgttctgaccacagacatagattcgaattctggctctgctgctctgagcctcagcttcctcttctgtaaagtggggataataataacacgt

SEQ ID NO: 117490 - DNA, 1009 bp, Homo sapiens
tctagcttcttcctggagcttggggaaaagtaggacactcgaatgacttggagactgaagaaataagcctgggccagccccaggcagggtgggctgggtcagtgttggtgaggctgggatgatagctttggccgtgggtgcaatgcccatcaaccctcctcatgcaggcaggtcgtgccatcgtcccgaagctgacagtcccccttcctgccatccgtctggggctgcctgggtgggcttttggacccggagcctttatgcaaggttctgcccactggagcagaagaatgagggcctctatttcaaagccttcctgtcaccacaggtgcagattttttgtcattttgggaaaaaaaaaactatcgaatttttgtaaaattaattttatttcaaaatgactgagggggtttatataaatagctttcttgatgattcttttggtaaagtcagtacttctttaatagctaagatatcagttgtgaattgaccttgtgggttcattaggaggattaccggctgggcttgctacaggaggcccccctgtagtgaggcatttcctcccagtggctttccaactgtgtcccatgaacctctgctggggtgaagtatgggagaaagggcaggccagtctggccttcctcctcttcctccttctcctcccacccctgactccccacccaaccaactctattggttttcctgccaaaaggcatttacctccctgcattggtgactttgcctcctggggctggactcctgaaaccctgacctaggcttcaggcctgcttcgattcagttgtgtctggcatgctgtcagtgagacctaagcctgccgtctccaggaaatgcactctgaggacagcaaagggcagctatgcttttttagacacattccaagatggaagggacagtgggggagaagcaggtgctgcagaagttgactctgtcactcctgattattttaaaaggccagtttgggtcaaactggtctttgacttaggaatcctgc

SEQ ID NO: 117491 - DNA, 1023 bp, Homo sapiens
acccaaatcgatatctctagcttaggcctctcctttgactccagacctgtttatctaactgcttacttgacttctctacttacacatctaacagtattttaaacttaaatcaccccccaatctgctccctgccttgcccgaagtctcttctcttctaacagtattttaaacttaaatcaccccccaatctgctccctgccttgcctgaagtctcttctcttgtagtgcattagtttcatattgctgtagtaaccaattattagagatttgatggcttaaaacaacacatttattctcttacagttctggagaccagaaagccaaaatcaattgaaaccagcactccttctagaggttctaggggagagtatggttccatgcctttttccagtctccagagctgcatttcttgtatcccttggcttctggccccttcatcccatcttcaaagacagcaattcagcatcttgtttcagttctcacattgcctttttcatctttgcagtcaaatttttctttgcctccctcttataaggacatttgtgattgcatttagggcccatccaggtaatccaggataatctcatttaaaaatccttaattgaaacacatctgcaaagtcccttttgctatataaggcgacatccacaggttctgtggattaggatgtagacatcttgggggctattatttagcctaccacacattgtaaatggtatcacccttctatagttgcttaagttaaaagacaacttaaatcctttttacctcaagccttatattcaatctgtcagaaagaatctatcagaaagtctttcaggcttcatgtttaaaatatgtcaagaaactgatcctttttcaccactcccactgctgttgtcatctcttgcctggattacatcagaccagatccctgctccatcttcctgttcttttgagacagagtgttgctctgctgcccaggctggagtgcagtggtgtgatctcggctcactgcaacctccacctcccgggttgaagtga

SEQ ID NO: 117492 - DNA, 1032 bp, Homo sapiens
acttctttaagtctaatagaagggaagtattgctaacgtttttcttatagattaattcattgaggatcggcaggttaagaaattactcaaagtcacaaagctgacgtgggtgatgctgggaccccaacggaggctgcctggttcctcagggcacagacgtaccccctgatggccacactaggctgcatgagctcagttgctttcttcttccacacagcaccacttaactcatcacaccctcattcccttacccagcaatgaacgtccccaaggtgggtcccctctggcctgacctggtttccctctaccttctcatctggcacctggcatttgtcttccagccaacccagcccagtggctcacctctgccctccacagggaccaccccttccctgcacacagctgtctacagcctacccagcactagggcccagaacctcctcctaaggtcccccagcccactgttctctcagctgtggagcctgctgctctctctgctggcctgtggtccatctctctgagccctgtgagcaggcccacacagtctgttctcagggtcacctccaggcctttgctaatgcagccccgttcagaggcctcctgtcccacccatcgcatctctcttctcttccttagccggacatagcatggccaccattcatctattttctgctgtggtgggacttggattttctgatactgccaagctgacaacaggctagaaaagcaccaaacacaggatgttaaactaaaactctcccgtcctgccactgtctgtggcatcttacccagtgtactctcccagggaggtgcgcttgagctcagagtgaattccaggtgacttacattgatgtcttccaagtccaggaagttcagggtgagcccgttgcgcttccagatgattggtggcctcaggtctccatggacggcgcaggtcagcactgtgctcagccccacggtcactgtggtcacactgaccctgtcctcgggggcgaggctgagctgaaccacttctgcagagggaaaggagga

SEQ ID NO: 117493 - DNA, 1066 bp, Homo sapiens
aggggataacgatagttcctctctcatagattgctgcaaggattaatgaattcacttagaacagcttagcatcaactatgaatgctgtatgattacctgaaattaattatgtggcttcagaggcaagctctgcaacacatggtgagccctgcaatgctctgctccttaggtgtgtgatacctgtacaccaggtgctgggcaagtgtctgcccatccagccaacactccatcgtgggtgggcttccccactgtgggccctggactagtttcttagtaatcaacttgcagacaggatgacagggccaggcttgtcacatcaccattcttttcccagggctcagtccagaacttgcctggggcagatggtaggcatgaatggatacataagagcaaatattcacctgttgtgttgcttcaatttggggcgtttccttaaactcctgcctactcagagctgaagcccaaaagcttcctaacctgttggctttgtgacttcaaagaccatgtctgtcacatctgagagcaggaaactcagccatggtgctgattcatgtggcacctgcgggggtgtctcagttcgctctggaagcttactgccctctgcagagaactgagggacagccacttgccaggccattctccctggaagtgcccatggcatcagaacatcttcatctgaggatcaggaaccggggctggagaccaggaggccagtccctttggtgagactgaggccccggccagagcctttgtggttgtgccattgtaaggaccgcacttctcccctgggatgagggctactccctgcagcctgggcatcttggtagacatttgaggttacagagcttgtaagggcctgagccttctgagacactgttttcaaaaggaacaggttgggtgcagtcagtctagtctaacacagactttttaaagtcacactgctcactctggggcctgggaatatttcatctgctcagctgcctggccagggctgcttacagaggggctggggcctgtggtctcaagggcagggatcataggcttgggctgagtccggcaagatcaa

SEQ ID NO: 117494 - DNA, 1051 bp, Homo sapiens
ccaagtcctggcacccagcctgacacagcccctcccactgcccaggcacctactttcttattctccacaaaatgctcagcttaggtgggccccattctgacaggtgggcgcctcctacacagtgtgattttagagactctagcaggctcatttggcctcaaacgacaccattaagggcaacacacttgtgccatttgatttactgggtgggttctgtcacctggcatcagcagggcttagttaacccattaggcaccccactccagatagtctcagagctgaggaatccctggtggcagaggacacagggcagctagctatgacacaggtagaagagcacctccctccctccctccccaggtgccagtgaggcgctgctgatttgatccctttgttggggttggtcctatctagcagggctgccctccacccacccaagccaagagcatcctactggattccaatccccctcctccaggaagcttcctggccacccagctcttactgttctagctcctttgaactgtcaccgtgcatgtggtcatagccccacaaccttcatcttcaatcatgccctaatattttctgtctgccctgatgagacccagagttctccagggcagaagaggaacatgatttctgcccagagttctctgcttgtcgctgaggaaatgacaaggtcgcttggaatatggcagctgtggttggcaggctgggctgtgggcagggagacaggctgagactgagatggcccctcacttggtatctgcctgcaggccagcctctctaaaagtgaagcatctggatcctatttaaggagcctctccctgtgggagagtcctaattttttttttaaacattagccatggctgggcaggaagcctgctggaggatacccaaagtaagacaggggtcccaggcctgaagggaaacaggacagtagttctcccaggcaagccagcgtgctcagggtcctgtgtggtctggcttcctaggcagagttgtgtgaggacaggctcggggaagggcagcatgggtcctgaagcatggt

SEQ ID NO: 117495 - DNA, 1020 bp, Homo sapiens
ctggcatgcagtgagcattcttctctacgcagtgtcaacagcactagggatgatgctggtgccgttgtaacatcacggcttattcaaggagcagatgcaacaagctgtaagacccttgcccatttatgtgacaactctgtaatgagctaagaggtcaggggtggtgggtcctcctgtgaatgaggggagagaagaacattggccctccatatttatttaatgaatgactagaatttgacctccagttgatcaaagttaatgatcaccttctctgtcttgctaagagatgtaaggagccacccaagttcatctagcaggttagtagaaaagcaaggggagaatcaggtatctctgatccccagtctggacaaagctcctagaatgtacctccgggctctcaggaaatgccagtggagcctggggtaagaattcatctgcctgaagatgagaacgtttagagaaggtgctggaggagaggggaccttcaaggtggattttgaagagcaagggaaggtttgctaggttgagagtgtggggaaggctttctaggagtacaggcatgaagtacctccagtctccgggaagagcaagtgattatgggatcctgggtgtaggggagagcatagttggggataaaggcagacaagtggatcacagcaagctggggaaaggccttgtgtgccaagcagggaagtctgaactcaagctgaccagtgttgtgtccagaattggtgggttcttggtctctctgacttcgagaatgaagccgcggacccgcgcggtgagtgttacaagttcttaaagatggtgtgtccggagtttgttccttctgatgtttggacgtgttcagagtttcttccttctggtgggttcgtggtctcgctggcttcaggagtgaagctgcggaccttcgcggtgagtgttacagctcttaaggcggcgcgtctggagttgttcattcctcccgctgggttcgttgtctcgcaggcctcagaagtgaagctgcagacctaaggcagt

SEQ ID NO: 117496 - DNA, 1025 bp, Homo sapiens
ttaaaaaattaaactaaactaatatttatattgcctgctttttattttattttatttattttattttttgagacagagtctcactgtcacccaggctgaagggcagtggcgtgatctcggctcactgcaatctctgcctcctgggttcaagcgattctcctgccttagcctcccaagcagctgggattacaggcatgtgccaccatgcccagcgaatttttgtagttttagtagagatggggttttgccatgttggccaggctggtctggaactcctgacctcaggtaatccaccttggcctcccaaagtggtaggattacaggcctgagccaccgcgcctggcctattgcctgctttttaaaggcccagtctaatttatttcaggtgaatctttcagaaatacgtgctgtttgttaattcattcagccagccagtcattcctccaacaaatatttatccaacaaatatttattgaatgacctcacttttgccaggcactgatctgagcactgagagccaagatggatgcttagacaactttgttttcaacctaattctcacttttgtttgtgccctgccttaaccctcaaattcatgaaatactttgtgtcacatctgctctcataacaatgctgggcaaattattcccccgttacagaggtgagcaaatggagcttaagactgtgtagcggttatatgaaccatatgaataagtggaaaaacccagaatttttattcgtcctgcttgtcttgtctacccacttgagcttccaatctttcttctgtttcctccctgctcatcagaccaaatctgtcccctttctcattcctctcgagtggagctgttgacttttcagagtgacaagttgatagaatcaactcatctgtgtgaatggttgggaagctaataatggcttaatattatcctgctgtgcattcgctgctatcctggcacaaggtcctcagcttgtcaaacaaatcccctgcctttggctccaacggatcctgtgttagctagagttag

SEQ ID NO: 117497 - DNA, 1016 bp, Homo sapiens
aggcagttaaatcttccatcattctatcttattttttgatatttgtgccttaatctataaatattcactctaggcagtaaatttacaagcaaggttcaagcttggtaattaatatttgtgcctctctatgtaagttatgtctttaaaatgaggcaattgctttaagcatttaagacattccgcgtatattgcagagtaattactttccaaagatatttccaactgatattttgttacatctaaatatacatttacagtactcagtagaccagaatagctctaatttatatatttggtccactgggttagaaaaagagacattttaaaagtatgtttttaatcagtgtgtttatcccaaagatactgttggctcctccagaatcacacgattttataaaaaataataaatgtggtgtgttctctgagctgatttagactttaatgagagatgacatctcagcggagcatgagcatggctaacttttaatccgggctccgaagtgttctagagcttggaggaacttattaactcccttggtgtcattttcttaatgtacaaaattcagatgataaacagttactgcccttgtgcagtgagaattaatgctttctgagtcgcagtattgttttgataaaatagtcttaattgtttgctttgtacattttctgctttattatttttattatttctcttgcctctgtaattggtcgttattgggttcccattatttctttattagtcattttataaaagctatcttgtgatttatcctccctcccacacttgctgttcccccaagtatcgtaaacagaggcaagacccaggcaaacaaagctggtggtattgttggttgctttgagtggctcgcccgttgtctttaggatggttcattcccaattgcttgactgctatgaaagaacttatatgaatcccaggaggtttattagaaacatgttctaagtaatagtaagaaagttggattaacagggtctgcatggaaactctaacctccctc

SEQ ID NO: 117498 - DNA, 1031 bp, Homo sapiens
atgactcagacacctccattaggcctcacccccaacactgagggtcaaattttggcattaggtttggcgggggacaaacatccaaaccatagcaccagttgtccagtaattcttaggaacagaaacacttttatgaccatgctgactagaacaaaattatctgtgattcgttatccattccagatgagaatggtatatataatttaaatctgaatttattcaaaatgactgttcttgtgttacaagtaaagatgatcatgaactgcactgtacaagaaattcttatctgatatctcaccgtgggattatgagaaagaagaaagaatcatcacaaacagctttaagaatgtggtgagcacaatggtgagcggcgaatgcagcacaaagcatatttagttagcagcacaggccaaaccgtgggtgacgtgagaatttagcacagaaatgcgctgggtggaaggtgggattgggaaggacctcttggaggcagaggtacttggagaggaagaccaggatctgggtgggcagagtattagagtatttaaggaggagtaaccctcagagtctaggtgtagggtggaatagggccatatctgtcaggaggggaaaacggaacagattggttaaggtgggtatctgggtctgtgagccaggggattcatcagggacgctttggtggccaggagcagaatcgcctgctaacatgctcatgtacaaagaagggttgtcatgaggccccagaccttctcccaaagccaatggcaggatgccttcatgggctcaggcttagaggcattggaagtctgtctcccaactcccttctgagccacactgtctcccttctccatttctccctcctctgcctgttctctccagagactggtctttccagagagctctgagtgtagcccttgctgcagctctgggccccagactgtctcatttgagttctgtctgtatcctcaggttctcaaggggcagagccttattggctcagcttggggaaatatcttcccagatccatttgcctg

SEQ ID NO: 117499 - DNA, 1868 bp, Homo sapiens
gaagcactgtttagccttctttacaagatggaaagcaaaatagcttttgtttttttttttttttgagacagggtcttgctttgtcacccaggctgaagtgttgtggtgctgtcatggcttactgtgatctctgcctcctgggctcgagtgatcctccaccttagcctcctgagtagctgggactacaggcaagcgcctccatgcctggctaattttgtattttttgtagagatggtgtttcaccatgttgcttaggctggtctcggactcctgggctcaagtgatctgcctgcctcggcctaaaatagcttttttgttgttgatattttgtgttttatatttagaaacctagaagagagatattttacttgttataaaaatgtttaccatattctctgttttctcttttgcctatttaatgacttctgttttccagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattattt

SEQ ID NO: 117500 - DNA, 2278 bp, Homo sapiens
aaagtatttaggtccaaactccatatcttttttgggacctacttgagtgagaatcagccactttttggtctgttctagggatcaggtaaagtctggacaaggtaactgaaatccacaccctttatgaaatgaaaacagaggggatgggtgagggctgtatgtgaactttgccatcgtgacttaaagtcagccctttttcttttcttttggtggcaggctgtatgatgcagtaggtcttttatgctgcttaaattgttagtatctagcaaagcaattattatctgaagaataactgactaagaagaaatgtaactgaatgctggctattgagacttaataactagttttcgagaaagttataggaatgtagcagagagaaatgcttagtgtaaaatttgggtaaatatgcttttagcttggtggagataaagttggagatttcagtttgatattctttgtttgtttcagttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaaggtaggtttgggatttttttagccctttattatttcagtcataatgcttttgatgattcatggttcttttttttttttttttttttttttgcaaaaaaaagtgtagtgggtttcactctgtcaaccaagctggagtacagtggcacaatcacagctcactggagcctcgacctcctaggcttaagtgattctcttgcctcagcctgtcgagttggtgggactacagattcacactaccacacctggctaatttttaaaaattattaaattaaaattttaaaaattattgtttgtagagacgaggtgtcgctattttgcccaggctgttcttgaactcccaggctcaagcagtcctcccgcctcggcctcccaaagtgttgggattacagacatgagccaccatgcccagccctctttcctttttttcagtgaagtttaaattcatagtaaaatattgagatgtctaatcagcatgtaaatctattgtgtattttaacacactgcagacagaatgcttgaatgtatgtacttctaaaaaaagaaatagtcctatttcttaatgagtaataccaaagcccagtgattttttttttaagagtttatgtcttaatttggcatcattacttcagtaggaatacttgtggagaaaatgttaatttaatatttgtcttttaatttattaacattgaacttaatcttttgattttttttctggttataaagtgttacacatttattttagggaattcagaaaacagaagagtttagaaaagaaaatttaaactacttctcagcattaacgttttggtgtatttctggtctataaatgtgcatataatttatacatataggtgtatgtaatgatttttaaggaattttatctcacagagttttttttttttttttttttttttttttgagacagagcttcactttgtctcccaggctggagagcagtggtgcgatctcggctcactgcaacctccacctcccaggttcaagcgattttcatggctcagcctcttgagtaactgggactacaggcgcaggccaccacgcctggctaattttcgtatttttagtagagacggggttttgccatgttggccaggctggtctcaaactcctggcctcaagtgatccacccacttcagcctcccaaaacgctgggattacaggcatgagccactgcacccagctatctcatagagttttatgtcctgaccaatcatgagcattttccatatccttaatattctttaaaaacattatttttttttgaga

SEQ ID NO: 117501 - DNA, 1289 bp, Homo sapiens
tgaatcaggttattccagggaatgtcagtttgttgtgtgcatctgtggatgtacatgcacactacacatgtgtgtacactatgaacatgaacatgtaagaccttaggttggattcaggattgaggtttcatttaaagggatgattgccaaagaagcttactgcatgctaccagtgctatagactaattgtaccaggggaacagtgagaggaaaaaggaaagtggggttccagaagtagatttgggtaggctctctgggcggtgggataattatagttgttttataagcccactgtagtatgcctgttggtcagatagtgctaagtaacaaggattgaagggccatgtagtttggaccctgctgataatacctggaacaggttctgaatttggtgttaatctttcttgtcatttctttcctccattcctcctcctttcctctccctcatttttctccctgcaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatt

SEQ ID NO: 117502 - DNA, 1024 bp, Homo sapiens
tcctcctgcttgctacatctcatattctccaaatgttttataatgaccccatactcctttataaacatttaattatactttacatatatccatttatatatacccactgtattatataaacattttataagcaatgacataaatcagcaaaccagcaccacaatttttttaagataaagaaccgatttcacacacaagcaacacatacctggctttagagtctgagtgtatcctaaacctatcaggctggagttgttcactttagcctaatcaaggaaatgacaaaacagagaaaacattaagtataatactttgcacttccatctccaaaattagagctttttagtcaaccaaccttggactttagaatcaaaatttttcatgaccaccttgttcatgagattcattaaattcaatacaaaatacatcaattttaggtgcatacctttctgttcaaagggtgtgctgagatctgacacccctcataagaacaaagcagagagaaggaaggcctcttaggggccagtgtccttttgctcatataaataatgaggctccttttctcttgtttttaagtgcttgctgttaagggagccaaattcggttctagtttaggagacttaaaaagggctgtccataaattacacaaaccagtacagacaccattctgcaacatgagattccctcatttcaccccaaagagatacagccgccagtgccctgtgacaacagaaatgagcccaataggatttactgcaaaaactgtgtagtagttcgagggcctgtgagcaatgccagagactctgcaagatgccaactgactattgatttcttaatatgcaatgcaggagctgaaaaggagaatgaaaagtgaggcggggcggggggaattatcaattagaaccctagatttcagagtgccccttttaacagtccgcatgatagaacaggaactggtattaatggaagaggcttaacagtaagccagtctggttcaaatccagctcccagcactttcctgctg

SEQ ID NO: 117503 - DNA, 1800 bp, Homo sapiens
cctgcctaagatctgtagttggccatttctccaaggagcactggttccatttaggaggaaatggtctaggtgctgaggatgaagcattaatctcaatgtgaataaagctagaagtgaacagtgctgtgtagtccttgaggctctgagtggatctggttcctcctgtggtctctgctgagaatgcagcttcctgtgggagatgtcgatcttgtaactgaatgatagagacaatcagataaaaatgatccatgttgtatttgttggatgtgatcttgttctccagtgtgtacttttggtaaaagacatggtaataataggtctgcaggtgacactattcacctgctcttcctaagggatgctgggtcttgaggaaccggcagtagagacactgaactgcttatagactcacatctggtatcatcaggttggacctgggatactgtctggctaactaacacttcctggcccccatgactgcagagttccaggttctacatcagtacccggttctctgaaatatgtactcattggggtctcatgaatatggaattgaaatccattttactgttgtactcacttagagggaacatagcctttgtttccttacttaaccatgtgagccacagagtaagaagaaaaccgtctctttaaaagctgctatttaggtagctgccttcatggcagataaatcttttccacaggtttggaaaatatcaaagatgcatctgtttcataattacatggtggctttctacctaatgaatgcctgtgtaggctgctacgttaagcatacaaagaggataggagaagaaagttacttcgtatttatttttcaggcttttcctgtctgtgttctcacttcgttattgtggggtttctgcagactgagtccctgtggaagagaggttgtgtcctgctcattgtggtacagcagtggcttaagggagaactggagccctgacttcacccccaccccactccctttatttgacctgggattaaaaaaaaaaaaaagacaacttgcatttcaaggtgagttagcttctgatcttaatataacttattttccttcaggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgtaagtgtacatgggggcagcagggtgggaggggtggggttggagcatgtgtggtaaggggattgcttttcactgtttttttttttttttttttaagaaagcccagtttttaaccactgtaaagtgagtttgttggcattagatgagccacatggcctgctgctatcttttgtttcccacctacccatttcctggagtgtcttagatcctttccactctgtgaacagtatatattgccacaggtacacaaagtggctgattaattacagcagggacatggtgtcagtccagagcgtgtccattccctgcagtttttgttttagttaacaaaacagctctctttctctgtctaatgcctgaggattagcctgctgggcttgatgacatgtagacatggtagacaaatttaggagctgattatctcagttacaaactatcttctctgtacagtgaagcatgtaaaagtaactattggacagtatggtgaagggaaacagt

SEQ ID NO: 117504 - DNA, 1183 bp, Homo sapiens
aattcacctgcattcaaccacataagtgtttttaaagtaatcttagtagtccctttgaaattatgtgtgcagtaattgttggaagaaagaagttttgggtttgaattaccgctgtgtcagctttagctcagtgctttttctctgtactgccctggagccaggatggaagggagatgctttcctgtccagactgaagagttacagggaggaaggaagctgtctgctgacaacaaattccccataagatttctttacatagcaggctcctttactcccatctgtactttaaatatctatttgaattgtagagttagccttggcccccccacattcagggtcttgcctcttgcagaaaggcaagtatagtgtttaggagtgaagtgaagccaagtgagtgctatggtgcaggctgtgactcttctctctcctttgaaggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcaggtaatggctgctgtgaaaagatgtggatttattaattcgcatctgccagcctgccttgtgactaaatctagtggcaaatttcttttctgttcagcttgcacgtggactgaagctgaccttcgattcatccttctcacctaacactgggtaagagtttcatctgttttctccacaaggatgttctctgatgttgcaggtggtggaagccctttgtgacaaaatgttttgggggctgacagcacctaaaatatggtctccgagacctggcgatttaagtcctctggttttgatttggtcccaggggtcgtatccacatctatgcactaacagactatgctataatgagcacttcctaattcaggactggtgtttacccaacaaacgatttctaagtgccacctgtgcttggccctgtgcccatctggagatctaagggtgcccaggccatgattgttacccgccaaggagctcactttctaatagaggattcagaccagtgtttagccgtgttttgtaataagattctgcattttgttagtgttctcctagtttctgccatggaggttgcaggatttctgttcagtaatagccattt

SEQ ID NO: 117505 - DNA, 1004 bp, Homo sapiens
gattgacttagtgatatgcagcaatcccaagtagtcctttgatggttggttttaaaaataaagttacactggagctcaataaatatttgtttaatgtatttggaggatgtatttgggttttttccatgtgaagagctgccaaactggtttggttttactgtattctctatgagaaatatgaagtgggttcccataaagtccaaaagttttgtgaaaagttgggcccatcctggcatatagtaggtactccataaatatttgttgaatgaatgaaatcagagccacatggaaaatgatgttcccatgaaaagctctgatttctattcggtacatttaatgtcctagtagctgacattttgtaagatgatatgttttattggcaacagtcctacaattcagtaaagtcactggctcatgggaatgtgtctttgacagtttattcattaagcaaatatttcctgactcctactctgttctgggcctgggctcagtcctggggatgctgaggaggagaggtctaaattgttgatcatctgtcaacaaagactcattgagtgtctcaagctctggccacaaaatgaaggacaagacagcaagggcttcttggcccatctgggaggataagctacctggtagtcttagtgctaggtgatttttattggttgctaattacatctaataattgttattgatggaaagctaatttccctaattatcaatgcatttattctggtgattcttttatcatagcagaagatggctgtgccacccacgtatgccgatcttggcaaatctgccagggatgtcttcaccaagggctatggtgagtgttgcagagagggggtgcctttcagctcacagactgagttggcatgtttgagactttaccgataactgtttaggagacctgggtaggtcagctgttctgaactttcacgtgagggaaaaaagaagctttcatttgtgtggcaattgtagcaactttggttgtgcacccagttgga

SEQ ID NO: 117506 - DNA, 1642 bp, Homo sapiens
aggccctggcctcggtgggacggggacgccaaggaccgcggggagccgggtgcctcccccaccgcagctcaggaggcggcagaacccaggggtggagagtggggggcgggcttcccgggcgccgccgggtcgagtcacttccggtgccctgacctttataggagtaaacagacccccgccatccccgcctcccctcctgcccaggtgactgactaatccgccgccttcaggagacagaattggccaaggtttcttggttggagggcggggggtgggaggtcaagtaggggccacctcggggaggcctgccctccaggtccttcccctaaaacttggcactgccgatactcccagcccgttccttcccaagtcaggaacttgcaggggaccccttggcaattctttttctctcaagagcagacagccttcagtcccagccgctgccagggctggtgtgtctgacccagctgtggtttttccaggcctgaaggccccggagtgcaccagcggcatgtacaaagagaccgtctactccgccttcaatctgctcatgcattacccacccccctcgggagcagggcagcacccccagccgcagcccccgctggtaagtggaccccgcagccagtgccgccctgtgcttgcagcctccttgaccaggtaggtgaggcaccggcaagagacttctgcctggaacaaaatagacgagactcctgtgctggtcttttctcccatacacacccggtgggatctgaaccaaaaggagaactttgctgaaggaaggaggggccgccctggggcacccccctgccctctgcctcttggcttttgtcttcccagcttgctcataagcaggtgcaggctctgtcctggtgctgggtgatgccagggtggggtcttcttagagaacttttgagccgagaccacccttgctcctcgctgctctgatctgagctcagagctttgcaattaactttctaactagcccaggaaaccctgagcctccttggcgcttggaggaatgggcaggaaagctgatctgttcaggtcccctggttgtgcaggagaaacgtgctgtgttcggtcggctgtgtcctgacgggcgtgagtgtaccgttgccaaagaaggaccctgaacaccatgtgtggaaagtgggttcttaggaaactggcttggtctcagacataccaggaagggttggcaaaggtgctacaaatcagtgatgttgagaagggaccagtttaattaattcgtgaattaaatatttttaagtcccagtgctttgaaaagatttcatgatctttacaaaccatgcccattggtacagatgacctaaagtgtgaagagcctattctgagtgttttggagcagtacagctgcgcttttaaagaaattcctattcgtgtttcacactctcctcagttggtccaagttggggtgaaggtacgtggaaggtttggaggactgtggtaagtgagtgttgggtgtgaatgtaagcccagtgcaggtggggctggcaggctggaggctcgcatggctacagtggggtcaccagagggaggagagttaagtgctaggctatttcagaccaggagtgaagagggtggttctgagagctgctgcatgccaagccagtgggaa

SEQ ID NO: 117507 - DNA, 1054 bp, Homo sapiens
ctgtacacatcactctttcgtttccaccttgactattttcctgaagcataatacccaaacagaattatggggtcaagaggcaggaagagtcgaggcgttttgcttccctggtgccccagtgcgctgtaggttctgagctgtgagtgtcccatgcttacagtggctcagcacagctgatatggagttctgcctttgttgctctgcattgaataggtttgtggtgggcagtgcgactgtgagctattttgaattacctttctttccttggaaggctgcgtagtattggctatcacatttggaaaatctgcagcctcttttctgctgcttccaaggtgggactttgagggtggctccctcaaagccttgatgcctttcaaaaccaggagagcaccatgaagggggccgatcctgcagacccctggttagagccaggcttcctgccccaccctgtcctggggtcagggagggatggccgggaatttagggcggtttgcccctcctctggaaagtcggggtgagtactagctcagcagggtaggaaagaccttcccaaggcccagggctggcaaagagccctggattggttgctgagacctgggatccttccccccaggctctaccaggttccaccaagccagtttccacggcagcacacgggaatattcataccagcactgccacctcctcagctactctgagactcaagtgagtggggctgaagcagatgagggtggccccctttctgggtctctggagaccataccccatccccagcccctccaaggagggaggtttagctgagcttaagcagggctctgggggtgctggtttaaagtcgcataactgctgaggtcaggcaggtcaggggtgggcccagagcctcctggaggtgcaaggcaagccgcagcccccctgagcctctgcaggctgttgtggtcccaaagccatacagtcacacccctcacaccttgtgactggtgcttcctgctgctgtgtacaaacaaggctctggtggaggaaacaggtgttttatcaggtcacaggggcccccacc

SEQ ID NO: 117508 - DNA, 1133 bp, Homo sapiens
gtccggtggaaaacccgctaagcaggaggcagggcagcacaggcctctgagctgctagggttgactctttgccctgctgtgtgggttccctctccttatggtctctatgaccaactgcaaaccactcttttccctaaaaataaacatgcttatgggactgggggaagctttgtagctatcaaaagaaataatagggtgttttagaaaattacattgtgttttaaataaccagcatgaaagtcattaagtttgaagtttcattcaaatcagatggctctgtggctggcgtggtggccaggcaggcagaggtgggtgggccctctgagatgctgagaggcagcctgtggagagccttgcggcagtggcagcagtgaggtctctgctggctgggtacagccaaggtccaggcgggctggccaccgagtgcgtgcctggctgcagcagccaccccagagctcgctggcagcctttgaggcagtgggcatccccatgggcgggggtgtggggacagatgaacctgggagagccaaggccacagggtcgatggccatgttgcagggggtggtgttagggatggagttgggaccagaaagggccggagaggatctgtggggcccaggccacatctgttcatttcaccactgggttctcagtgcccaccctagggcctggcacacagtaggtgctcagtaagcagttgttgaaagaataacaacaactacagtagttcatgtgtcaagcacttcccaagtgccaggcctatgccaggggcttttactcatatcaagattgtacaagtcggtagggcacagtgcctcacgcctgtaatcccagcactttgggaggccaaggcaggcggatcacgaggtcaggagtttgagaccagcctgaccaacatggtgaaaccccgtctctactaaaaatacaaaaattagccgggtgcggtggcacacgcctgtaatcccagctgctcaggaggctgaggcaggagaatcgcatgaacctgggaggcggaggtcacagtgagccaagattgcaccactgcactccagcctgggcgacagagctagactctatctcaaaaaaaaaaaaaaagatcgtacaagccaagaaagtaggtattattgtggcct

SEQ ID NO: 117509 - DNA, 1105 bp, Homo sapiens
ttcaggtcaccctgaccagccaggctgggaaagggagagactgtgtttagaactgggacagtgtcctgtgcacaataaccataggccctttgcagtgtcgtgggtgtcatcccagctctgccacttactagctgtgtgaccttgtgcctcagcttccccatctgtcaggtgggcgtagtagttgtacctaatatcataggtctatgttaggagtatctgagttcaactctgcacggtgctcagaactctgcctcacacatgggaaatactccgctcacattagcacatgcttttctctaggcctgaagcatttttttgcctggcacataataggagctcataaatacaccctgaccaaatggtaccaatagcgaccagctgagcatcctgatctcttggggggctgtttctgctggcacagtcccctgccactgggaggcgttcttgggagggcctgaacaggcctcacctatcccctaccccccacaggcttgaggccagaggaaacagcaactttcttcgctgggaaagtgttgtggggctcaagcatttgggggttttcagagtcaaccgtcagaggcgagggagtttctctgctggcggtggcaagggctgtcagcgtgcacacagcctgcgagcagaccgctgcggtctacagggaaaatgccgactgtgtttatttttcacctgagcctgcaggaagttggggggtgcgggttgggggggtggtgaagggggatgccaagccaggcccaagcttgacttcagaacagaggagaactacctcaggagtctccgtttccatctcctcctgcttggccctgcctggctgtcttctgggctcctgtctggtaaacaagaaggcacgcaggagcacccgaatgaggaattcctagccatgggctaaggaaatagtccagaagggcgaggagcccctgtgggacagtggactggagtggtctgaggaagtctttgagcagtaagagcaatgcagtggcaggaaggaccacttttgctgggagtgagccctgtcaccaggcatccagtagaaggctggacaggcactggtgggacagagatgactctcagggtagccctggggtgt

SEQ ID NO: 117510 - DNA, 1324 bp, Homo sapiens
gcctttcctcctctcagtgagaaaatggaaagtggtggttgtgatggctgattcacctcagcctcaggcaaagtcattctgaaatccctcattgtcagctgtgggaaacctgctgactcaaccctggggggcaggtggagccttggctccccaggctgggctcccctagaccaggggcctgcctcctgcccagaaagctaggctggagtcccccgagcagagatgccccaatgcctccatgcctgagtgacttcagctctgcctactggccccctaatgtcttaggcaagtcaccccagccctctgccctgggttcccttgtctgtcaaaggggcactattatcacactgggatcctcctgaataaactagtttatgtctggtcctctagcaaagctggtgggatcttaaggcccctgtaggaggttctaggatgcagtaactgctgatatggcctgccaggtcaggctagcccactcactcagcttctctcctctgcagttcacaggcctctgcagacccctgacctctctggcttctactccctgacctcaggcagcatggggcagctcccccacactgtgagctggtgagtgtgggcccaatgggaaaggggtaccgtgtgctggtcagaccaagacctgcctgcccttccatttcctcctccatccctcttggctggccaccctgctgccagctctgtttagatgccaggggctggccagcaactctgtcctaacctggctctgagctaggggtcctcatgtaccccggcctgcattccccagggagcctgacatactccctttggagaggcaggagagctggtccctggtcccagccctgtctccctcagtgtccaagagatccccttagatgggagaactctgggctgctaagggacctccagggccatatgagtaactgaggaagaaaggtgggcccgagcagggaggggacagcatgagtggctaccagagaggctgctgcttctcagctcactggcctcagtgcctactgcttttggtcctttccttggctgagctgcttgaggggcagtgtccctccctgcccctgtggtgcctgcttaagcccaagcctctgaccagcctgcttggagattcttaaggctggaccaggaaaaggaagcctggccccctaagccagtaggcctgactatgggccaaagggcctgtcctcagctggagttgggccttggcaggctacttggccctttactcatcaacgatagtttgagctgcgcaggtctctagcctatttcagagagctgggctgtggcagtcacccaacagcaggaaaacttg

SEQ ID NO: 117511 - DNA, 1098 bp, Homo sapiens
acctgctcccagcacactacacagacacactgcaaaaatctacatagattgccattcagatggttactacataggtcccaagtagcttttgaatctgtccccttctcacgtccttcccctaccaacccagcctcaggagcctgtggctgccctgtgaggcctcatccctctcctgcttgacccttccaggcctctctccacacaatagccagagtaaccattagagacacctgaatgttcctggcctgcttcggctgaaattcccccagcgtccaaagaatagaacccaggctgctcccaagggcctgcacagccctgcatgagcatcctgctgctgttgctagccccttctcttctcctctgcttcctgtccctctccgttccccggcagccccagttatggctgttcccttgttttcttctcgcaaaagatctattactctttccgcgaagctctccctgacccatcaggcctggtgaggtctccttggggcttccccatcactcagctggcccattaagctgccggtgccatgtctacacttgctatactgggctgtgagctccagtgggcagcaaatgtctgtggaatcccctgccattgcatatttgcactgagtctgtcactgaaggagtgacctaagtgaagggatccatgtacacacacctcccacttcactttcttgctattctgtggagaccattctgccccttactgcttgcacaggtattatccctgagccagcagcccctaagggtcagaggttggggacttaggtaaaaggtgctgtctcagcttgggcaaagctcaggggatgcccaggagagtccttctaagtagggatgaagaacagaggtgagtgcacacacatctgcacacgggctgagccacatatgcctgtactgtcctggcctctgtggtgctctgctgcacggtgtggcccaggctgaggcctcttggcacttgcactagcttcattctcaggcacaggacagcagggggctgcaaaatgacagacggacagatggacaaacgactaacacagggcaagcactggcctgggcatggccttgtgtgggctctgaagcctgggcaac

SEQ ID NO: 117512 - DNA, 2357 bp, Homo sapiens
ggtatagccttcagccttatcccttgaaggaatgtaggtcaagaatgaagaaaaactggataaaatgggtagggagttggggaggaggtgggtggccctagggcataaaaggctggatctccatggtcttccttgggcccctctgcagcctccatgctgcaagggccccacaagccacagagatgagccagattgacaggactccctccctcccattcttcccactgcctctactgcgtacctgggtgcccacctttcctgatatcttggctctgggctcttgggctcccactggggctggctgtgccatggagaggcccactctgcctatgggggctgtagggtgtctataactggctaacactgatgttacctcttctttctgggccctgctctgccccgctgcctgctcgccctctgccctgctctacccctctggcatggctgtgagcagaccctggctcgcctaagaaatgccgtgctcgctttggcctcaaccagcagacggattggtgtggtccgtgcaggtgggtttgtccccaccatcgttctccctttgctttaagctgcttccctgactctgcacatgttccactgggcctgcagcccactcctttggcccctcagcccactagcatactcagcagattgggagcccaggcctcctgagaatagtagtaaatactgaacacagcgcgtggagaagaccacttgggtctaagtgcaggaggattggagagaaagacacagaatgttccagaaaggaaggacagactcaagaaggcagctctgatgccagtgggcctagcaggtcctcagcaaacagacagctcagccaccactaagggggcctggagcccattctaccaggcctcaaagtcattatggcccatgggctccctcacttcctcttcaagatgggatccctgcctgtaccatcctgagcccttaatctgaaaaagcaaggtgacaacaacacagaaccatctggttgccaggtagccttatgacttgctatcttgtacctactgataccaaagggctggagaggctgggggagaggacccagggggtaccctgggctgtctgagggaaagggctcatgtgtttcaccatacaacagagaaatacttgtgggtgtgacaaggtttacccaacaagtggttaaagtttcctcagtcagtttcaggccaggcctggcagggctaagatagagggtactccaggcagtaaggccactggctctaaggaacacttgtccagcctctcagtgtacccaccacactccctgtccaagggcaaggaggagtttggggtgtgtctgtgtatccacatacatatgcacggtgggaaacaaccctgtcttcaggggaagttctattccattcattccatcagagacaaactggcccagagaactcaaggatggtaatggacaagagtcactgtccatgtcttcttcctctagcccagcttgaggactgggatggctgggcaaggaagccataggcattgcggccccttgccttggtgcagatgtgagtcccacaaacacatctggagaagctcaaaggccgggactgggagatgactcccttggaagacaggagagatgactcccttggaagacagatgacagcccataggcctagtgacaaaaggcccctttgccaccttgtggctgttctgggaactgcacctgtcctaggtctgggccagaccaagcagaatggcagtctgaggacactgacttaccacccaagtcccaggaagagaggacaaggaatcagccaggcctgtgcaaaggcagcattttttggttgtggtgtatgactatgaattcaccctctgtttacagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaa

SEQ ID NO: 117513 - DNA, 1002 bp, Homo sapiens
ggctaatttttgtatttttagtagatacagggtttcaccatgttggccaggctggtctcaaactactgacgtcaggtgatccacctgcctcggcctgccaaagtgctgggattacaggcgtgagccaccgcgcctggcccggcagccctttttctttggatttaggcaaaaaacaaaaattaaattaaagacttgtttttcaaggctgagggttgaagcttggctcaaaaatgggttaacgtaggctatggtgaaaacctgttgtccactactggaggttttctgggctccttgatctagttgtaatggtcctctgtcccgcagccccatggggaaactggagccggccaggcggactgaatgctgaaagacaggctctggctgtcatgaggttttgggtttgccctctcaagctgcccaggagctggctggactgccatagatgaactggaaatggaattgtgaaaaaggctctgtgaatggggaggggtgcacactggatttgggccatgacttctttgaactgttgactgcagctgctagtgacaagcctggggccagagcttcttaggctggtgggtttctcagggaacacttccaaataatttgaactagagctagatacaccctcccctccccaatttgcctgataaggtagtgtcagattatttctgttgcttaggttgataggcctaaacttaacctattccattccccttcctgcttcttgcaagctcctgagatcatagtaaggggcttcctctggtccaacttatgagtagcagctggttttgtttttgtttttataaacagagcttctccatttccttagaagagctgtcatcttgagctttgtgcttgtgaccatgctcacatgttgtttgacaaaccagctcattcttggtccatgaagtgtctgaatggggagggtgtggcagtgggggatgggggagatgggtagagaaggtagctaggctcagttcagcccatctctgacctata

SEQ ID NO: 117514 - DNA, 2332 bp, Homo sapiens
aactagtaaaagatgaaattaactacaaagtaaacagaagaatgagaatattaaagggcagaaatcaatgaaatagaaaacaggtaaacaataaagtcaatgaaaccaaaacctgttttttaaaatgagatcaatatagtgctataactgcttacgtttgaactctttaagtgtggacaaatatttttgccaagacctgatgtggtatttgtgtgcatgtgtacacacatacacaacagtagtggccgttatttcacatttgagctagtatagtttggttaaggaagcagaaggattcaacattatagaggtataacaaagaaggtcacataaaagtctttcacagaagaacttaggagtgatttattcttctccctttaatttcttaaaattagcattttaagctttattagatacggagtgtcaatcattaactttggatttagtttaaaacatcaagtatactttaaggaaaacaactgtctctttacaggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtaggtagcacacagttttgtctttgatcacatgctcttaaaaagggagtaacacctataacatgccagcaaaagaggtgactgtatcaagtagtcttgatactttagggataatatgtacttaatgtgtcttaaacatactcttactgttctgtctttatgaatctgaacacttagatgatactgcattttaagcataagaacaattagttttcaatgagaagagctcttgttaatgtattaacagttactagttttggcacctgcaactttctgtatagaccatacatatctgacatcagaaaagcaggccctagagagaagtatatactagggtactttagagcaacttaatgaggggaggaaatgaaagaatagatcagaatgattttgttgacatgactacagactgaaataatgtgaatgaattaactgaatttgctctgtcaactttagtaaattgcccattgcctttgctttgttcataatttcagcagggcagaataaaaaccatgggaggcaaagaaaggaaatccggaaatatagtcttaacctggtgttgttctaattttccatctgttcttctgactcaactcactggctatcgatgaatcagtaggtagtatttataagtcttaggaaagactactcaagttaaggtacttccctatatccatctcttttaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctg

SEQ ID NO: 117515 - DNA, 1193 bp, Homo sapiens
caatctagagaagtatctgtagtgttagttttgcttctagtaaagttgagcgttccttatgtttggctattcagatttcatttattggctgtacatattaacccatttctctttaatgatttttgaaagattttatattctctcagctaatcattgttgtacatattgcaggtatcttccagtcattgtcctaacttttctttttgcatagaagctttttaatgtagtcaagtacagtactctgtctgcatggcttgcttttatctaataagatcttctcccttctagggttataatgattcttcaagcttcatttttgtttttcaagcttggctgttaatggctcaagtcaacctctagctagttattattccaatatagggataagttgtcccagcagtggaatgagtaccttgtgacaaagtgccacagaggaatgaacttttgttgttgtaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggtaagtttttaatgtgtaagatagctctactctagagcctttaaacacttcttatagatttaaatttgctaacttcattgacactgaattttaatactctctaaattcaaatgtaacgccatatttaaatccacatatcagtaacacactaaatgtaaatggtctaaacacagttaaaaggcagaaattaccagatcagaaaagcaagcttagctgtgctgtctgtaagaaacccgctttaaatatatagacagaactaggtttaaagaatggaagaagatacggtacactaacacgaatcaaaagaaagctggagtgactatattaaaataggtttggaggcaaagaatattaccagggttaaagaggattatttcatactgataaggggatcagttttttaaaaagacataacaattataaatttttatctggctagaagcagaacttccaagaagtgaaacaaaacccaatagaactcaaagaagtccacaaagtgacaatcatagagatttcagcacctctctcaattaatataactagacagaaatcaggataacttgatataacactattgaccaaattgtcttaat

SEQ ID NO: 117516 - DNA, 1034 bp, Homo sapiens
gagaccatcctggctaacacggtgaaaccccgtctctcctaaaaaatacaaaaaattagccgggcgtggtggcgggtgcctatagtcccagctactcggggaggctgaggcaggagaatggtgtgaacccgggaggcggagcttgcagtgagccgagatggcgcccctacactctagcctgggcgacagagcaagaatctgtctcaaaaaaaaaaaacccctctctagattacttacaatgccggatacaatgtaaatgctatgcaaatagtttttatactgtattgtttagggagtaatgaccaggaaacaagtctacatgtttagtgcaagacacagccatccattttttttcccaatatgtttaatctgtggttggttgaatccacagatgtagaactcatggatatgggggctgactcttatgttttgagacatagcctggttggtataagtattataatggaattaggaaatagaaactttcttctggttttcttagatttgggaatggatgatgaaggagatgatgacccagttcctctaccaaatgtgaatgcagcaatattaaaaaaggtaaggtctttaaagagtttaagtttattctgcttaatatataacaccaattgattaatacaagtaattcaacaatctatgttagaattttataatttactgcttaaaattacatttaaatttgaatgttcttaaacacttacttgagtgatgtttgtatgttcttaaaatatacagaaaaaagttctgtctgctttcttgccacagttgactattgtcatttattgggcatctgtactgtgtctacctatgcaaacacttccctaggaaggatgatctacatgtagaatatctggatcgcaggttggcttatatacctaaattttgatagatactgttaaatagtcttctgtaaagataccacttctagagcatggtggaattgaatcgtgactgtctttcttagatttataattttgaaacggctaaagtcaaaggaatatgtaacactttgttcc

SEQ ID NO: 117517 - DNA, 1090 bp, Homo sapiens
gtatgttgtgctcactaaaaaaaactgaaagcaatccaagtgtccctaaaaggcaggtgagtaaggttttatccagaagatgtagaaactgatacccgaattgctgcctaaatacttgctttggcattgaaagtgttctttattttatcttggtgcctgacacactaatctgtcctgtgctgcttcaaggaagcatttgccaattttaagaacatagggcatcttgaagacttaccatgccagctttgatcactgaagtaagtggacggataggcagttagcaacaattaagttattcttttactctgttgcctttgggaatcagaagtgaatggttttatcttaagtaccaatggcttacataagattctagcctcttgagggctggagtcttttgaatttggcaactttctgctttttttgttttccacctgcagtatctctggttatgggttttatgtgacttagaaaacaaaaataaaaccttttaatccacaggacaatcagaagtgagactcttggcacatttacatgtggattgaatgattagttcaggtccagggtacagtatcaggatacaagtgtctttcagaagtccctgaaactaaatagcttaaaggaatgactgttgctacttgtgcatttagtctgaaagcaaaaaatatcgtacatccttactttaaatgctagaggatttaaagaggattacttgagcccaagagttcaaaaccagcctggacaacatagcaggaccctgtctttacaaaaaataaaaaattagctttacaatcctttacagtcataaaagcctttattttattttattttatttttttgagatggagtttcactcttgttgcccaggctggagtgcaatggcgcaatctcgggctcactgcaatctctgcctcctgggttcaagcaattcccctgcctcagcctcccaagtagctgggattacaggcatgcgccaccacacccagctaatttttttttttttttttttgagatggagtctcactctgtcacccaggctggagtgcaatggcacaatctcggctcactgcagcctccacctcctgggttcaag

SEQ ID NO: 117518 - DNA, 1103 bp, Homo sapiens
ttgcattgcctcagacataaatgagcatattctgatgtactctttggatctgaactcatcttcacaggtaggactcactgtggggaaaatttctatcttatttagtagcgttgtttgttttggactgaccttcctcaggttcgcatgtagttaattgtggcagttaactgttcagatggagtccagtattcagtgggagacgaaaggcaggcagaaagcaaatacaaatatgtatgttttattaaatttataccaatagtgagttcagtagggcaggccttaaaagcttctgttcctagtagttatactttgaaaaaattttaatagaaatactcggagactaacttgtgaataactgcttacaacagtgctttacagggttatgtattgtaggttcttagaactttgtggtcaataagttagagccttctgatggactgtagttgatgaaatgtcatgtagaactctctctcttaaattttatatttaatgtcctttttttttagatgccttcaattaagttgcagagttctgatggagagatatttgaagttgatgtggaaattgccaaacaatctgtgactattaagaccatgttggaaggtaagttcattggaaaacctgggtgggaggaaatgtgtaatttgagatagtttgtgaatatcaaatttatatgagcagcagcctgtcataaggtgcttgagagtatgaagaggtaaagtttacatttttttctttataacttacatttttctgatacaggtcatcctttctgcattgtctgaattagtgagggtcgttctctcattaaatggataaaatcataaggtaaaataaacattgaagtgattgccaagccttaggcaatggttaatttctgttcaagtaaatttgaattcataagttccagtgatagaaattaaggtctttggaaaagagataccgtcctataatggtggctgaatagaacaccttatttcagtggagggagtgagctctgtggattgctgtgtagattttatttattgattgatttatttgagacagagtctcactcttgtccaggctggagtgcagtgatgcagtcacggctcactgcagcc

SEQ ID NO: 117519 - DNA, 1154 bp, Homo sapiens
tatgatgtgatagaacccgctttatgctggccatggagaattatttacaagtgcaggagcctttaggcctctttctttagaatggaattgttttgaaagcatttcaaataaatatttcatccattattacttaaaaattttgcactttattctactgtaacactaaaacttatctttgagtttagtattaccaagtgcatcgaattacagattaaccgattgaccagctgctatttagtaaggtctcaactcccttaagagtaacccaatccacaaacttgactatgactaagcacttatcttgagttatttgaaagaaatatgaaacggtcgtcttgcttttagagtaattttaatcaactgcattgttagatttgtgattctgcactgttcatttcagtactatctaatataaaaattacatgtttaaatgttttataattaaaaattgggctcaggttaaaatattttcttttggagataccttttgttgtggtcttgtcacaggaagggtcctctactctgcatccttctccattaagcagggacaactgcattattggcaagcgctaagcaacatggagaagcagacatgtttgtgaatcgcaaagtgaaatctgattctctccaactatggatgagtgagagtaggatatttcagtggctggttttaaaacatgctttacttttttgcttcctttgcctaacaacctgtttgctttggggttggcgacaattgtctcagagaagctgaatgaatattttaaccgatgtaatgggtcataagtctttgaacataaaatgggtgtgatgcatgttttaaatgccaaatgatacacttttgggaaaatatatgcgatttgtaatacaacacacctagaaaacttcagaggtgccataagttaatagtgacatcaccggattatgaatacttgagaagcatgggccttttaaaagttgtatgtgagttttaagaggccttgaattaatctgtaccaggtattgctattctttttgttgttgttgttttccttgtttgtatgttttcttttttaaaaaaagaatttgaagatggtaagaaattgttggacttttaattttaaatgcctttttttttttttttgccagaactcaagtcctttgaaattaaatgc

SEQ ID NO: 117520 - DNA, 1066 bp, Homo sapiens
acatacacctcaggaatgaacacacgcgcgtacacacacacgcagccccccccaggagtgaacacacacacacacgccccgttctgttgttcccaggaacacacacagagacgcacacactcgcccggttttgttttttccaggctttttaactggggtctttcactcggcttagggcaccgctgcctgaaagacctttctaggccagtcggggtccggcacccagttgacgagacagcgcggcgctttcagagctggggagaggcgaaaactcttccggccccccgatcccccggccagccgcccccggcagctccttgccgcctcccggcctgggcccgcccagccgttctcggcctgccgtcaggcgatctcggcggccagcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccgtgagtagccgcccactgaactggaaagggtcgtggctaccggattgcgtgccggctggcctcaccgctgcggtttgggcctgcccgcggcgggcggtgactgggcctggccttctttcgggcccggtggatcgcgttgtcgaccctgttcttcgggagaccctaccaggttccgttcacctgccccgcccccgactcagcgaggcctcctctggccgggcgtcctcacggcgctccataagtgagccgaaccccgggctgggccttctctgcaccggccgagcgtcagccggcgcggagctcggctgcaaggcccaggctgcggccgggggcctctcttggtcttaagcctgctgtcccggggaccagggcgggggtggcggcggggttgtgaatgggggtcccttggctgtcgtgagcgtgggcgtgtgtcggtgtctggcttttgttgtggtcgggagggagagctgcggtggtggtctgaggccgcccggttcttg

SEQ ID NO: 117521 - DNA, 1034 bp, Homo sapiens
tggtatgttaaaagagtatagagtaagtgattcatggcttctgaaatacatcaatttgacgttgcagtcttgaaaaggcaatagctgacatatcctgaaccagcttgggtttccagtgcactcagtgctgaaataattgctgtgaagggttgagttgaattcacaatgacttaggacagtagtagctactgaatgttcaatctttgaaatgacagaattagcttatagtgaatattgtctagcactgagcatttccatgtgccaagcatgttacatgaattattgagttttctcaactctgttgagaagagcagagaaggttctgctattcaggcattctgatcgcagagttcctgattttcaggaagcattaggtttctcttgcctttgctgaaattcttattagtggtgtttgaagggtgggcaatagcctacacagctttagggtttagatgtgtcgcttagccccattcaggaagctaggtgtgtgatgggccctttggggagtgtgtggtgaggaaggcttgcatgctgggccttttgagtgttggcccaagtcaggtagcctggttacagcattctcaagagttcatggactgccgggcacagtggctcacgcctgtaatcccagcactttgggaggctgaggcgggtggatcacaaggtcaggagttcaagaccagcctggccaagatggtgaaaccccacctctactaaaaattaaaaaaaaaaaaaattagccaggtgtggtggcgggcacctgtaatcccagccactcgggaggctgaggcagagaattgcttgaacccgggaggtggaggttgcagtgagctgagatcgcaccactgcactccagcctgggtgacacagtgagactcgtctcaaaaaaaaaaaaaaaaaaaagagttcatggactaacctttgtgtctcaagggcatttatttgagccagagtttgaaggggagttaggtgaggttcagctgaaccaccacagcctaacaattgctcttgaagataaaagaattttcacagtg

SEQ ID NO: 117522 - DNA, 2573 bp, Homo sapiens
gttacattaagacaagccaaaattgaataggaagtgtaaagtttggaagactcatgttcttgatcttgattgtcactacatggaggtcgtggaacataaaccatgaatcggtcttgtttttcagcttgcagtttgacccagcacctcgtagaggcgagccacatgttactcgtcgtaccccagactacttcctgtaatgaaattttaaacttgtacagtattgccatgaaccatatatcgacctaatggaaatgggaagagcaacagtaactccaaagtgtcagaaaatagttaacattcaaaaaacttgttttcacatggaccaaaagatgtgccatataaaaatacaaagcctcttgtcatcaacagccgtgaccactttagaatgaaccagttcattgcatgctgaagcgacattgttggtcaagaaaccagtttctggcatagcgctatttgtagttacttttgctttctctgagagactgcagataataagatgtaaacattaacacctcgtgaatacaatttaacttccatttagctatagctttactcagcatgactgtagataaggatagcagcaaacaatcattggagcttaatgaacatttttaaaaataattaccaaggcctcccttctacttgtgagttttgaaattgttctttttattttcagggataccgtttaatttaattatatgatttgtctgcactcagtttattccctactcaaatctcagccccatgttgttctttgttattgtcagaacctggtgagttgttttgaacagaactgttttttccccttcctgtaagacgatgtgactgcacaagagcactgcagtgtttttcataataaacttgtgaactaagaactgagaaggtcaaattttaattgtatcaatgggcaagactggtgctgtttattaaaaaagttaaatcaattgagtaaattttagaatttgtagacttgtaggtaaaataaaaatcaagggcactacataacctctctggtaactccttgacattcttcagattaacttcaggatttatttgtatttcacatattacaatttgtcacattgttggtgtgcactttgtgggttcttcctgcatattaacttgtttgtaagaaaggaaatctgtgctgcttcagtaagacttaattgtaaaaccatataacttgagatttaagtctttgggttttgttttaataaaacagcatgttttcaggtagagcttaaactaaatgatgtgtttacttagtgcagtttctggttatgaatattatattgctatgtgtatattatatggactctttaaaatgattgacagattggcaaattcttaaatctttgtacattgttgagtcatatgttcttagagttaaatttgtctcagataagaaagtgttaaagcattagcctgtgtcaagttctttgagtgatactagtgaaaccaaatagaaaactattgttggatcatgatttagtcttatgtacattcacccgaagacaaaaatggtacttaaagtggcagtgttcaacatttaatgagtttttccccttttatccttcgaataggattagatgtttaaaaaaaagttcttctgtgggaactaatatttgatattttaacctaccagagtaaacaggaacacttaatcatacttgtgagtgtagtaaataaaagttttcttgctttgtgctgtgttgaatctggaaccaacagggaagttatagcatatcccctttctaaaatgcttgaggaacacatacataccgaatgtcttttctgatctaattgatagtatttttagtggcttgtggagttaattttccaaagcaaaaggccattagggtttctacatttcatttcatttcattcttttctttcacaagaaatacattctctgtgtgtctttttgttgctctgtcactctatgccctttctctccgactgaacaaatagcttatccatgtgcagtggttttaatacccaaacaatctagacaccaagcagctattttttccggtcctgtgatatcagaattgaccaaggaatacgtatattgtaattgacacgtggtggtatcttccaggtacaaattctctaaattttgtggttagcagaatgggacttgtgataagaatagcttggttttagcataactagggtttaaaataattgtttaattatagagactgaccgggctttggccatctaaactggaaagtgttagtaccctaccttcttttgaaaatggctatggtaaggaaaatgtgttagtaaattatgtattttcttgaaaaatacataattatggttggatgggaatcactaagttgggtgttaactgatgtctcaattagtaacattaggattttcattaataaacctaaaaagctttccctaagaacaggcctggcacagtggctcatgcctgtaatcccagcactttgggagaccagggtgggtggatcccttgaggtcaggagttgaagagcagcctggccaacatggcaaaaccccatctctacaaaaaatatgaaaatcagccgggcttggtggca

SEQ ID NO: 117523 - DNA, 1170 bp, Homo sapiens
aagtaacaaaagtagctcatgcattcaggtggatggactttgaggaaatgaggctggagatcctagaggcatattgcatttgttcctgggcagtgaccaacttaacaggcctttacctgtgactgacaaaattggtaaggttctggtctccaggattaagtatctacttctctagggaatggccacttaaatacttattcttaaatcatgttttaaggccactgcaagagaagaggctaatgagacattgtcatttacagcaaggcagatacatgagaagtatttcattctttggtggttgctgctgtttgttaaagcctttttttttttaaagtactaaaaaaaaaacaagttttgtaattagggggaaaataaatacatgtgtaccttacaggttgtataaagtacaggagattattaagtcatccagaaaaaaagcattaacatttcttaagcccctttggcaggggtgggaatgagtagagatttttttctctcttgagtgaagtaacatttagttgaattgagggagtaaagtaagatttttgtctccttttccttgcagggatataactggtgccatgaccggaatgtagtaacgattttcagtgctccaaactattgttatcgttgtggtaaccaagctgcaatcatggaacttgacgatactctaaaatactctttgtaagtaattctacctgaacattttcttgcattactgaatatgtagggttttggtttatttattttgagagagagggtgtcactatattgcccagtcttgtctcgaactcctaggctgaagtgatcctttcaccttggcctcctagagtgttggggttacaagtataagatacagtgcccagcctgaatacatagtttaaatgtgaggtttaagagtttaagggggccaggcgcggtggctcatgcctgtaatcccagtactttggaaggctcgggtggatcacctgagatcaggagttcgagacaagcctgaccaacatggtgaaaccccttctctactaaaaatacaaaaattagcccagcatggtggcgcctgcctgtaatcccagctactcaggaggctgaggcaggagaatggcatgaatccgggaggcagaggttgcagtgagccaagatcgcgccactgcgttccagcctgggcaacag

SEQ ID NO: 117524 - DNA, 2402 bp, Homo sapiens
cataaatcaaggagagaggccatcagaagaaaccaactgtgctgacaccttgatcttggacttctgcctctggaacagtgaggaagtaaatttctgttgtttaagccacctattctctgatgctttgttgtggcagccttagcaaaagaataccgggggaaaggatgtttctttcagtaaatggtgctgaagcaaatggatcagaatgtatcatagaactaaatgtaagagctaaagctacaaaacttctagaataaatcagaaaatctttgtcaggttagttaaagattcttagatataacaaaagcacagtccataaaaaattgaaaaatcggactttatcaaaattaagattatgttttttcaaaagatgacaccagaaaaaaagtacttgtattcagatatttaaaaaaaaaaaacttttacagctcaataacaagacagataattgtaaaatgggcaaaatatttgaatagatattttacccaagaagatgatacatgagtggtcagtgagcacatgaaaagatgcttgatatcaattgtaatcagggaaatgcaaattaaagtaactgagttactacttcacatctattagaatggctgtaatcagtaaggttgataataccaagtgttggttaataccggagattaaactcttcatgcattgctggtgggaatataacatggtctagctactttgaaaaacagtttgactgtttctcaaaaagttaaacgttaccaggtgatccaacaattatattcttaggaatcttcctaaaagaaatgaaagcatatgtccacagaaaaacttccatgtatatgattatagcaacattattcatagtagccaaaaacctcagtaacataattgccagttcatcttaactgtgaatagagaaacaaaaaatggtatagccatacagtgaaggactgtgcaactatgaaaaggaacaaaccactgatctatgccagaacatgggtgagcctcaaaaatattctaagtgatatttagccaaaagactacattttgtattccatttatatgacatttctagaaaagacaaactcaagacagtaaatcagtggttgccaggagctggagtgggagtggagagtgactgcaggagggatctttttgggataatggaaaggttctaaaactggattgtggtgattgttgcataactataaatttgtgaaaaattactgaaccgtaaagtaatttatggggttttaatagcccattgatttatgtttggtataaagttggtggtagagggagtttgattttagttgagatgaggtgggcaaacaccccatgggcatttaaaaattctgtagagctgtggttttggttcactatgatatgaggatgtgtgctgttttttcaacaaaattgtaactgcatttttttctatagaaagtttcttgaattttcattggtttttgaaagagctagttgtttatgttttgcattttattgttttaggttcgttaccgtgaacgcatcaccattcttcgagggaatcatgagagcagacagatcacacaagtttatggtttctatgatgaatgtttaagaaaatatggaaatgcaaatgtttggaaatattttacagatctttttgactatcttcctctcactgccttggtggatgggcaggtatgtggatctaaaactcattgctgattatttcagagaatctgctttctttagtgttcaggtgcttatgactctttccactcttaacacccctttggggatattttttaatagatattgatagcattcattcaaacttaaaaaaaatttaatttgacaaatgtgtccaacttttttaagtgcattattctttatatcaggcactgaactgtatggtgggatcacaggggtgggtgatgtagcccatttaccctctcagactgtttttggacaagtctgggagatgtaaggagctaattattggcctaggtagatgtgcacacaaaagaacttacaataaaattttatgagtatgaagatactagtctctggcaaagggcaggagtgatatccaagaagttttctcaaaggagctgtttgaagtggagtctggttgtgacagcgatggtctattaggaagaacaggagtgtactcaatagttcagagtgggctggagcaaagatgaaccctgcaaagtcaagtctcattcaggcagagcacagaaacaccagaggggccaagtgatgggggtgcccagctcattttttaaaatttttgtagagacacagggtcttgctgtgttgctcaggttggtctcaaactcctggcctcaagcagccctcctgcctcagcttcccaaagtgctggggttacaggcatgagccactgtgcccagccaagaatgtttacaaatttt

SEQ ID NO: 117525 - DNA, 1262 bp, Homo sapiens
agccattaaccatgacagtaataatctagactaggctgggtgcagtggttcacgcctgttatctcaacactttgggaggctggggaaggcgggaaggatcacttgagtccaggagtttaagaacagcgtagtcaacataaaccccatctctacaaaaagttaaaaaaaatagccaggtgcagtggtgcatgcttgtagtctcagctactcaggaagctgaggtgggaggatcacttgaacctgggaggtcaaggctacagtgagccatgatgcaccactgcactccagccgtgtgacagagcaagacccctgtgtctttaaaaaacaaaaatctagaatggtagaaatgataaccgaaaaaagcaagttccaaaattacatgcattacatgccaattgtagctttgcaaagtgtactgatgatgatctgaacatgaagcaaaagatggtaaagagctgttagggtggcaggcttccgcctttccctttaaataaattgtttgactttacctttacccaaaaatcttggggagattttttcccccctaggcaacagactgatttttattattaaagaatattcaaaatgataaatggctgtcacagactttcctaatattagagaagcagtgagatgtggttttagcgtgagctgaattttcttgattaatatctgaattgtgtaaagtcctacgaaatatttttggagatcgttattttctgcatctgtaaaatgaaggagttggactagatggtggaaggtttctgcggtgactccaaatactatgaaaagagctaacctgtgctaaaaacccaggatgaatcccagtgctcagaggaatgaatgtgctacctttaagagtatgcaagcagcctgggcaacctagtgagaccccatctcttcagaaaacaattttagccagacatggtgacatgtgctgtagtcctagccactctggaggctgaggtgggaggattgcttgagcctaggaatttcaggctgcggtgagctactccactgcatttgagcctgggcgacagagtgagatcctatctggggggaaaaaaacttactcatggaggttaatgggctgaattgtagcccccaaaattcatttgtctaagtcctaacccacagcacctcagaatgtgactgtatttggacaggtaattaaggtaaagtggggtcacatggttggaccctaatccagtgtaagtggtatccttattagagattaggacacagatggggagaagataaga

SEQ ID NO: 117526 - DNA, 1442 bp, Homo sapiens
aaagtttgtgaaaattagccagccatggtggcgtgtgcctgtggtccccactactgaggtgggaagattcctgagccaagaagatccaggctacagtgagctatgatcatactactgcactccagcctgggtgacaaaatgagaccctgtctcaaaaaaagaaaaaaaaagaatctttgagtgctgcattgtagttagaactctgaaggtaaggaagtagatacctgaatgtcctgttcgattttcattggttttatgtgacagctaacaattagtatttaattagatggctatttgataggtttttaaaaaactcctggtattgatgataggaatgcatattttttccctaggtaacagggtgagatagctaatggattataatcatatctcacttattttaatgggttcataaatgcctgcaattttatcttagactgagtctgccccttaagctacattaagtgtaagtaaacaaatctttgttaatattgtttaatgccaaatgtattgccttatttttgtctcccatctgtaggctaaagaaatcctgacaaaagaatccaacgtgcaagaggttcgatgtccagttactgtctgtggagatgtgcatgggcaatttcatgatctcatggaactgtttagaattggtggcaaatcaccagatacaaattacttgtttatgggagattatgttgacagaggatattattcagttgaaacagttacactgcttgtagctcttaaggtaatttcaattttatgttggggcatgttgaaatgggtaagacagtcctcttgaaagttttttttcccccagttattttctctatctgaatgttaaaacaaaattccacatttaggaatgcatatgttcaggttttggacttaaaaatcataggcgtctgcgttctgagtaaggggatggtacagaatcaaaacaaaaggaggagaatgaatgcctcagtcagattgtttgaaaaaataggctgggcgtgatggcttatgcctgtaatcccagcactttgggacgctgaggtaggcagatcacctgaggtcaggagttcgagaccagcctggagaacatggtgaagccccatctctactaaaagtacaaaaaactagccgggggtggtggcgggtgcctgtaatcccagctactctggagcctgaggcaggagaattgcttgaacctgggaggcggaggttgcagtgagctgagattgcgccactacacgccagcctggacaacagagcgagactgtctcaaaaaaaaaaaaaggaaaagaaaaatgttagagggctggtcaaatagatattttagttcagtaaattggggtatggagaggtaatataattagatttgtgtttttagatacttttgaagtattataaatatataaacataccaaatgtcaaaatgttttaaatcagctggtcac

SEQ ID NO: 117527 - DNA, 1108 bp, Homo sapiens
tcttagtataaatcatgatccagagactgagctctaaagtattctaataaagtataactgactttttatattgtttattgcaacttataaaatgcctcttttcagcagggcaaggtggctcacacgcctgtaatcctagcactttggaaggccacggcaggcggatcacgaggtcaggagaccaagaccaatcctggctaacacggtgaagccccgtctctacttaaaaatacaaaaaattagccgggcgtggtggcacacacctgtagtctcagctactggggaggctgagacaggagaattgcttgaacctgggaggcggaggttgcagtgaaccaagattgtgccactgcactccagcctgggcgacagagggagaccccattccccccggccccaaaaaagcctcttttcatcctcttggcttccacagtcaaatgtcatgcatgtgtgtatttgtttcatggtctcctaggcaggaagctgtaatgcagttagtttggagttgacttcatgaggaaacagaaaaggtgaacattcccactattcagaaacacaggttccccaaccctccctacgttctccactgggaccagaattgtatgttttcagaaaattggctgtaaggctaagttgaagctcatgtactgtagaaagaatgaaggacccttcaggagtatgtgggataacatttgtattaccagtctggtgtggccctgttttatggcagcaaatatgttccctatctcatggtaagtcaggtttgtcagagttacctgtgagatagcctttgcttagtttggaaggggtaagttaggaaaactaagagactgggtttggtggggtcttttatcagggtactgaggagagaggcaaagctatatgtaacagggagacactatttattctttctgctttgacccatttctcttacttcattatcatccttgcctgagaaagctgtcaacctccactcatacacaggcagatctgaattggatgagaaccatgaaggaggaagatttttgtttttgtgggcttttttttttttttttttttttgagatagagtctcacagtcgcccaggctggagtgcagtggtgtgatc

SEQ ID NO: 117528 - DNA, 1177 bp, Homo sapiens
atcataatttgttgatagtttaataatttggtgtgcagctttgcctcaggctcagttctataatcagcattacatcagtataactggccgggtatgtttcaatctacagattgaaaggagtaaatagtatcaacttgcttttgcattgactacagtaaacaatcttttattatgtgacttcagctttgttttagcttgggtatgatttcttggctttgtgcttaccaaacatgtggagaacgttgtttgatagccagatttttttttttcaaagaagttctttacctaggtatgctgttttccattgctttgcaagcactataaataaagtgcagtcattagtcattaaaatgttagttttaacatttgttacgtgagtatggaaaaaacaaactgcttccttctaattagatgagctgaaaaatatttgaccaagatgacattcttatatgaattgggtaatatgttgctgtgagtatgtgtgtacgtttcattttaaagggtgtttggctcatttctctagaagtgatttgaatattgaggacaagcaggtgggggaagcatgttacagaacattatttttatcatacttttataagatattgttctcagttacagatgcaactcaaagactcagaaaggtaaagtgacttgactaaaggggctaaaagtgagattgccaaggcttgtggattctaagcctaatgttctggtattgcttcacagatccccttctgttttcagaggtagtgttagtagtgaaagatgtaggtaaattggggccaagctaaattgggaagtcaacactttcataaaataaaacttttttttttttttttttttgagataaggtcttactcttttgcccagtctggagtgcagtggcgcaatctcggctcactgcaacctccacctcccaggttcaagcagttctcctgcatcagtctccctagtagctgggattacaggtacccaccaccatgcccagctgttttgtatttttagtagagatgggatttcaccatgttggccaggctagtctcgaactcctgaccttcagtgatccacccacctcagcctcccaaagtgctgggattacaggcttgagccagcgcgcctggccaagacattatttttattttcattgcttgaaagcttcctattcatgttacatact

SEQ ID NO: 117529 - DNA, 2834 bp, Homo sapiens
ggattagtccggttcgccgctgtgcgcactgcgcatgctccagctccatccttcccttcccccaccaccccgccctccgggagccacgcccaaaaagtcaaggcgcttcagttaccagccggctacgtcgcgcctgcgctttgacccccagtttgcgccccaactccggtcgtgcggccgcccggggagggctctgcagttgcgcagcttgctccccggcccttttcccctccgctccccgccgcctcctgacgccgggcgtgacgtcaccacgcccggcggccgccattacagagagccgagctctggagcctcagcgagcggaggaggaggcgcagcggccgacggccgagtactgcggtgagagccagcgggccagcgccagcctcaacagccgccagaagtacacgaggaaccggcggcggcgtgtgcgtgtaggcccgtgtgcgggcggcggcgcgggagcagcgcggagcggcagccggctggggcgggtggcatcatggacgagaaggtgttcaccaaggagctggaccagtggatcgagcagctgaacgagtgcaagcagctgtccgagtcccaggtcaagagcctctgcgagaaggtgagctgtagtacggctgcggacagccgccgcggggccgagcccgccgaggaaaaggcggccgtgaggagggtgcaacatggcggaggccgccggtccgggccccccgagtctccgagaccggcgcccatcctggccggcggcggcttcctaacgacccggcgccccctgcctcccgcgcagggattggttgccgccgccgcctaaaatggcgccgttcactcgactcctgggcttttgagtcagccggccttggcgccagacgaggtggcagggggagcggagaccctgtgggtcatcgtcagggacggttttgagggtgagctggcttggattctgcggcttgggaatggagcctgggcctctccggtgggctgagtaagagtcttgccgctggtacccaggcctagttaggtccagagctgcccagaggatcccccaaaggcagtcttgttaggccgtatcccagaacatacctaaaggtcacacagctttagtaccccttggtggtttgtattaaactcaccaagcgatcttctccagaaatcaaggtaaggggtgtctttaagaatttttaaattattctcttaacctaatttttacgaaggtcatggtggtagctataagggaggagtgtaacttatttttcatagttggaagaaatcgggaatttggtgagtcatactacataaggagcttttggattggaaatcaagtgtcggttgaatatgatttatatgctgactcaaagccttctctaagcttaacacacttggcattttgccgtttatttttaaaatgaacaacataaaatggaagagcggtaaattttgtatctttgttgcaaaaattacttgatagtattttgtggctgcaagtagtagtagtgataataactgtcgactgagattgtattccagacattgtgcttagtgtttaaataatgtctcacatacactgaaaatagaatgttgtagtccacttagtaacactaaactttatattagctaattcccttttgttttcccctgggggttggggaaacaggtagttaatttagctattagctttgtgttgtatttttaaattcttgtaactcagttttctaaagtacacaaaatgctgatctctgctgtgaacattttaacttcccttttcaaaattaactttgcagcacgtcactttagtacagaatagtggagtatcatattagcattttgtatccgtgaaaagaattaatggagaactattatcctgatttgtttctggtttgatgtgaaaattaggttcatgagtttgacgtatatgtttccaagacaggcttttttagaaaccatgttgtgaacaattggaatttaagtaagtcagatttagatttgtttctcccaagcctgaacaaaactactactagtggatgaggtggcacatcatctgttggagatgccttttaatggtagcgatgtattgaatctcctgtttctttaccctctcacgtcaaatgaggttggtatttattttaaaggtttaaaattggcctttaaaaatgaatgtatattgccaggtcttaatttctaggtactgtacatgatgatcttaccgatttttggaattcagtgcattatatgaaagacttttaagtcagtagttggccagttgactagtcttttgaagaaaacgtggaaaggagggaggtaatgacgtaactggaagactggactgcgagttagatttggacatgagtccttctgctcttacttgagtaattgtgacagactttgggacagccacttcacttgtccttgttttcctgtctataaactaaaatgtgttctgagattatacagtcaattccgttttaaattagtagtgtgtttaatattgaacatctattgaatatctaagattgcatactcttttgagggaaatgaaaagcaatgaagaataagtatgcttattgtcgaggagctatgaatctagtttgaaagaaaagcatggtatgaaaaggtgtgggagatggagcatggaagtagagggtttgtgttggaaactgttgtagaagataagataatactggatgctagagtggggtgggtgaagctgatgcatctaatattgctttccacatctttgtaaaactaagatgtagtgaggtaaatctccattgcttgcgctgcttacgcaaattttagttctgagtgccaaaaaagatggaaataatatttgagagtag

SEQ ID NO: 117530 - DNA, 1024 bp, Homo sapiens
tttatagtatttaaatatgaagataaccatgatttgctttaaaatttgctttaaaatgatggtgagggaggggtggggtatagataaaacaagactgccatatattgttaatcgttgaggccaagcaataggtaatgggtgtttattatattattatctctacttttgtgagtattgaaaacttcccataagaaaaactgaacatgcctctatgcatgcctgggggcttgtaagacccaggattctaccccaatatgggggatttcatgcatggaaacagactagcagagaaagtcatattcttaggaaaaatgttttgggcactccttaaatctttggtgactagaaatccacttgaaaacagaattcccttccctgacagtacctattccagtgttaggtacacagggtggggaggagggaaattgattggaattaagaaacctgattaattcagaattaatgcaccagcttcctctgaagattaggtagtattcaattttcagcctttcagaaatatattcgtcagcataaagacaggcgaatgggctgcatgttgctatgcagacgacacagtttggaagggccttctgtttgcttatggattcgctctcccttgaagaaaaactattaactcatgctgcagcctgctgctctctgcttggtgttggctatgtcaccgagcccaaaatagaaagttcttttactgcagagagggaaggaggtttaaatttatcaattcaaataacaaagggtagaattatactggcttttctcgggtggggagtagggggagataatgcctatttcattaggagaaaaagtgatctgacattggcaggggctgggaccagaagacaagcttgcactgtggtgattgggcttgtttcccatcctggcccccctcactccctccttccaacagtgtcacctctttcaggacatgggaaagcatctgagccactgggtaatcagttccagaaatatcactgaaattatcagactgggaacgattctctgaacc

SEQ ID NO: 117531 - DNA, 1004 bp, Homo sapiens
atctaagtcaaaagaaaaaattgttatggaataaaaaattgcataaaatattttagttcacacgtactgattcatattatggagaaacaagtgtaatactctatcttatctacattttgtaattttatagtgatacaagatatatgtgttttggggtatgtaacaaaagctacaccaatattgtttaataattattcagaaatattcaagtataatacttaataaaaatttctgctatgtgcaaggcatggtgctaggtactgagactataaggaggtaaaagatagttcctgcccttaaagacttctataatttaatcagaaaggagagtatatgaaaatcatactgaataaaaagtggctcataataaatgccaaggaatcaacacaaagtcctttccctggtagggaaagtttttttgaggaaatgggacatgaatttggctttgaaggatgtggagggtttagataagagggagaaactgttgtgttctaggttagaggaacaacataaactcaaaagagactaaagaaggacaaaggataaagggcaaagtggaaaggacaaagagcaaagacatgtgcctgtagagttttctgagcagaattggaaagaggtatattagaacagtaaattggaggtagattttaaagtcttttaggctaaggagtcaaaacttgattttgtaagaggtggaaagtcgtgaaggttttgaattcagtgtaaagaaatgtaaattttaatctaccactattgtgcagaatagattggaggactaagagtaaaaataggtctgttaggagttcaattaaggaattttggaaaatgtctgaggacccttgctaaaatgcagcaatgtgaatgaaaagtaaagttagaacatgctgtattgtaaaaaacaaaaaaaaaagacatgaggccgggtgcggtggctcacgcttgtaatcccagcactttgagaggccgaggcgggtggatcacctgaggtcaggggttcaagaccg

SEQ ID NO: 117532 - DNA, 2128 bp, Homo sapiens
acaactgcatatgtatttgtgtgtgtatataatgtagcatttttaattgaggttacagtctctgaaaggagatgccctttttggtgcaaaagtcatctttctaaagcttgaaatcagcgtatttgattagcactcatgacaaattcagatagtaaactagttcatgtcattgtcgccctggctccttactgtaatgctctgcttaattctgagttgaatgcatggcaccttttgtagtttccagagatctgcaggttacaagaatttgactatgacgaatgttggaaagccttgtgttgagtctcctgatctgagaggtggatttggtgttagtgcagagcctttaaaatagggactggcagaaaacctactaattactttttaaagccattgctgtttgaagcaaaaggaatagagtaaatctgctgcctaatactagtttcctagttaaatttaatgtgttttcagtcattttgtgtttacactgaggtttgctttttttttttttcttgtagccattttgcagaagtagcctggttaggatacacagtctttgcatgtttagagcagcaaaatcaatggttctgtaaaaatattacttgcttttgaggttttaaactttttttggtataagaggacagtctatatacatcaattctttttttttaaatatattttaattatactttaagttctagggtacatgtgcacaacgtgcaggtttgttacatatgtatacacatgtgccatgttggtgtgctgcacccattaactcgtcacttgcattaggtatatctcctaatggtatccctcctttctcctcccgccccacaacaggcccctgtgtgtgatgttccctttcctgtgtccaagtgttctcattgttcaattcccacctatgagtgagaacacgtggtgtttggttttttgtccttgcggtagtttgctgagaatgatggtttccagcttcatccatgtccctacaaaggacatgaactcatccttttttatggctgcatagtattccatggtgtatatgtgccacattttcttaggctagtctatcattgttggacatttgggttggttccaagtctttgctattgtgagtagtgccgcaataaacatacgtgtgcatgtgtctttatagcagcatgatttatattcctttgggtatatacccagtaatgggatggctgggtcaaatggtatttctagttctagatccctgaggaatcgccatactgtcttccacaatggttgaactagtttacagtcccaccaacagtgtaaaagtgttcctatgcatcaattcttgaagagataatattgaaagagggatgattctcaagccctttcaatttttagataatttggagaggtatttaataagtatatatacctggttaatatatttaagtcatatggttcattttagttcacaataacaaggaaatggagttagtctgtgtctcaaaatagatggtatagtgtctgtaggtgtttacgtggcctccttagtggccttaatgttcaactttttaaattaccacgctggatttccaggttacaagaggacccacctgtgggtgtcagtggcgcaccatctgaaaacaacatcatgcagtggaatgcagttatatttgggtgagttgaaaggtttaacaaataataggtgtgtgctgaatctttaagaaaagtaaacatataacaactgtctaggaaaagaaactgaggtggaatgagagatcttaaggactaaaactgcaagataaattagaaaaaaaaaatatttcaattagagttttggcccagcacagtagtagctcaacgcctgggaggatcgctggagcccaggagttcaccagcctgggcgatatagtgagacagtgagactctgtcccctccccaccaaaaaaagttttggcccagtctgggcaacatagtgagcccttgtctctacaaaaagtataaaactagctgagcatggtggtgcatacctgtggtcccagctacttggaaggctgaggcaggaggatcacttgagcccagaagtttgaggctgcagtgtgccatgattgtgccactgccctccaacatgggcagccagcagagccaagatcctgta

SEQ ID NO: 117533 - DNA, 2400 bp, Homo sapiens
tcatattgctgtaaaatgaaaagatgtcttttcctcttaagaatatacatatgggccaggtgcggtggctcacgcctctaaatcccagcactttgggaggctgcgatgagtggatcacctgaggtcaggagttcgaaaccagcctggccaatatggtgaaaccccgtttctactaaaaatacaaaaattagccaggcatctgtaatcccacctactcgggaggttgaggtaggagaatcacttgaatccaggagaaggaggttgcagtgagctgagatcatgccattgcactccagcctgggggacaagagcaaaactccgtctcaaaaaaaaaaaaaaaaaaaaaaaaaaatatatatatatatatacacatatgtacaaaatgactggtcagtattaatgaaagtttttttgtgctaaaattatgggcaagtttttttgtttggtttggtaaaaccaccctaaaaagaaagcttagaatgaaagttaatactttatgcctgggtctatgaaaatccagggctaaggtgttactaaactctatcttaaaactccacaaatcatcagaatgagtccctctttttctgttgaagtttatcctttccattcttgaaaatcaagaaaaagcagaatgagaaacttcttttaatcagaaatcttcttgttttcagaccagaagggacaccttttgaagatggtaagtcatactcattatgttttctatagtgttatgaggttactttttagtagaaaattgtaacaccaacatatctacttgaagccattttctatggttaataggccaagttaaaagtaaagctatggaaaatttatacttcataagggacttcttcccacagcagcttggtcacctccattggtaaccaatattaaaggttactttaatattttcctgtataactgtaagcctggatggcagtgtttatgttgagaatagtttaaatttaggtggccttaaagatatctctgaggtgaacaccagaagagtaaatcatgcttttttactttgttatctttgatattgacagggtgttgagctgaaatttttcataaacatacatagctgccagtagtttcaagtactactagcatttaacacccataagtagttatcattttgcataatctttggcatctcaagttgggtattttcatcaggggctaggaaaatgggaaactagttctaataccgaatttataattgaacttatcaaactgattttaaccaggaacttagacttttcccaattgtagtgttggattttaagaaattattaaacatctttgttatcattaacaaaatgacttcagaattaatccatcaaaaatatttatccgagaatactgactgcagcagtttgtaaggacgtaacctgaatgtccagtaggagaaatggttaagcaaattatgatgtatctggattctggaatatgtacctgttaaagaataaggtagatttggacatactgtcttaagaggacaaaaaaactgcacgataatgtttgtcgtagcatcacatttttagcaaatacatatatgcatgtgtgtctatgttaaagggttatatatcaaactgttaccagtgattatctgtggggggggtaaggagttgaaggaggtacttaaggacgttaccttttttctctacatcaagggttctcaagtgtgtgatccataaaccccttggggtcttggagaccctctcgggggacccatacgatcaaatctcatcatactaagactgttgacctttgcattgatggtacaaaaccaatggtggctataactacacctaagtagtttcgtatcttagaacaaatcaaggcattagacagtggcaccaaaccatactaatagtgattatattctttgcattttaaaagatgccagttggccaggggcagtagctcacacctgtatagccagcactttgggaggcttaggcaggtggatcatggatcacttgagcccaggagtttgagaccagcctgggggagcccttctctacaaaaaattagccaggcatggtggtacatgcctttagtcccagctacttgggaggattacctgagcccaagaggtcaaggctgcagtgagccctggtggagccactgagctccagcctgggtgacagagtgagaccttgtctttaaaaaagttaccaatttttcttaatttcttaatttaaagacatttttattagtattaggaagctctggacccttgagtatctatgtgggttttttttgtttgttttttgttttttgtctcgctctctcacccaggctggagtgcagaggcgcaatcttggctcactgaagcctccgcctccgaggttcaagtgattctcgtgcctcagccttccaagtagctgggat

SEQ ID NO: 117534 - DNA, 2555 bp, Homo sapiens
ctcatttttgtacttttagtagaggtggagtttgaccacgttggccaggctagtctcaactcctgacctcaggtgatccgcccaccttagcctcccaaagtgctggaattacaggcgtgagccaccccacctggctacagttatttttaatgaagattttctgagttaaagtttttttgtgtgtgtgagacggagtcttgctttgtcacccatgccagagcatagcggcatgatctgggctcactgcaacctccacctcctgggagggtcctttgccatgtggtagtcagaccctctcaaaatcctttaaccaactcccattctaagctataataaactatttgtagttcttcaaatatgcattttaaatcttggtagctagggcctagttgccttccaaaaatatgacagttaacactcccaccaatagcaacatgaatgtgcttgttccccaaccgcttgccaatgctgcgtgttaccattctaacataaatagagtatatttaggatgttttgtatgccgaaccaacgttgacatactaacttttatgtggttgtacaaaaaccagtatgcagttgagaactgatgaagagattaaaaagtcgtgcttgtctttactataattattttgttttctctctaggtacttttaaactagtaatagaattttctgaagaatatccaaataaaccaccaactgttaggtttttatccaaaatgtttcatccaaatggtaagtagcattttatagattttgcagatgatagtggggaaaagagttgtttccctccttttagctctttcaccttactttttactgttagggctcacttgtaggtgttgcttccatgtccatgtgagccacgtattttgttgtggatttttttttttttttttttttttttttttgagacggagtctcgctctgtcgcccaggctggagtgcagtggcgcgatctcggctcactgcaagctccgcctcccgggttcacgccattctcctgcctcagccttgtgagtagctgggactacaggcgtccaccaccacgcctggctaattttttatatttttagtagagacggggtttcaccatgttagccaggatggtctcgatctcctgaccttgtgatctgcccaccttggcctcccaaagtgctgggtttgttgtggatttttggtttgtttcttatttcttcagagacaaagttatactctgtcacccctgctggagtgcagtggtacagtcacagttcactgttacctcaaactcctgggttcaagtaatcctcctgcctcagactcctaactagctgggacgacaggtgtggaccaccatgcccagctaatttttttgtttgttttctttttcttttttgtagacacaaagtctctgtgtgttgcccaggctggtccttgaactcctagcctcaagcagtcctcccactttgacctcccaaagcactgtgattacaggaatgggccattttttccagcctttagctatgtttctgtagctagactcttacaaagcttccaaatttgaggtcaagttgttttaataactcctgaattaaaagtaatacatggtcgggcatggtggctcatacctataaactcagcactttgggaggccaaggtgggcggatcacctgaggtcaggagtttgagaccagcccggccaacatggtgaaaccccatcactactaaaaatacaaaaattagtcaggcatgatggtgggcacctgtaatctcagctactcaggaggctgagacaggagaatcacttgaacctgggagacggaggttgcagtgagctgagctcacaacactgcacttcagcctgggtgacaaaccaagactctgtctccaaaaaaacaaaggtaatatgtaagccaggcacagtggtgcacacctgtagtcccagctactccagaggctaaggcaggagggtggcttgaggccagcctaggtaacatagtaagatcctgtctctactaaaagaaatagataaaagtattatctatttatttgtggaattgtgaaaaataagaaaaatctgttggctaaaattaagcttttcaaaaatacaattttggccaggcgtggtggttcatacctataatcccagcaccttgggaggccaaggtgggaaggttgcttgagaccaggagtcagagaccagcctgggcaacatagcgaggtcccatccctataaaaaacaaaaaaaatatcaaggcatggtggcgcacacctgtagtctcagctacttatggaggctgaggtgagaggatcacttgagcccaggaggtcaaggctgcagtgagccatgactgtgccactgcactctagcctgggcaacagagcaagattctatctcaaaagtacaattttgcatatacaaagttggagtcaatgaccacacacagtggttcatgcctattaattccagcactttggaaggctgaggagggtggattgcttgagcccaggagttcaagaccagcttaggcaacatggtgaaaccctgtctctacaaaaaatacaaaaattagc

SEQ ID NO: 117535 - DNA, 1001 bp, Homo sapiens
atctggagtacactcctgccctgagcactcatgacctaagcacttcttaaaggtcccacttctcaacagtgttacaatggcaattaatttttttttatttaatttttttacttttatttttttgagacaggttcttaccctgtcatccaggctggagtgcagtggtgtgatctcagctcactgcaacccctgcctcctgggttcaagcgattctcctgcctcagccttccaagtagctgggattacaggcatgtgccaccatgcccggctaatttttataattttagtagagatggggtttcactgtgttggcccgactggtctcagactcctgacctcaagcaatcctgcctgcctcggcctcccaaagtgttcaggactggcgtgagccaccgtgcccagcctccagcaattacatttcaacatgagatttggagggaacattcaaaccatagcaggtgcaaaataagagaccttagttttaagacaggttatcctgtgatacagaagaatttagttattacctaatatttaaaacttctaagccaagcattctgtttggtaaagatttctcttaactgttagatatggcagagtgtgtaactaattttagtattgtctttgcagtgtatgctgatggtagcatatgtttagatatccttcagaatcgatggagtccaacatatgatgtatcttctatcttaacatcaattcaggtaagtgtgtgttaggatgtattataatttgtcagtattctgtaggatatagtcagctccttagcacacaggtaaccaatggcagagcttggacaagaatccatgcttttcagctaacttttctctttcagtagtgcctacttgggatccagtctgcagtccctttcctgattgtgtaagttacatgttctcacaggtcaaacctaatttgtgtccatgaagcatagccaagggttgtggaaaagaaaaaatggcttggaaaaaccataggaacctaaagaaact

SEQ ID NO: 117536 - DNA, 1501 bp, Homo sapiens
ccacacccggctaattttgtatttttagaaattacggggttttctccatgttggtcaggctggtctcgaactccctacctcaggtgatctgcccgcctcggcctcccacagtgctgggattacaggcgtgagccaccacacccgacctctttttcttttttaatagaaacagggtctccctatgttgcccaggctgggcttgaactgctgggctcaagggatcctcctgccttggcctcccaaagtgttaggattacaggcacaagccactgtacccagctgaaattataggtcttaaggcaattgagaactttatttcagaagcttaagttccttagcagcaggaaaccccatagtatttatcaaatcatttctaaaagtatttagacccaaaattatatgacatgttaatctctgaagtaatttgttgttttgtataacttttctgtaatatattccatatctgacccctgttggtataaagaacaactatgcaaatctgttttttcttttctttcctcctagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaatt

SEQ ID NO: 117537 - DNA, 1034 bp, Homo sapiens
tctaaatcttgaaacatctgctgtactggtatttctgaagtccacttctgtatctacaagcaagaagtgttcacagggccaggcacggtgtctcacgccagtaatcctagcactttgggaggaggatcacttgaggtcaggagttggagaccagcctggccaacatggtgaaaccctgtctctactaaaaataaaaaattagccaggcgtggtggcacacgcctgtaatcccagctactcgggaggctgaggcaggagaattgcttgaacctgggaggtggaggttgcagtgagccgagatcacaccactgcactccaacctgggggacagagcaagactccatctcaaaaccttgtggggaacatgtataggtttgccctgcagtatcaggtcagttctctgagagctgattttatagttgagcaacctgcagtttcttattaatccacagtgacaattgttccaaggtttttaccttactactttttattgtgcagttacaataaagaccttttagacaaggtgatggaaatggccgatgggattgaagtggaagacctgccacaatttactaccagaagtgaattaatgaaaaaggtaaataggatttccaagtgcatgtgatgaaatggtgtagagttaacagtccctgccttgatgacactatattagagtatattgtttttgaatgctctttactgccccaaagacctataccctttcatttttatttccccataattggtataagccttttcataaatagttgacaactcactgtggtaaattatgcattgttgatgaggtaacacataagcttaacctcttccggttgtttaggaacattgttttgagatttttgcttgatgtttaaaaagatgttggctagaatacttaagtttcctacttgttaaaaaatctcattggtaagactcatccttaccccaggtgtgagtgccggtgtgagtgccgacctgacttgtttggcttctgtgatttgctgataagaacgtgcctggagcaatgtcgatgg

SEQ ID NO: 117538 - DNA, 2377 bp, Homo sapiens
gccctggacactgacccccacatccttgaggttgggaggcagggtgttctggctctaacctagtgttcctcttaacaggaaggcagttgtcttatgctcatgacacaggtaagaggcttctagtccaaattcttcatggcacatgcagcaggctttttgggacctcacagttctccctttaggttctctgatggggagaacaggtcagagttggggagcaggatacccctggcttgccctgtcctccagataggacccttaccatgtggctcaaaagcttacaattgtaggtctgctcaaagctcctttcagacagcccataggaatctagaatacccataccctggaacttgtaggcctgtacacttcagcccactggagatggggtacaccttctggagtcagacagcctaggtttgaatcctggctgtgcagttaccaactgtcataatggctctatacctcagttccttctgttacaaggagcactttctgcaaatgggattaataacagtacctatctcatagtggatgtatagaataagtgattacctaaaaaagactaagcccaaagcaggcatgtgataagcacgtgattagtattagtcatccttattatacctggggagggtccccgatgcagcttggacctttgatctctcacctttaggctaggccagagagccagctcgcttctctgcagaagggatcagaaggatcctgcaggtgccaataggcagccgatatgggagcgagtagacggagctctgccctctctggggcaaagagtagggtgagaaggttctgaagaacaaagtagacagagccttttcattctcccaccatccccttggtacgtccccagaactggtctggagggtgggtgtggcagcgtcttcaaggggagctgagtcccctctgggacacttgaagttgcagacaggcaatggctggtgttgcaggagggttcaggctcctctagacttggagaagcaggtccaggaagccgactggaggatcccaggcagcagccctctactctgtatacaaaatcatttttgtaactgcaattactgtccctgagaaggcattaaagttaatgagagataggaaagagtggggctgtgaccccggtttaaagcggtttaagagtgtgcagctcttgttttctgaatgtctggccttcccaacacaaggaggctctgaggacaggttttccagccgaaatatcattaaattgtattagcatcttattacacacacgccttagcggtctgcctcagacagggagagtttttgtttctctttgaaagattgtgtctggaatggtaaattgcctgcttgaaagcccttttttcccctttttttaaagaagaggacgaaatcctgctgtgtggtggcaggcaggccaggcctagtggcccctggagaggagaggctggaggccaggttggggtgttttaactgcccagggagtggctgcagtggcaggcctgaaaggcccactgttcccagggtcagctggaagggcgttaatggaggcccagggtgtttatttgagtttatttgcagagaggtctttaaagggggctggcattgggcattggtgttttaagtccagacctgaggccctcactaaggccaaccactagtgctgccaagaaaacatctgccaccaaattgctgccctattactgagttgacattgatcattagccaggagcccaaccaaataaagcctcctggaaaatgtgtgaggttaagacggggaaggcaggctgtgaaaacaagggcgaaatcttgggccagggtgtttgttcctgcaagccacaggcaggccagctggactgtgtggtcccgacacttcttgggggagggagcgagagcacactcagcactccctagtatgtcactggggttctggctggagtctaaatggaatgctccttactcttcatggaatatacattcccaaggagaacgacatgcaacaagtagctcaacaagcacagctgggatgggtattccgtggacactgggtggtgaatttcttcagatagtgtgatgagcatagactgacatgggccacactgaagcttaaacctgaaggttgaaaagtcagacatgcatagaccacatagaagaatattccaaacagagtggagtacagcgtgtgcacagggctcgaagtatggaatatttggcttgttcaaaggaatgaaaggagcccagcatggctagaaggtggtgaggaaggggatagtggtcagtatgaagctgtccaggtggcaggggccagattgtgtagggtcttgtggtcaggagcttaggctttgtcttttgatctatgaagcctttgaaagattttcttaggggc

SEQ ID NO: 117539 - DNA, 1074 bp, Homo sapiens
ggagacacctccccacctcaagtcctgggctctagaagggccaatgaagtcctccccgcccagaacccttgaactgttgcccagcacaagcttttcctcccacagtaggctggagagcagcctgagaggttttcctagtcctctaagtgacaaggttgagccgtggccggcataaattccaacttatcttggggcagagaggaaaccatcaatgaacgcttccaagttatttggctcatgagagggcagagatgaaagcgaggatttggcggcagagaatgtttgcactaaatctcacggactgctctcttctctttctgtgaatggcttgggcggggcctttatggtctgctgagcctgggccttggataccctggtgaaaggggttctgggagccccatctactcaatcccctggagtatgaagcctatggggtggctgtcaggctggtcatgtggtttgcttagtgtggcaggagtccccagtgggaacacttacggagtgatgtgtgtgctgtggaaagcccctccttggtggctgcagagccatggaactcgtggttcacttgtctcctcatctctaaatgtgggcaatgatggggtgggggacacagtgaatccaacagctatgaaagggctggggttgggtttgggtgggataggcagggatgccctttgatgacctctcaggggctgccctttcccagtgcaccctaagggcgcaagccaaggggcactctacagcaagtgaggtgcctcagggctgaagaaagcacttgaccaggagtcaggaccctggacagggctaaggcctggaggcccagcttcccatctggcccttgcccaatggctggcccttccctcagccagagtgaagggggagtgagtgcgggcctccgagctgagagctgaaggcatgggccctgggattcttgggaggctgggctaggatttttggtggaagtgcgcaaagcctgaagtctgccctgggagctccttaaggcagtagaaggaaaaggtggagctgcccctgagaactcagcctgctgtcttctgctgcctatggcatcccaac

SEQ ID NO: 117540 - DNA, 1039 bp, Homo sapiens
gttactgctgaatctgtctgtcatgagccttcagaaggctgagtgaactgacttagcaccgggcacagcggtggatgctgacttttccagggaggaatgtggggttggagtttggtctcaggcctggagtactccttgaagtggtttctcttgtctcagtgatgtgagttcttctttaacttgtgattctcaaatgacggtgatcactgggaaagttggtacctgagcaagtcacatggtgtctagaggtgccaccacattccacaatagcgctttgtggggggatcacgcagtgggatcaggtgactggggcaggaggcgttgccagtgccagcccaggcagagtttagagcttgttctgaggtggaactgggggtggaggtgggagcagcagacaaaactctggcaagagcaatttgccccaagtgagcaagtgctcagggtgtgaccactcatggctttgctctgaggggtttggatgtgcttgattaagaacaaagacaaccctctccttcctgccttcctacccccccttccccaacacacacaaagccggtcgagttaggagagtgtccttgttcttgagggaccttggaagtcccagctcatgtgaagccactatctaggctgccctaagccccggccgtcccccagctgtttgcataaggtttgcataaggcctttcctggggttggcgccctgtgctgttttatacctccacttgtgtctgggggtgcagatagataacatgattgtgaacctcagtggaaatgtcttgaacagtcacgtaatggcagtattttttattttattttattttatttattttgttttgatcttttgagacagggactcactgtcactcaggctggagtgcagtggtgcaatcatggctcactgcagggttaacctcctgggctcaagcaatccttccacctcaacctccagagtagctgggaccccaggcatgtgcgaccacacccagctactttttaaattttttgtaaaaatgaggtttcaccatgttgcccagacttgt

SEQ ID NO: 117541 - DNA, 1051 bp, Homo sapiens
acagtgctgggattacaggtgtgagccaccttgcctggcccttttttttttttttaattttttaatttttagtagaggctggatcttcctgtgttgcccaggctgtcttgaactcctggcctcaagcagttatcccacctcagcctcccaaagtgttgggattacaggcatgagccaccatgcccggccatcagtattgctttcacattagcctctctgtcctctgaggttttcctctttttattttgatttttgcctttctctgccagtctttctttctctcataggtccactcccaactatccctcaaactctgtcctttaataggtcagagcagtgtgaattcagttaatcacatttatggaacgtctactatgtgcaaaacatgtgcagagttcagagctatgttatttattgtgctgattgcttttatttcgtcttatttctaagtgcgcaggcagaatgtccacttgagttgcatgtatctgcctcttcctctggcctgtggggcagactgccctgaggcagtctgaagtcactctttcccctcttgcccctcacaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggtgagccaggcagcccaggctagggggccattgggacaggggaggaaggggaggctgctttccaggttaggtgacctgccagtcctggaattcctttctagtccatctctattctgtattccattcccttttccaacaaaccattgaaatgttccagaaatactggtggtttaactgagaggctagggggttgggctcgggcttggctatagagccagaatgcttgcgttcctgttgacactcatattcagtgtggccttagaccagaaatgtaatctctctgggcctcagtttccttatctatgaaattggaatgctaacaataactaa

SEQ ID NO: 117542 - DNA, 1096 bp, Homo sapiens
gtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtc

SEQ ID NO: 117543 - DNA, 1088 bp, Homo sapiens
gttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactc

SEQ ID NO: 117544 - DNA, 1010 bp, Homo sapiens
aatgcctgagttcctactttgttccagagactgtgcgtattacttgatttaattctcaatttcatagggtggatgctactgttcctaattctctctagagcttcagtcaggctaacttgcccaaagtcacatctcaaaagcagtagagccagaagtgaaaccacatctgttcacttctaaggtgctggctctatacgttctatgtcactcctttaaaggatgagcagagtaaacatttacaggaagagccttaggaagacagaagaatttagcttatggtttcattgaggtcactttaaaatgtggggaaagtttgacaaagaacgttggtatgacatgatatggtagaaaatgagtcctttattgttttatcatatcaaaataagctctttggatggtttcatatcaactcttgttttgtattgttttgtttttttcagtcactaatgacagatgaaaccattgctaatgtgcctatactgattcttgggaataagatcgacagacctgaagccatcagtgaagagaggttgcgagagatgtttggtttatatggtcagacaacaggaaaggtaaaaaaaaaaaaaaaattatgatgggtgtgtttaattctacagtacaaatgtcttcttaaattactattgtccaactatacaagcccattatcattttcttaaagaaaactgtcatttatacctgtgggtctttttaatgtcctcatttctttctaccatggaatgaaacattttcttggtgacaacaaaaatgtcaaggatgagttatgcctaaggcttgtgcttataggaaactaaattaaagctttcaaagttatttatcatacattttcagaattagccaccaaacgatatatttgagtgtttaagtataccagtagtgtgtttaggccctgagtttaccagagataaataagacataaacttggaatattttacggttttctgaacatatactttataataagctttaagacggattgttttggtattcac

SEQ ID NO: 117545 - DNA, 1070 bp, Homo sapiens
aacaaaaacaaaacaaaacaaaacaaaaaaaccttcagtggctaactcattacttacaaaataaaggccaaactcattaacctggcattcaggatctctatgatctggtcccagtttacttttctgggcttttaaaaattatcttatagagacagggtctcactcactatgttgcccaggcttgtctccaactcctgggctcaagcaatcctctcatctcagtctcccaaaagttgggattataggtgtgagccaccacatctggcctacttttcttttatttccctctattccccttcccgttctttttgcttcaaccaaatcagaccttcttggtgttttcctctgtgcttttgttcatgccatccccatccgcacatgagtaacccctttaggccccagcgtatgccctgctacctcccttgggaagccattctcagttggagtgctctcagctatacttcatagcacttagtatatttgtgtacatgtctacaacaagtttggaaagactgccttatctcttatattaaacttgcggggactaaaatcctgttttttgttttgttttaattaaaaaaaattttttttgtagagatggggtctcacaatcttgcccaggctgattttgaagtcctggcctcaagcaatcctcctacctcaatttcccaaagtgctgggattacaggtgtgagccaccacacctggcctgttcattttttatatccccaaaagtacttggcaacatctacctcatagtaagtcataactaaccaatattaccgaattggtgggcattctaaaaacctgatgcgacatatagttgaaaagattgtaaatggttctggctagtgaaagcacatttgagacatgtaattgtctggcatatacacaaaataatttctggaatacgatgattagaattggaatctaatggaatttgtctgagacttcatttctatgttgtttcaagatatgtcataatggctgggtgtggggtctcaggcctataatcccagtgctttgagaggctgaggttgggaggatcacttgaagccaggagttcaaga

SEQ ID NO: 117546 - DNA, 1034 bp, Homo sapiens
tactgctgtgtccggtttccattggctggaatgggacctcacattctgtatttgtcctgattggctagcaacttagaactttttaaaagaggcaaaggcagaggagaacaaaggaaggaggaagtaacttgtggaatgctgagaaaggtaaaaacaccttcaaataaggaagaggaacaggctatgacctaatgcttgcttggaccagtgtaagtatgccagggcaaatatttaggctaaattgtgggagctaagaacataaagtacattgatttctttattacggctggcagatatttaagaatgttagcacgggtctttgaatcaattttgcttctaagagaagttactatttattcttaattagatggggaggaaagtctttgaaaaggaacctctactttactttttacacgattaatgggtttctaattttcatgtaaaaatattttaaaatcttatttagcttccgaagaactgaccattgctggcatgacgtttacaacttttgatctgggtggacatgttcaaggtaagattcttttttttttttttttttttttttttttttttttttttttagacaggctcactctgtctcccaggctggagtgcagtggtgcaatctcagctcactgcaacctctgcctcctgggttcaagcaatcctcatgcctcagcctccccaatagctgggattacaggcatgtgccaccgcgcccagctgatttttgtattcttagtagagatgggatttcgccacgttcaaggtaagattctcttactcttacagtcactttgttttattttaacttaacaaaaatgtggccattagttctagtgcatgaaatctcattctagtcacgcaaggccagagtagatttaaaatttagggattattactccccgataaatactttaaaagcaaagggtgattttcatgatacttctggccaattcaaatgagaattgcttttggtggtaaagtgtatgagtaaaattaacttccattctctctacttcaatctacctctc

SEQ ID NO: 117547 - DNA, 1051 bp, Homo sapiens
ctaaaactttgacattgttagctgaaagaaccaaattcgtcagcaatttaaggtgtttggtacagtggacaaaatgaggtgaagaagtccttttaacttgaaaaattaaacatagtattatttatttgtgtgttcttacatcagcctctatattactaagtgtctttgaagacgtcctatattccgtgttaaagtatcagtgaagagtaggtcacattgaaacaatgaaagaaggaaagaaaaggaacatttattgactactatgagtaaggcactagctgtcattttacagatgacaaataaatggtggtgccagtatagcaaagcaacatgattatctactattatacctttcagtagacttgtgtctgtcaccaaaatgttttgaacttaaaaaatgttaagatagttcattggcattttctgagtttgtagaaaaggaaggtgtcttcattttagaaatgtcagagatgcactgtcagtaattacaaagattagcagtttaaataaggtatattttaaccttcctttgacttgcattattgtactggaatagaaattcaagcaagaattaagaaaaaagatgagtctaacagaaatgaaaatcagcctgggcaacatagcaagacccagtctctacattaaaaaaaaaaaaatttgctgggtgcagggccctggctagcaggccagtagtcccagctactcgctgctgagatggggggtttgcttgaagccaggtcaagactacagtgacctgtgatcatgccactgcactccagcctgggtgaaagaaaaagacattgttgctaaaaaaaaaaaaaaaaaaaaaaaaaaaagaaaaaaaaagaaatagaaaaggaaatgaaaatcattgccacatcatttgaagcttacaagttggaatgctatattagtatttcttttcttttttctttttttttttttttgagacggagtctcgctctatcgcccaggctggagtgcagtggctccaggctgactgcaacctccacctccagggttcaagtgattctcctgcctcagcctctca

SEQ ID NO: 117548 - DNA, 1032 bp, Homo sapiens
cttaaagtattgctatattcgttggtaagactaatttttcctccttttattggaaggtcctgtccaaaatgcattgctgtcttcacaagagtcagtgagccaaggatacaatttccagcttccaggatcctaccctcatccaataccagcaaagactttgaatccagtctctggacagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtagtattcttatagaagtgcttaaaatgtagaaatgtgaaacttttgcttatttagatgtttgaaataatacttgaaacctgaaaaccatatggaaaatgtgacttttaaaattattagtagttttttgttgttttttgtttttcggctttccagcaaaaaccagaaagcctgctagacaaattaagtaagctataacactcattagtagttttttttttcattcttttttctcttttttttttttttttttgagatggggtcttgctctgtcacccaggctggaaagcagtggcacaatctcagctcactgcaacctctgcctccctggttcaagcaattttcctgcctcagcctccagagtagctgggattatgggattacaggcacgtgccactgcacccagctaactttttgtatttttagtagagatggggtttcaccatattggccaggctggtcttgaactcccgacctcaggtaatccgcccacctcagcctcccaaag

SEQ ID NO: 117549 - DNA, 1020 bp, Homo sapiens
acttgtctatactgccatagatatgtgtgaccacttctttgataagggagttacatggcaataatctttgtcttcacttttgtcaacaaggcactgatagtcttgttagcagttgtaagattcagtaataggcaatttttctttttcttttttttttttttttttttttttgagacggagccttactctgtcgcccaggctagagtgcagtggcgcaatctcggctcactgcaacctccgcctcccaggttcaagcagttcttctgcctcagcctccctagtagctgggattacaggcatgcgccaccacgcccagctaattttttgtatttttagtagaaacggggtttcaccatataggccaggctggtcccaaactcctgaccttgtgatccacctgtctcagcctcccaaagtgctgggattacaggcgtgagccactgcacccagcctaataggcaatttttcaacttgatactggagtatttaacagtattggtgaaacattttgaaaaatttcaggctgagcgtggtggctcacgactgtaattccagcactttgagaggccgaggcgggtggattacgaggtcaggagtttgagatcagcctccagcctggccaatatggtgaaaccccatctctactaaaaatacaaaaattagccgggcgtggtggcgcgcacttgtggacccagctgctgccggaggctgaggcaggagaatcgcttgaacccaggaggcggaggttgcagtgagccgagattgcgccattgcactccagcctgggggacaagagtgagacttcgtctcagaaaaaaaaaaaaaaagtgttccttctgcctcggtctcccaaagtcctggtattatagacatgaaccactgctcctggccccctatttttatttttatttatttatttatttattttgagacagagtctcgctcttgttgcccaggctggagtgcagtgacgagatctcagctcattgcaacctctgcctcgcaggttcaagtgattct

SEQ ID NO: 117550 - DNA, 1103 bp, Homo sapiens
tccagctacttgggaggctgacacaggaggatcacttgaacctaggaggttaaggctgcagtgaggtgtgattgcaccactgcactgcagcctgggcaatagtgagaccctttctccaaaaaaaatgtttttttaaaataaataaatcaagtattctggagtataaaatagaacttaaaagttaccttgtttctagcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcaggtaaactttttgggattttctttaacctatttctccatttggtttaaactgtatacacatgaagaaagttttaggaaggtatattatacatttttataaccatttagaataataatggatatttcataaagcctttgtctttatacatttttccagaaccaaaagattggccaagagatctagattacacttttgttatttacagagaaattaaccacttccctacacacttaataaaagttacttactttaaaattatgtatctgtagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagtaaggcttcagatgtgacattatgcatgtccgaaaagttttctagctttttgcagggggcacatcaggtgttatgaataagctgtacaaattattaatttatgaaagttctggatacagatgatagaactcttttacttgtttacttaatagagatttgaaaagtcctacgtcaagaaatagggatgtaactcctgaagtgattttgttcttatcagctctaatgagattatgatattcattatcattatggtggttactttctttcttcaaaatccaaagtacagggatttgtttctacata

SEQ ID NO: 117551 - DNA, 1050 bp, Homo sapiens
gctctcatttaaaattaatttcataacaaacataatacctttttttcctaaaaacttaccataagcttaaatgtatatgatcaataatttctgataaattaaatttggtacctttaaattgtatttagaatcttcagcaaaactgaacttttaaataatagactttgcaatttgggccatcacctaagtttaatttaattccagtgtcaactagacttacaaaacaaaaaataagtcatttgatagtttagactgttttacacacaagccaaaaagagactatattttagttataggataaccatccactctatttctgcataggacttagatttaaatatttaaatgggataaaattttgagactctattgaaatatttcatctgtaatctgatccagtattaaaatgtataccttttaaatctttgttgttgttttcttcaaaaataatcatagcagcaactgatacatactttttactttgatataggttatttcgatgcacgctgactagcattcctcagacgcaggccttattgaataaagccaaacttcctttggggctgctgcttcatcctttcaaagacttagtggtatgtttcttttcttttctttttttttttttgagacggagtctccctctgtcgcccaggctggagtgcagtgacgcagtctcagcttattgcaacctctgccctccatgttcaagtgattttcctgcctcagcctccctagtagctgggattacaggtgcctgccaccgtgcctggctaatttttgtatttttagtagagagggggtttcaccatcttggccaggctggtcttgaactcctgacctcgtgatccacctgccttggcctcccaaagtgctggaattacaggcgtgagcctctgcgcccggctctttttttttttttttttttttttctgagactgggtctcactgtcgcccaggctggagtgtagtggcgagatctcggctcaccgcaatctccgcctcccaggttcgggcaattctcttgcctcagcttcctaagtagctggcatt

SEQ ID NO: 117552 - DNA, 1025 bp, Homo sapiens
tcaagtgatgctcccacttcaacccagctcaccacactgggctaattttttaaatcttttgagagggtcatgtttcactatgttgcccaggccggtctcaaactcctggcctcaagcaatccttccgccttggctcccaaagtgctggagttacacatgtgagccactgtccccagccaataatttttttttttaagacaacttttaatgagaatggtcttggagcaaaatagtagggtttaaaattaatacatttcaactacatggtttttgtgtatggcagtttagatacatcttgtactctaagttttctctaaaatgataatatcccaacagttatttagacaggatggattcatgcttatgttttcaacatgatgatttttgcctttaaaaatttaattctgtttttttttttccagcaattgcctgtggttacctccagtacaattgtgagatgccgttcatgcaggacgtacatcaatcctttcgtcagctttcttgatcaaaggagatggaagtgtaacttatgttatcgagtcaatgatggtatgggatgcttttttgaaacatttaaacgtttctacttgcattgtagggaaatcagatgatacaaatgcacagttaaaaaaaaaaaacccttttatttacctctagtcaatccttccactcagagaaaactacaggtaacttttttctgtgcgtttatatttataaataaatttaattatttattttttaagcaaaaaataatgatagtattacatggatatcccatttttacattgtattgggtatataataagtggtatatttcatggtattacttaagccaggaatttaagaaacatttttatttagaaattgtcccacgccttttctctagggtgaaagaaaataagtccacagaatagctgcccaattcattcactgctgaatgaagggaagtaggcagtgctagaaggttagttgaatgtagttttctcagtaattgaggaggaggagatttctctcaataactatgt

SEQ ID NO: 117553 - DNA, 1011 bp, Homo sapiens
cgggcacctataatcccagctactcgggaggctgaggcaggagaatcgcttgaacccaggaagcaaaggtttcagtgagccgaaatcgagtcattgcactccagcctgggcgacagagcgagactctgtctcaaaaacaaacaaaacagagccaggtgcagtggctcatgcctgtaatcccaacactttgggaggctgaggtgggtggatcacctaaggtcaggagtttgagaccagcctggccaatgtagtgaaaccccatctttactaaaaatataaaaaaattagctgggtgtggtggcgggcacctgtaatcccagctactcgggaggctgaggcaggagaatcgcttgaacccgggaggcggaggttgcagtgaaccgagattgcaccattgcactccagccttggcaacaagagcaaaactccatctcaaacaaacaaataaaacaaaacaaaaaaacagttttattgtttgtgtgtgtgtgtgtgtgtgtgtgtgtgtgtgtgtgttttgagtatagaaaagtaaggataggctaagaactttctcttgcactgtaacaattctgaaaatgtacatgaagtatttagttacctttaaaatttttatgtgtaggtgctttaatatacaaaatgaaattataataaaagttgaagcccctttcatctgcaaaccaggctatttcctgaactatagcttaacctttagagtgcatagggatttgaatttctaaacaattagtaggaagacagatacaatgataattaatttagaaaatactctttgaccactagtgtattataagtggtaggtatgatgttaggttaagtgatgttccataaagttctcattaattaatgaaacttactaaaccttatgaccttgacctctgaaattgtcttaccatagcttctagtgccagctagtgtctgtacatttcatatgtgaaatgttaatatccttgtataattgggaagtttaagaaaataggccgggtgtggtggctc

SEQ ID NO: 117554 - DNA, 1017 bp, Homo sapiens
aactcgctttggaacttacaagaataaagtatgtagaggtgatggagaaggccatatttcatggcattaaaatacatcaaatctctaaactgtgatggttcttttggatacattttggacttatagtcttgctggactactgcatgtgcaagaactgtaaggcccaactttgatttgtcttgcttgccaatttataatgttgacttaaaatggctttcttgtcatttgaccaacttcattgtttagtgtctgtagattctctgaccatcatcatgactcaatgtcttgtctattgtatgagatactgacttaatgtgaaataaaattttaattatgacacttgagttttcttgctttgttttacaagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggttagagagtcatgaaatgtctgataaggtttatgctggtgttccatccctgtgaccatagaacttgttttttctttaaatttatttgtcaattgttgggaggagggactataaggaagttaacttttatgtagacatttttattttgttacatttttctctacctgattcacccttccttaatttttagtatctttagcaggccactagcaattcagcctgccttcagagagatagtctgggagactaacagaatatgcttgatagggacaaagagaacctgattgaccagttaagaatagtcttatttggctgggcgtggtagctcacacctgtaatcccaacatcttgggaggccgagttgggcagttcatctgaggttgggagtttgagaccagcctgaccaacatggagaaaccccatctctactaaaaatacaaaat

SEQ ID NO: 117555 - DNA, 1827 bp, Homo sapiens
gtagctgggactacaggcacctgcaaccatgcctggctaattttttgtatttttagtagagacggggtttcaccatgttagccaggatggtctcgatctccggccctcgtgatccacccacctcggcctcccaaagtgctgggattacaggcgtgagccaccgcacccggccatttttttttttttttaaataaataaagtcatgttgcccaggatggtctcaaactcctgggctcaagcagtccacccgccttggcttcccaaagtgctaggattacaggtgtgagccaccacacctggctggaacttacagaaaattcctaagcagtacttgcttcttaatgaaaaatcaagtagtaccacaaaggaaaaggactttgtagaatgcccagaaataattgcaattgttgttaacatcatgatgtatgtagatgtgtatttagattttatgacaatgtaatgattttttaaaatgtctctttataatttattataaataggatatacacatgacaccatccactgacttctataagaaattagccttggactgttctggtcagcaagttgctgttgacttattccttctcagtggacagtattctgatttggcttctctgggtaagttcttcgtaatgattttttttttccgttaaatgaatatcaaaatggtccttatatgatagtgttctaaatatagaacaaagttaaagaatatgtatgcccttgggaaagttaatcagtcagtttagtctattaaaaaccttatagtcttctactctaaacatttagtaatagagaaatttctattctactatttaaaggaatgcaggccgggtatgatggctcatgcctgtaatcctaacaatttgtgaggcctgtgcaggaggattgcttgagcccaggagtttgagaccaacctgggcaacataggaagaccctgtatttgcaaataatatgtatatttttttaaataaaaaactagccagacatggtggcgcacacctgtggtcccagctgcctggaaggctgaggtgggaagagtgcttgaggtggagaggtcaaggctgcagtgagccccatggtatcactactgcactccagcctgggtgacagaatgggactctgtctcaaaaaaagggaataaaatctcctttctgacagtagtttaccttggaaagttaaagaaagattgattccaatgtctttagttactttggtgtagtagaaatagttaacggcacagtttaaaacagtgtgtgttctcttccaggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtaggaatattttttttttgcgtaggactgaataatatttttggtttcagtaaatgtacatgtttttatctggtcttataagattgcccttctgagatactttgcctactctggaatatgcaattaagaggagagaagaaacactgtaaccaaaaaaagggggcctattgagaatatactcaaaagcactgacttatatatttttaaatagagaattttatggtgtgtgaattatctcagttttttaaaaaagaccttatctccggctgggcacagtggctcatgcctgtaattccagcactttgggaggccaaggctggtggatcgcttgagcccaggaattagagacgagcctggacaacattgcaaaatgatgtctctacgaaaaatacaaa

SEQ ID NO: 117556 - DNA, 1046 bp, Homo sapiens
aggtgggattacaggtgcgcgacaccacacccggctaattttttttttttttttttgtatttttagtagagagcaggtttcagcatgttggtcaggctggtcttgaactcctgacctcatgatccgcccgcctcggcctcccaaagtgctgggattacaggcgtgagccaccgcacccagccagttatgggtaaggttttaagtattccaattgatggaaaggagtaaaacaggcagagagaaaagaataatgaaattacgtattaaaacaagtacactgactatattaaaggaagataataaaagctcttaagattttaatggaagaaggaaagttccatctattcattcaaaaaatatttcctgattgtctattatatactaggaactgttctaactgctaggacaaaaaaatgaatgaaaaagataaaaatccttgtcctcatggagcttacatcctattaagggaagaataaaaataagcaaaatatgtggtatgtcagtgataaatgctataggaaaaatacaggaggtaagggtgattaggggtgtcaggatggtgagggatggggtgggattggggtactgcatattaaatcgggaagatcagagaatgtaggctttagaaaaaagtatttcaagaaaggcctgaagaagaaagaagagctcagatttttaaacgtcaaaatttaaatatttcggccgggcgcggtggctcacgcctataatcccagcactttgggaggccgaggcgggtggatcacaaggtcaggagatcgagaccatcctggctaacacggtgaaaccccgtctctactaaaaatacaaaaaattagccgggcattgtggtgggcgcctgtagtcccagctactcgggaggctgaggcaggagaatggcgtgaacccgggaggcggagcttgcagtgagccgagactgcgccactgcactccagcctaggcgacagagcgagactctgtctcaaaaaaaaaaaaaaaaaaaaaaatttaaatatttccaggcacggtggctcatggctgtaatccca

SEQ ID NO: 117557 - DNA, 1574 bp, Homo sapiens
tcaaaaaaaaaaattaaaagaagtttataaagttatagtaaactacgattaattattgaagaaagaaatttttttatatatctctagtgtagcctaaatgtacagtgtttgtaaagtttatagcagtgtccagtaatgtcctaggcctttacattcactcatcactcactgactcacccagagcaactttcagtcttgtgcactccattcgtggttaagtgccctatacaggtgtactgtttatcccttctgccatatttttactatacctttcctatgtttagatacacaaatacttagcattgttttacagttgcctacagtattcagtacagtaacatgctatagacgtttgtagcctaggtacagtaggctataccattaaggcttgtgtaaatccactctatgatgttcatacagagaaatcacttaacaacacgtttctcagcatgtatccacattgttcagtggattcatggcagtacatttgtctgccacctttcccctccatatcttccttgtttcatgccaagcataaaatgtctcatcaggtaaatactaattattattaattcagttaaaggctgtacaatctcactaaatatacttacctttttgaccttttaaaatatactcaagctgggtgtggtggctcacacctgtaatcccagcactttgggaggctgaggcaggcagatctcttgaggtcaggagttcaagactagcctggccaatatggtgaaaccccatctctactaaaaatacaaaaattagctgggcatggtggcacacgcctgtagtcccagctactctggaggctgaggtgggaaatcgcttgaacccaggagtcggaggttgcagtgagccgagattacaccactgcactccagcctgggtgacagagtgagaccctatctcacaaatatatatataaaataaaaataaaatgtactcactcaacagactcacctttatgtatgctgcatctcaaaataattttattcctgtccctaggtactgatgctttgggttggaaaaaattgtacacagaattttctcagccaagttctaggagttcaaaactatgcatcaattccacagcctatggtaagactcttttattatagtgattataaagggcatttcaaagttggcaaaaacatgaatatcccctattttgatatcagaaaataataacaaaatcataccaaaaatttttattgatgggttttcatgttgatggattctatgactccactcatagaatcattagggaatttatatatttaaaaggcagatatgccagccacagcggctcacactgtaatcccagcactttgggaggccagggcgggctgatcacgaggtcaagagatcgagaccatcctggccaacatggtgaacccccttctctactaaaaatacaaaaattagttgggcgtggtggcgcacacctgtagtcccagctactcaggagattgaggcaggagaatcgcttgaacccaggaggtggacattgcagtgagccaagattgtaccactgcactccagcctggcaacagagtgagactcca

SEQ ID NO: 117558 - DNA, 2975 bp, Homo sapiens
ttcagaaatggaatttctggatcaactatttctcttaattccaccataagcttttcccttaaacaacttgaaatttacataatcaaccaagtattctcagagaaagcctctagaagtaactgtttatatagtaaatgttattagggttatgaggaaatcaaaagccttctgacaagtctattttactgctacattttatctaaatttttttgccttttattcctaagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagataagaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgt

SEQ ID NO: 117559 - DNA, 1032 bp, Homo sapiens
aaaattccctgtatatctacatggctcctttatttcctccaagcctctgtaacaaatgtcatatttatattgtatataaacatactatatacagtgtttgtttcttcacttgtctgccgtcttttcctttaccggagtgtaagctgcctggagctcaaaggcaggagcttggtctgttttgttcactgtccttgcctctctttcaagacagattttccacctctacatgtgtctgtgctgaagcagaagggttcattttttccctcctaattttagaaaaattcataaaaagttctttgagtgttaaatttgtctgctgaaattatttttagaaaaaatgtaataaaatgtaatagaagctaatggtgtttgctgaacttaatctttgacttattgttctagccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgaggtaagacattaattaatttccaaaagacgagtgataaattgggccttctcggctatagcaggcttcttgaaaagtatgttttcaactggagtttggtggcccaattgcaggcccttttctttatcccctacttgtttgattagacccagaaggatgtgcctacaaagactctatcaaacagtgtttttttttttttttaatcttttttgagacagagcctcactctgttgctcagactggagtgcagtggtatcatctctgctcactgcaacctccacctcctgggttcaagcgattctcatgcctaagcctgccaagtagctgggatttcagatgtgcaccaccacacctgtctaatttttgtgtctttaaaagagacggtgttttgccatgttggccaggctgctctcgatctcctggcctcatgtgatcctcccacct

SEQ ID NO: 117560 - DNA, 1041 bp, Homo sapiens
tttatcatgttgatgtcgtttattttctaacttgtaatagaaaattgcttttcatagaggcaattttggaggcgtttaggggattaaaattgagaataactgggaaactttgcttgctaattactttagtttctgttgttaggaagaaataaagtttatgtgtgcataatgcttgtaagtaaaatgagattgatttatagtgtttgaaatctatcttttggctttcttatttgaagatgctttttttgtgatttcattttggtaatatatttgtgtgtatatttataaaggtatgtgatctaagtctaccctgaggggtttgtatatatgccttttttccccttctttatactttgaagaacttactggaatgtcacttggagcaaaattattaaatttggttttgctttttattttcccccatctctttctttcttttattcccccaagaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatggtatattttttagcctaatagcctgtataacacctcatgtagaatattatatgaataatatttcataaggggtttttaatcttttttattgttgaaaactatgcataatatgctgtttaccattttcatcattttcaggtttcaattcagtgataaatacatttgcagtgttgtgcagtcgttaccactgtctgtttccatgactttttcgtcattccatacagaaactctgcaccttttaaataactctatgacgccttttctcgctacttcttgtgacctttgctctattttctgtctctgaatttgtttagtctagctacctcacataagtggaatcataatacatatttgtctttttgtgtctggcttatttcacttagcataatgtcttcaaggtgcatgtatgttgtagcatgttggaa

SEQ ID NO: 117561 - DNA, 1063 bp, Homo sapiens
tccagagtagccaccatgcctggctaattttgtctttttcttttttcttttttgacagagtcttgctctgtcacccaggcggcactgcagtctccgcctcccaggttcaagctattctcttgcgcctcagcttttcaagtagtcaggattacaggcacctgccaccatgcctggataatttttgtatttttagtacaaaaatatgttggccaggccggtcttgaactcctgacctcaggtgatcctcccactttggcctcccatagtgctgggattacaggcgtgagccaccatgcccagctaattttgtcattttttgaagagccagggtctcgatatgttacccagctagtcttgagctcctggggtcaagagagcctgctgctttgacctttctcagtgttgggattacaggcaggagccactgtgcctggctgctgatatttcataatttaggatggaaacatttcccttcacatctgattttgactttcgagattttagtaaagtaggagattgtagaattttataggaaaatgggattttggtccattgtctgtgaaagttccaaagaatggtttaaatagattctatctataagtagtcatgatgtcttttttttttcgctctgttgcctacgcttgagtgcagtgccgtgatctcggctcactgcaacctccacctcccaggttcaagaaattctctgcctcagcctcctgagtagctgggattacaggtgtacaccaccacgcccagctaatttttttgtatttttagtagagacgaggtttcaccacactggccaggttggtgtcaaactcctaaccttgtgatccgcccgccttggcctatttttagtagagatggggtttcactatgttggccaggctagtctcaaacgcctgacctcgtgatccacctgcctcggcctcccaaagcagtgggattacaagtgtgagccattacgcccagccaagtagtcgtgatgtcttaattctagacaatctaatcttttttacataactgagatatgctatcttctgtgattgaaaggtaattgaaa

SEQ ID NO: 117562 - DNA, 1106 bp, Homo sapiens
ggcacctgtagtcccggttactcgtcaggctgaggcaagagaatggtgtgaacccaggaacctgggaggcggagcttgcagtgagctgagattgtgccactgtactccagcctgggtgacagagcgagactccgtctcaaaaaaaacatcatttagcagagaaagtttgtagttctgcatccagctgtatagctgtaaaatctattattggagatcaccttttttggcataattaatcttttgacccttttacaaccaatttatgttttattcatatttattttgtcattgttaatattcagaagtaatacatgcttcatgtaaaaatggaaaaacctcagaatatgagcatttgaactgatggatggctggagtaattggaaaaggggtgtttgggcagtggcagaaaaggttagagaggtggggtgtggtctgattgtgaaatactgcatttttaaacagatgtttaaagaatgtgtattctggtattttagatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaaggtatggaatttcttatttttaaagatttccgtttcctcttgggtaacttgagttctccattgcattgtcctactgattggcatgactttgtaaagctaacagttttctttctcctcatctgagagatggcagtactttttctgagtaccagagatactggtaaattttagctataagtgttctttcaaaagtcactcttttaacaccatcaacttagtttgatatctttgcttacatattaacctttttaataagttctctggagacttctctagcactcctgtctttgatactcttttttttttttttttttgatacagagtctctcttttgcctaggctggagtgcaatggtgtgatcttggcttactgcatcctccacctcccaggcctatgcagtctacctacctcagcctcccaagtagctggaactacatgtgtgcaccaccatgcctggctaa

SEQ ID NO: 117563 - DNA, 1042 bp, Homo sapiens
aaaaatttatacaaattaatgagaaaaacaggctattgtttgtcttttcatttaataactcagttggctcagtgccctggctcacacctgcaatcccagaactttggtaggctgaggctggtggatcactggagccaagtagttcaagaccagcctgggcaacatagcatgactctttctactaaaaaacaaaaaaaattaactgggtttggtgacatgtgcttgtagtcctagcaactcaggaggactgatgggacgaatccttgagcccagaaatttgaggttacagtgagctatgatcacaccactcaagcctgggtgactgagaccatgtcactaaaaaaagaaaaaaaactaaagatgaaattgtgtcagttactgtgtgcttcagcagtcatataacttgtgtttcagctttgcaaaatattctatatttgttctttattttagaagtctgggccaacggtcacaaaagttgtcactgttgtgacaaccaaaaaagcagttgtggattctgataagaagaaaggtgagctgatggagaatgaccaggatgccatggaggtgatttttcttaattttgactttgtttatgatactatcctggaagcatttattagaaagcattcatggagatgtgcgtttcatttgtgtgagctaggagaaattcccagaattgagagacattcttgctattcttagtagtataatagtatctagttaaatatctgtttagtggaacattctgatgtcttcattcctaactgtatgatctttctgcccctcatcagctcacttcaggcatacaatatggagagaaaaaaatggagtaacagaatgaattaattttctttccattaacacgtaaagatttatatagtaaaaacagtagcaaagccttattagagctgtctctgatgattactgttttagctttatattggcattttaaccttctaaaggcaaagaaaaaaaaactaagttgaaaaattcttcaggagctgcttgatacgtttctaattcaaggtgtcatacgtcattt

SEQ ID NO: 117564 - DNA, 1005 bp, Homo sapiens
aaatgattctcccatctcagcctcccagaatgctgggatttcagtcatgaaccactgcgccctgcctaatttttaaatttttcattatcccaaaaagaaacttttgtccattagtagtcagtcttctcccctctccccacccctgggcaaccattaatctattttttgtctctagaatagatttggctattcctaacatttcatgtaaatgggatcaaacaatatatagtctttactgcctgatctttttcactttacataatgttgtaaagattagtccatattgtagaatgtgttagtacttcattcctttttattgccaaatagtattttattgtatgatatataccaccttttggaagttcatttttatgggaacacataggacctgtctggggcccagcaatctcaattcttaccttttcttcctttggttttctttttaaggcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaataggtacaattcttttcattaaactatttttcaaataacagctttgttgtcaaacagaaagaccttatagtttataatgttcttaattatgacaatgaagttgtctttatgtacattttctttatcaatttggcactttggggctgatttccccttaccagcaggtggagtgagaatcttcagagctctggagtgacatctcagaagtacaaaaacagcctctcctggcacagctcagtttttaaactctgacttggcaggtagactcctcgtgcatctatctgtttatttatattgaggtttgttagcccagtatcagtggatatataaaagcgacatggaagatatcctagggaaacatattttcctaggtagtttttggcct

SEQ ID NO: 117565 - DNA, 1223 bp, Homo sapiens
tggaaagttgttcagcttctctcttaggaacacggggcatagtatatctctcctctgtctgtgcccctcagaccaaggttgtttctggaagcagcagtatggcttctgtggcacagtgagtcacttgattttctttgttctgtgatttgcattagaaaactgtttgcattcttttgaaccaagtattttcctgagggttggatgaggcatttaactgtcatttatcttcttttagcatgtttttaaaaatctgcttatatttatccttccccacaacctctgctgttatacaacttttgaaatagttttcagggatgcataacaaaacaaaaattaggtgaaacaatctgaactttattgtaaaggttaaattgaacactataaagcacagccttaagaattttggtggttaggctactgatgtatttatctttccagctgtcatcatgactccaactcgagaactggctttacagattactaaagagtgtaagaagttttccaagactttgggacttagagtggtctgtgtttacggaggaacaggaatcagtgagcaggtagttatataagaaacattcatgttttccattcttttctcaagttggatgattcaataaagtaaaagtgacttttacttttagttttttgaatagtgattgcttctaaaatcatttaaaaaatgaagtataaaaataatagtaagaattagttattttatgtaggatgaatacctttggagatgtaatgtacagcatggtgactagttaatgttatattgtgtgctgaaaattcgctaagccagtagatctcacatcatgttttttttttttcttttttgagatggagtctcgctctgtcacacaggctggagtacagtggcgcgatctcggctcactgcaacctctgcctccctggttcaagcgattctcctacctcagcctcccaagttgctgggactacaggtgcctgccaccacgcctggctaatttttgtatttttagtagagacggggtttcaccatattggccagattggtcttgaacacctgacctcaggtgatcctcctgcctcggcctcccaaagtgttgggattacaggtgtgagccaccgtgcctgaccaatcttacatgttcttaccacaaaagaaaatattggtaactatatgaggtgatatgttagcttgattgtgttcatcatttcagagtgtatatgtatatcaa

SEQ ID NO: 117566 - DNA, 1950 bp, Homo sapiens
agtttgtgaccagcctgggcaatgtagtgagaccccatctcttaaaacagtaaataaattagcgagtgcctgtagtcctagatactgggagggtgtgtggggtggtggggggaggggctgagatgggagggtcacttgagcccaggatctaggctgcaatgacctatgatgacactgctgcactgggcaacagagcctgggcaacagagtgagaccctgtctcaaaaaaaaaaaaaaaaaaagctgattatgactgttaaagtgatttcatgattcactaatgtggcaaccctcaatttgaaaaacactagtctatgtggtcacttagaaatttctttttctgaggcagggtcttgctcttgctcaggctggagtgcaaggatgtgatcatagctcactccaaccttgaactcctgggctcaagagattatcactttttttttttaaactgctttcttaagttcatttcttggttttgagggatagtggcaaatcaaatttgcagaattctctagttcttatttgtttcaaatttatggcactatgtggtcacgttgttgctatttctttagtagtgccccgagattcaaaataattaagcaggaagcttggaagtcttctaattagactaggcaagaactaaatgcagtattttttagtgtttaagtaagcattagtaatagactataaagtttcatcttttttattagattgctgagctgaaaagaggtgctgaaattattgtttgcacacctggtcgaatgattgacatgttagccgctaacagtggtaagtcaggggtatttttttggtgtcttttatttttgaattctttacttttttttgttaaaacagatgcaagaaaccaacaaagggtttctatatttcttcttaaagctgcagtatcttaaaatttgtagcctgtagtcccagctacttgggaggctgaggcaggagaatagcttgaacccgggaggcggagcttgcagtgagccaagatcgcaccactgtactccagcctgggtgacagagtaagactccgtctcaaaaaaaaaaaataataattgtaacaagttgattattacaagcattaatgatatttttgcaatttaaaattttttttcagaagtaactccatctgatcataacttggattcttaatccagttttggcctggctttgcttagtaaaagagtggggtagtagctttttctttattacaaaatttagactttttctccacatgagctagtattttcttagatactacataaattaagatattgcagcttcaagaaattttatcttttgtaaatattgcatgtttgtagctcaaatgttatgctttgttaaattattccctatcaaaactcttactaaactgttgacattatttaacttctgtggagaaaggcccttcaagatttatagaactgggcttccgagacttaaaccatcaaaggtaggtaatttaatgctgttcccgaccttgcaaaactaattggggctacaaatgctagtgtggaatacttaaatattagatagcacttattttggcactttttattttttgaagaaaatgctctcagaggtttccattgcaatatttagtgtgtacataatagagtattaaaaactgagttagtgcatgtttctagtagtattctgcttgaatttctaattctaattgtacatgaagttggcaaagtgacatcgaaattgagaagtcattgtgcttgtctagcatatggaaagttttggtttgaatgctgattaaataatccctttttttttttctcaatgctgcattgattaagtctcctcctgaaattcatcttgattaattttacctttttctcttatctgtcattgtggtctatttttaaataactattttatacgtgtttttgccaggtgattgattcaacagttgatagcaatgcttctgtt

SEQ ID NO: 117567 - DNA, 1036 bp, Homo sapiens
tacatcagacagattctatcagcacaattgttgtctaggtgtggatacagattcctggtgattcctgttctgccaacttcccagaatcctcctctttttgtctgtttttgttgcatattcctagtacttagaacagtacctggttcaaaatgggtctttaataaaaatgtgttgaataaatgaaggaaaacagtggtagttggttgtatcctagatataatttgaagatagaccactatatttgttgatggattggttgtaagatgagtgacagagattaatcaaagatgtctcctagatttttgtcctaagcatgtgtggagttgtcatttcttgagattgggagactgtgggagtggcaaaactgagacagttgttctcaaaagttccttttacttggttttaacattgcataagctttgaagaccatatttaccatatttatttgtaatgttttctttttctcaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtggtgggtaccatctttaggaaattcccagtttccttgatacttaggtggtatgtatgattcttctatgatcactgtttgtgaggtaggcaaggtaatttctaaaatcaagtcgtataccactactctagccttcagtattttaccagataaacttaactgtgctgttccacggagctatttaaaatgcttgtttttttttttttttgttttttttttgctgggtgcagtggtgcatgcctgaagtcgcagctttgcagtccccggagttctgggctgtagtgcactatgcctatctttgtccatgctaagttcagcatcagtgtggtgacctcccggtaacaggggaccaccagattgcctaaagaatgggatattctgtccagggcagaaaaacagaacaggt

SEQ ID NO: 117568 - DNA, 1073 bp, Homo sapiens
tatatagaaatgtcacataccagatgggcatggtgactcatgcctgtaatcccagtattttgggagaccatggtaggaggatcacttgaggccaggagctggagactagcttgggcaatatagtgagacccctgtctctacaaaggaaaaagaaatgttacatatctattttatttcttggttactaggatatgaaattaagagccagagagaacagatgatcatttgccctcatttgcaagcctgttaaaccctgaaagtttacaatttttatcatttacaattaaaatcaacatcttcctagcccttggtaaagatatagcaagatattgtcattcattcactacaaataaaatgaatatttctgtccaggggatccatttgcattttcacttcattaacttgatacaatatggtgttttcagattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggtaattattcacttgattcacacataaaatatctattaagtacttgccaagcattgtgctgtgttctcgatgatacttactttgttctctataattcagaactaaattttatgtcagtttttactctaaagtgctttgtgggagtaagattattattgtctcatctaagagaaagaagatcatacaggcatactttggtttgaccaagttccatcgccatttatcaactatggaggaattgaatttaacttttctctgtgttataccctttccattgtacgtgctatctgtaggttttcatgattcactttaaagagcttttattgaaatttcaaagtaacgttttaatttcttgtgatattgctatcacatgcatgtaatagcaatatcacagtatgtggaactagaacacaaaacacagaccgggcatggtagctcacgcctgtaatcctagcacttggagaggctgaggcgggcagatcatc

SEQ ID NO: 117569 - DNA, 1032 bp, Homo sapiens
aaggagaaagatctaactcttgtcaatataggctgaatgtttctgccttttctcgctttggctcccaaacaggtttagattaatttctgatattggacctttgcaaatataaaccttatatagaagaaagggggcaatacaagaccagagttgaaagattcataaatgagttaatagcaataacctttaatcttgccattacattttcttagtcttttattttctatattttaggagttggatgtgtcaatttgttcttcactgagtttagattcttggtcagaagacatggaaaatttaatttgaacatgttttaaagctctctaatttacttgcaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaaggtaaaaataagttttttatagttgatcttcattatattaaaatacaggtgtttctttagtatttcaaggagtagataataggagttatggagacattttgaaaatctttaatccacataatgtgaagagtggttgatgttaataatttatatacatgtacaggtctaagtgttgttcaaattatcagatacctagctgctctttgtaggcagatcctgttaacagtttgtcttcccttttaggtttttcccctcatgcctaaacgtttctatacagatgttccttgatttatgatggggttacaatgtcccgataaacccatcgtaagttgaaaatgcatttaatatacctgacgtactaaacatcatagtagcctagcctacctttagcatgctcagaacacttacattaggttatacttgggcatcatcatctaacacaaagcctattttataataaagtattgaatatctcatgtaatttactgaatactgtactgg

SEQ ID NO: 117570 - DNA, 1009 bp, Homo sapiens
ttgggccgggcacagtggctcgtgcctgtaatcccagcactttgggaggccaaggcgggcggatcacctgaggtcaggaatttgagaccagcctggccgacatggtgaaaccatgtctctagtgaaaatacaaaaattagccgggcatagtggcaggcgcctataatcccagttactcgggaggctgaggcaggagaatcacttgaacccgggaggcagaggttgcaatgagccaaaactgcgccactgcactccagcctgggcaacagagtgagactccatctcaaaaaaataaaaaacaacaaaaaataaaaattaaacttggatatttcactttgaaccattaagtaatttagtaagactctttcgtggcttttaaaattctttagttaatgttgtcaatctcgaggatttattaggtggatcagattttatcttatgatctaagtaggatccatcttgttagtgtctaataattgtactttttcatcatgcattagggttatgcttatacttttatcacagaggatcaagctcgctatgctggtgacataattaaagctcttgaattgtcagggactgcagtacctcctgatttagagaaactgtggagtgatttcaaagatcagcagaaagctgtgagtttttaacccatgttactcttctagaaatcattaatgtgactaaaccttgattatttaattcttggaaatcttttatttaacacttgaaaattttgctacgactatttttatttctctctagagggaaaaatgagtgaaagctaaaatcctatcttattcttgaacttagtattttgtggtgtctatgtagagctcttagtttatcttacatgctagatgaagtgtttttattacattgacatacaccaccttgaaaaatatttaattagtatgaattcctaaacattaaagtttttactatgagattaacttcgttttctttttttgaaaggaggggaaaataattaaaaagagtagtgggttct

SEQ ID NO: 117571 - DNA, 1039 bp, Homo sapiens
ctcaggtattaagtaatttgttccaagtctcagtcaatacttttaagaagttctttgattttacttttcaggaattatgttgaacacaagtaaacaagttgtcctagacattgagtttgtgagaatttaacattctcaatacagaattttttgataattgcatttggatgatttctcagtgctattgactgaggactttgggcctattctggaatttctaactgttagccactggtagttttatagggtagtattctgatgagtcttaacaaaatcttaaagatgtattaataattctctttttctttctttatctgcttttattgggcacacaactccctggatatacaaacacccagttacatgactcaaatcaatatggtcttaaacagtggagaaatgtgatttttaaatatttcacgttatctttttcttggaagcttacttgttattttgaagcttttgaggcagtcattaactataacgtttgtaatgttgggttgggtcatagagatgaaggagctcagtgatggtagtagtacaaacattcaaattcggaggagactcctaggaattagagtatgcaaatgattttcgaaatatttactgtgtctgacatcaagagttagctaattatcaactacatctctatgatctagtagaatatttaatagagttgaatgttctccagttttcttatccactaggaggtacattaaactacattataaatatatattgctaaatcacacatatcaatgagactatgcattagaaaggtttatttattaaacttgcatacaaagttagtagcttttcagagaataatttgtggtgtggtccctactcttgtctctgccctcatttgagatttaactaagtcttctttaactacaggatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaag

SEQ ID NO: 117572 - DNA, 1201 bp, Homo sapiens
ggctagtcctcctttcattttaaagattttgttcagacgagacccttctgaaacatttgtagacttcagtgaacatcataaatgtctaataaatacttactaaatgaataaaccaaggaagttatatttccctttagccttctcttactatctcctggacaaatcactaatagtctttttattccactctttttaatcaccatactaggaactcttaacacataatatgacctcagtggttacatttgaaactctgaaagtaatcaaaataataagcagccattatataatgtgggtaatgttccaccaggcattaaatggctatcttggcaggcagtacagtgtttctgaaagtcacctacagtgtttcttcctggacctccgtgatatgggtaaacacagtgtaagtttagtaatttgaataatatgctttccactcaatcactaggtgccaatgaactggctgtgcagaaagcaaaggcagaaatcaccaggctcataaaagaagagctgatccggctggtgagtgaaaaccttaaagtttcgtttgttttgttttaataagtgttttattgaaatataaatacagagaagtactcaaatcataaacatatagtttgatgaattttcacaaagtaataagcataccagtgtagtcactacccagatcaagaaataaaaaacattactaatatcccagaagtcttctctgtgtctattcttgtcactattcatctccccccaacaaaaccataccttgaattttttttcttttcttttcttttttttttttggagactgagtcttgcattgtcacccaggctggagtgcagtggcacgatctcggctcactgcaacctccgcctcctgcgttcaagtgattctcctgcctcagcctcctgagtagctgggattacaggcgcacaccaccgcatctggctaatttttgtatttttagtagagatggtgtttcactgtgttggcaaggctggtctcgaactcctgacctcatgattcacctgccttggcctcccaaagtgctgggattacaggcgtgagccgtggcgcccggccctatattgtgaattttaaaatcatagattagtttttcctgtttttgaactccacataagtgtaatcatgcgtttgcaccttttgcatctagtttccttcactcaacattttgaggagattggtccat

SEQ ID NO: 117573 - DNA, 1120 bp, Homo sapiens
acatttcctttgaaaggaaacgttgtcttttatctaagtgtaattctgagagcttttctaaaattcccctcacagagcattcctttttttgttggggggtgggggtggttagaagtttaatgaaaagtgggttcacaaaacaagagggaaaaagtaaaacagctgttaaatcatgtgcttaatactatttcaccaaggagtggtcgaaaagaatcttgtgcccatagatgctaccaccattaggttgattcaaaacatagttgttaaggaatagttgagtgaacagagaattcattagttattgaatagtttttcctttctcaatgcagtaatagtaacatttaaaattttaaataaccaatagttttataagttggcaaaggaaatgatcttaaatatttccttttgggtttgtttggttggttggttggttcgttttttttttttgttttttttgttttgctttctctgatgacatatcttttatttcctattacagcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaa

SEQ ID NO: 117574 - DNA, 1037 bp, Homo sapiens
aaaagcctgccggctcgagatcggcgtcgcgatggagtgcccgtggacttctacgcttgcggaactccgagtggacggatagcggcttatgaattttgctttttagagggtacacaaccctttctctagggtggcgtgcatcttctgcaaacttgttattgccaatacgctaatagtcgctttcagcacacaacaggtaatacattctaaacgcctcgtgtcaaaataaggagagtccttatttgtgcaccgtggggcacagttaaggagcaggaagaagacaaaggaggccgttatttatgtgccgtcctattatcaaaactttccgtggtggggcagggtgcgtggctattggcctctgctgaatggactttcagagtgattgaggtgagttgcaaatcttcatttagaattatgaaacgtatatgattatacataatagttagtcaaatgacctgaaataaatctctgagaattacgtgatctttgatctttggagaacagaacttgggtttcttgaaaggaagctttctccatgtttagaaagcttcagggatgctttgtgaagttactaaaaatagttacatttctttatgttggcagtaatgactgccacattcaagagaagagaaaggaattgttctataaagaacggctcattttaggggttaaactttaggagttaaacacaataaaacaacttcaaggatggtaagttttagcttatgctttaagtattcgaatttagtcacagtccaaatatatagaagctcttagttgactcctgtacattcagggaactatttattggttgtttttgtttgttttgttttttttgaaacggagtctcactctgtcccccaggctggagtacagtggcgcgatcgcggctcactgcaacctctgcctcccgggttcaagcaattctcctgcctcagcctcccaagtagctgggattataggcatgcgccaccacacccagctaatttttgtatttttagtaaagatggtgtttaaccatgttgaccaggctggtc

SEQ ID NO: 117575 - DNA, 1614 bp, Homo sapiens
aggtcaggagttcgagaccagcctgaccaacatggtgaaaccctgtctctacaaaagtacaaaaattagccgaacatggtggcaggcacctgtagtcccagctattcaggaggctgaggcaggagaatcacttgaacccaggaggcggaagttgcagtgagctgagatcgagtcactgcactccagcctgggtgacagagcaagactccatctcaaaaatttttttaaaaaaggagatactttattatggttgttatccatatttttgtagtataagtcttaagcatttgtataatgttcactcattttagctaatggaaacctttgtttaccttttgtattggtactgccttctgttggaatggaggatgtttgaagggagtcagtaccttgggccaagagattgtattctttacacttgatcttagccaaaaggccaagaagcagtagagattgtgttcattgcttggcacatgctgtcttttgtgaagtgtaacatatactcagggttctgtataaataataaattacaataacgatggagtgtccatcttgtggaaactgttgtcaggccagaagtatgcatgtgagaaatacaataaaaggccaacaggaggcattctaagaacatcaggcaaactgaaaaaaagaattgtgttaataagagttcttggctttactattattcttttgaggtttagtaatctagaagagaaaagcccacagaatagaacatttgtttttgacttacacacttttctggttcctaattggagagcattatagctatgaaatcagtattataatagagttatcttgtatgatgtttgtcccatgattaaattgagaagaagtgtccttgaatctgctgatgtgtgtttgtttataagtggtctggagtcctgcctgttagcctaattttatgtagcctgcatagttgttggaagacagactgttttctcactgaatgctgcatacaggtatgtatttgtgtgtgtgtatttatatatatttgtcttttatttttggtagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcatggggtagaggaaactagcagtgaagtcaaaccacccaatgagtgaatgaggcaggaa

SEQ ID NO: 117576 - DNA, 1022 bp, Homo sapiens
acagatgcactcagggcatgagcagcggcattgtatttgtacataggttcaagtgtaacacctaactaaatcatttttccttttcctttagagttatggtcatgtctcatgtttcattactactttggggctgttctaaatagatgctttatgtgataaacaactgaaaccattatacctattagtttgtgaagtaagcctacagtataataaagacactaacgtatttttaactgatggagcaaaaaagcaaactaatgaatcaggattacttgaggtaatggctgtgtgagtttttgtaacatttattttcacaagatgggacacatatttgtatgctttggcatttacatccacttcaaatgttaaaaaacttatttttaatgttttaggtttaagcagcttgtaatttattgatctacatggcattaattgatttaaccattatacctgaaataattcttcagtgtttgcctttgagcagtgataggttgtgtattttttaattgcctaagagcatatataccaaacactacaaacaattcatatttacagaaaatttaaactattttataaaaactgcacattacatttttggtgaaatatagtgcattctgaggatagcatatttcatataatagaaaaagaagcattctctaggtttgcatgtagctatagtcactatattttgcctttcatatagaaagttttaaagtattatgtttaaaaacatttattggctgggtgtggtggctcacacccagcactttgggaggccgaggcaggcggatcacttgaggtcagcagttcaagactagcctggccaacatggtgaaaccccatctctactaaaaatataaaaattagccaggcgtggtggcgggcgcctgtaatccaagctactggggaggctgaggcaggagaattgcttaaatccaggaggcggaggttgcagtgagccaagattgtgccactgcactccagcctgggtgacagagtaagactccgtctcaaataaataa

SEQ ID NO: 117577 - DNA, 2692 bp, Homo sapiens
attagctttgcacaaaccatagagaacgatgttggatggttacataatcagttataacattctggcagctaaattgctacaagagctttttcttgcaaaagcttaaaatacaagatttttaataatttactcagaacagtataacttctgacacacacaaatgcttgcctctttattcatatgttcgttacctactctgtacatgtatctgtcatttagctgtttctcaagatgatgttcagcagttggctgcttagaaatctttttcaagccagtttctaaagacatttgtttaatgttctaccatagaataatgcacaccattgtcaaagatttgattattgtgttttatagtaagtccatttgacatttatttccctttcagtttattttccttccttattttgttatacatacccttccctttctcccctgcctttcgtacattcattcctcttcctctaccctccagcacatctacttactggtgctgtgctgtgtgtcagaagataaaacaggtgtattattgtataatgaattttgtatacatgtttatgaaatggtgagatcaactaaaggaggcatgttcataacagtgtttattatcagcagctatgtcccaggaaaaaaaaatgggaggggcaaatggctacagttgtaaatggataacatcatttagaaagccgaatttactgttcatctgagcggttacctggagtattatatctatgcactggtgagcatctcctgattccacttacttttctccctgtgaacagtttaccggtgccatgctgaagagaaagacatctaagtgataacatgaatgaagtcttaaaatttaaagtatttttactgctatataaactaaagactacattgtgcatattttgttaacactgtctcttgttatgataaacactgaaatagcatgttaaacagttgcctatactttaatataatcagttggggaaaactggccttttctcccccactgtatgattgtttcttgaaaggtaaattgctaattttatacagtgtaattctgttcttcacaaaataggtttcattattctatatttaaactgttggtcagaaaatgatctgcaattcaagtaagtctgcattacttttttctttaaaaagtactttaacatgccttatttattatattagcaaatgagctaataacagatgaaattttcattttttgacagatataaccttgcataagtagtatttagggtgattttgatactatctttagagttttgcattggatattaaaaaatatattggcacaatgtattggaagaaaatgagtagtatctggtttaatttttaatatttagggacattttaaaaaatcaatgttttaattagactaaaaattctttatattttttatttactttttaaagaaacatctgtcaaagtaatattgattccaaactgatgtttgtgtgaatttacatgtctattttcatgaactaagaatagagtttctttgagttgaggagaaaaaaatatatatgtgggtccatttattaggttaaagttgacccattcagtgtaaaaataaccatagtgtgtgagctaaagaaaaaaaaaagtaaatttctcctttatattctaagaagctttaaaagaacaattcaggggttattgataactgctactctgtcggtcattgtctctatatgcagtaaaattttatggtccctttataggaatataaagaattcaaaacagtttttcaaaagatttttttccttggacataaaaaattttgatgctattctatttttgtttttattacagcttaactgtatgctgttaaactctaggatgtatctgaatctttccttttttcccccctcctccaaatatataaatctgtgctctcacatgtaatgtatttaatttttggaaaatttaatgctatatagtaaatcaagtgtgtgatttaaagtaatcagatcactttgattcttttaagttttcagaatttcttttttccacaggtaattttggagaaaataattaccaattaactgataataagcacgctgtcctctgctgtaaaaagtctgaatagatactgtgtatgtttttatgtccatgaacttgagctactcgtgtgcaattatgtgtatgggaatggagtagtgttcatgatttgtatctacatcatcatatggatgtatatttattaataaagtcattactttaaaaccagctatgtttactatgttttttagtgtggtacttttcaagtacttaagtggtaaatggtaaacctttttcatgactgtagatcttgtgtttttcttagaattttgcttttttttttttcttttttaagacagggtctcactctgtcacccaggctggagttcggtggcgtgatcatagctcacagcagccttaaccttctcggctcaagcagtcctcctaccttcccacctcagcctcccgagtagttgggactacaggtacctgccaccatgcccagctaattttttatttttttatttttatttttattttttttggagacagagtctcactctgtctcctaggctggagtgcagtggcgcgatctccgctcactgcaaactccgcctcccaggttcacgccattctcctgcctcagcctcctgagtagcctggattacaggcgcccgccacc

SEQ ID NO: 117578 - DNA, 1037 bp, Homo sapiens
aaattgagcacatgctgttggaaaaatggtgctgaaaaacttgctggatgccgagttgccacaaactttcaatctgcaaaaaatgcaatgtcagcaaagtgcaatggagtgaaatgcagtaaaatgaggtatgcctgtatttgaaatgatgaattatgaaaaatattaaaataacttgtaatattaggaaagcgcagaggaaagtttaaaactttctgcttaattcagcaagacttaaaaaaagtgaaagtttataacttgtcatttgatcatacttttttgctggttcctggattcatatggttcaaaatccaaaaggttccgagggttccttctctcgctgctcctacccacccgttcctctccctggagcagcagtgtgtcctgtttcttgggtatcctttcagaaaaatgtacttttactgctaactttaatgcttgtttcttttaccacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcaggtatcttccattggtggggtttacgtccatcctcctggctgatggttgcagttatttggaggtcctaattagttaagttagaagcagaagagggggggcatgaactgtgtcctgggatggaaggcaaggcaagagtgaatagtgaggattatcatactcctgagggagctggtggtgtcactttatggaggccccttaaagaaagtgggctgttctctgtgtggtggatttaaaggtggcaggtggtagcacctgatggcaggggaggggccagaagacttttgagggccatagccagactgaatcagcacaattggtatcacagtaggatattcctttgtgactttaaggcgcaggttaaatccccatcccaggcagcccaattcccagcacccctgttttgtgtctactcaggat

SEQ ID NO: 117579 - DNA, 1309 bp, Homo sapiens
tctgtagacacctgagaggagttttactagttacttactgaactttggtctcaaaagacaccaaaatacaactcttataaacacattgactaagaaacttctgatgagttcacagaaattctagtgttttagttgtgaacagctgaatgggttcctgatcctttgatgcagtggggagaaaggcaacttacaaattacactgataggcaagtgaaatccatcccatatatttatatatatactagtggcaatgcttattttaggactgcatgtcattttgcataccatacataatacttgagaaaaatctgtggtgggtgctttttctgcctgatttgaaaccagtgatttttctttcaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtaatcccagcactttgggaggc

SEQ ID NO: 117580 - DNA, 1053 bp, Homo sapiens
tgccaggctcaatgctaggtaccctcacattcaagatctgtaatctaagcctttcaaaaaatcttggcaggtagatattataatatccccactacagacagaaggatcccggaattcagaaaagcggagtttagtatcccacagctaaaagtaacaaagttaggccttagatctagtttactctcttcaaatcctagcctaccccccatcccctgaaaaaattaagcccaccaccaagggttctgctgtgaatgtgccctcatgggggcctttgatgttatgtagatgaagtggctccatttcccagtcctgggtgtggtccctgctgctgggcaggtgtctgttgtgggcataaagtgcataccactgatcttagcggggatgtggatggtccagcactcagagaaaacagctcagtgtgttctacagactccaggttcctgccttattacaggcagcatgtttaatggttttctttgcagctactcagtgtggacacacataattctgtttcttttccaaaattctctgagttgacaaaataagtgtttaataagaatttcagaattctttctttttttttgagacggagtctcgctctgttgcccagactggagtgcagtggtgcggtcttggcgcactgcaactttgcctcctgggttcaagcgattctcctgcctcagcctcctgagtagctgagactataggcgcgtgccaccacgcttggctaatttttgtatttttagtagagacgggtttcaccatcttggccaggctggcctcgaactcctgaccttgtgatctgctcgcctcggcctcccaaagtgctgggattacaggcatgagccaccacgcctggccaagaattttagatttcttatgatagatgtatgtgtaagtttttcagaactgtcactggaaaactgatgaatgaatctcttttgattttttttttttaattgagtcggagtttcactctgttgcccaggctggagtgcagtggcacgatctcggctcactgcaacctctatcatccgggttcaaatgattctc

SEQ ID NO: 117581 - DNA, 1001 bp, Homo sapiens
gcaaatgctgctaatgactctgtttgcttgtgtgctctctgccaacagggcaggatggaggcttttttttttttttgagacggagtctcgctctgtcggctaggctggagtgcaatggtgtgatcttggctcactgcaacctccacctcctaggttcaagcgattctcccacctcagcctctcaagtagctgggattagaggcacctgccaccaagcctggctaattttttgtatttttagtagagatggtgtttcaccaacatggccaacatggccaggctgtacttgaactcctgagctcaagtgatccgcccgccttggcctcccaaagtgttgggaatacaggcgttgagcccagctgctgaggctttttgctatatcatacatcaaactgacttcaagtgccctgtcctcgccatcgcagccctgtcggtggacatgcaccaggtgggtggagcagccccaggctggctgggccaggagtcacatggtgtggttctgtcaggattcgtgaacccagcagagctgttgggcttatatccactgaggggctagtgctggtctggatccaagaggtggaaggaggaagatgcaacagaaggacctggtttcgtttctgcccagaagatctcctagttttgctggggaggtggcacatctgaattgtacaaggtgattgatttttttcagcttaccatgttagtcaggtactagaatgtgaagtgctgtgctaataagccacaggaggtgcacttcagggtggctgctgcctggagaaggggagttttgagttggttcttgaagatctggtatgtggttgtaagggaaggcactaagggaggggttagcaggtgacataggtctaggacagggagtaagaggacatactttgtctgcagtgtgttgggaaataagggccctaaaatgggttcagtgagctgggccacagagtacaggggggttcctgtggcgtactctcctggggtagctttcccaccag

SEQ ID NO: 117582 - DNA, 1018 bp, Homo sapiens
agctttatgtgttgggtggggtactttgggaacacaggattagagtttggattagagtttgacttagaatggaaattaacctttgacttaattgtgtgtgagagtggagaagggggaggggatagagttaggaggctgtgaagttaggaatgcttgaatgctgtctgagaggtttagaaattttaattactttaaaaaatatatacttagaatactgttaaaggaatttttaccaggttttaaaatattgcattaaaactcaaactatttcccatttgttttgacgtaaccaaactcatttattactaactcataaagttacaaggggcaaaagaaaggtgttgtacaaaaaaccattttagccataattttttaagcttttaaataaagcagggcctagctgcacatctaaaatccaaagactttacttaaatgggataatgtaagtactggttatattaatatagccttcatattgtcagatttgtgagcacgcataaatctgttttcttaaatgtattattataattgttttttactcttttaaaaatcatgtttggaatatacctgactatacttactatttaaaggaaatatatttaaagaaaatattgaatagtatattttgaaagaaaaccccaacatgtaaccttccaaaaatagacattcctaaggtactgtcatcattcagtaccgtcctgtcttcttaaaaagtggtacacagacagaaggtgcagaatttgtatcttattacaagctcatgttaatgtagtcattttttattttcaggttttgatgttttgttgtttttttttttttgagattctgaagtttttagaagtttgtatttataactttttaagcccatgtaatgcatatggggcatctgctgggccataggaggaatcttcacttttggagggtgtttttagggaaatcggaagcagtcaggagaaagaatggtgcatagtgcccctgtctgttcaaaaaaaccagaggctcctaaaatcctgtgtag

SEQ ID NO: 117583 - DNA, 1007 bp, Homo sapiens
atatataaagtatgatttgcataaggtatgaaataataaacttgtaaaaacaaaagggaagaatttccctgtagcagttgcatcaaatggcagtgcactcctcctccagcagtgtgctttttttgccctgatggtttagagccagttgcatgactttcctctgatgggattgcaaatgagctgagcagtctttgcagagatggagctttgctgtgtgctgcgtgcctgtcaaccctacctgcacagagaaggtgattgctccgtggcagaacagaatgggagcctgctctgaggaggagaaaacaaatgatcttgtttatatacactcaggaaaacaaaccatttttctttctttcaggatattgtgaattacttatataaaaaaagccaacctctccagaaacttcctagatcaacagctgaagttaagataatttatatagaaatgcggaaaaatttgacttaagaatttattattttaaatgttttctctcttcattgctattttctgaattactagcataatttgtgaatttttgacacagagacttaaaatttttcatttatattcaagattcagctaagtttggctacacagaacaaattttctagattttaaaaaagtggcataaaattactttatgtatgattccagcaaattggaaccgcttcagtgtcccaaagaagcacattttctgcgcaaagcactgtgcatttttgtgagacctcctcacacccagtagtgatgttaagaagtaacagagcctcagatttacagagtagtagaggcaagagaggtttaggatttgctgaaggccatagaatgagacatagctaggattagcatttttcaggatataaggataccacccaccagactttgtctttgataccaaaaatagggtttaagtgctaagcttactttcctttctttgtggctataagccctggtatttttctttaacaaataattaaaattattattaaataaataaatatacttaaat

SEQ ID NO: 117584 - DNA, 1011 bp, Homo sapiens
gtgttttcatttgtaatcagacataaatatcatttccttccatagcaattgtgttttataaaagaagggttataggcctacaaacataatggtgattcataaacaatagatgtctaattcattgaattagtaaaggaagtatttagaggcttaatggagattgtactggggaaattactttggagtagctggtgctcattttcttagtgggagatatgttcttttttagtgcataattaaaatagtctataatcaaaatataaaaggcagctgatttaaagaatgtatatcaaagagacttgctctgagtaacgaaagatttgtattgtaagtatgtgctagaagtcttagaactttaataaatcatacatgttatttgactgaagctgtattttaaattcagggtgctgttaaacatttcacagattgatgcacgatttttgtcttggttttgtgcatctgatagtctttcatagtttcatggaataaaatgaaacaaaaggaactttaagaaaaattaaagttcccaaagaatacttgatttggggttcatggaaaaatctttaattgctgatggtttggagatttccaaatgacaaacttcattggcccaatttactgtgattgtattgcttacattccttaaaatggtagagtaacttaaaaagtcatacttcatcatacattcattgacttgttcataaaatgtttgtaatttgcaatagaggaaagactgaaactattatcagccattatacgttatttgttggccatatgtttgtttgaaatggctgtggctcaacagaacatggctcatagacaaactatgctgtaaattggcactaaaaacccacctaaacaggtaggcatatgttaagaagttaacatgagccaaaatattttaatgtgaaccaggttatgtacattaaaggattccagctccctttacagtgggaacttcatttgcatgttgttcatttttttcccaaactaatttttaaaaaatagatc

SEQ ID NO: 117585 - DNA, 1037 bp, Homo sapiens
tgccatttactgtgcatgtctctgtgctttgcatgtatttgcctataagccccaggaggtaggtgttatctccattttacatataaggaaattgagtttcagaaaccctcagtgactattattactacttgctgtgattgtttaaaggaaaatgttacacaaattagtaaatggactaaaactcaggacttccggcctctgaagtccatgctcttaatctcttctagtagcctttattttctcttgtttttcatcataccgtggtacaaaaaggtaagagaggatttcattgcctgcctctcctggacctcatggcctgtagagtgaggatggtgcgttgagatgaggcactgactcctccatcctggtcagcggccatgggccctttgctgtccttatagacaatgcaaagtgtgtccaactgctcggggctctgctgaggtttgtgtgagaagcatttgtgattctggaaaactttccctttcccaggatgaccccagtgatgatgatgctctacccaggagcttggcttgggtctgtccagaagggctgctgctgtggccatgggcacacagagccctgtccctggcccagcaggtgtgtggcctgtctctgactccctgcagcacctcccctgcaccccagacatcctgtgtgtctgtccttttgatgccaactttggggtgccatgcagccatcaagtcagaaggcggttgtgctgtcacagggtgacaaggagattttcgttctccttcctctctgcttagcctcattttgctgtgcgagcctgaaccttaggtctctgttgctttctctattgcatagggatggaaattcctgccaaatctgtgacacagtgttgctttgaggactgctgaggtttgtcagtgctaaatctaaaagggcatcatggttgcctttagacaccacctgagaaggcttccctgatctccctcctcgtggcttagaggcagtgtatccacagttcacttatacttactctattacagtcatcatcacactgcagtaaaaccacc

SEQ ID NO: 117586 - DNA, 1413 bp, Homo sapiens
gtgtgaaggggtaactcttctgtgtgggtggatagaggtcagtgccttcccagagaacctgcagccatcccctggggctgacatcaagagcctgggctatggctcaggcactgtgctagtcaaaggtatcatggaaaaagaaaatcaggagcttacactgtacttcgggggcttaatgcacaccacaaaacactattctgtttgctggctactgccttctctaaaagcacatagcacatccttctgcaggtgccagctctctgcccagttgtctgtcccccatcccatcttctgggcactgggctttcccacactggcgtacaagcagacacggggctcaacagacaccgacccaacacaaggcaagctgcagcacagagggaggtggcctgtaaggtggggcaggtcctgcagcccccgtggcatcccagttgctgagtgcttatcttctcttctccaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttgttgtgactggtgtgttccagttattgtgcccgtgagtcacaggtcttaagtcggcttctgcagtcccaggatgtgggggcagggcagtccatccccctcaacccccaccctgctcccacaactccttggatgctccacagtgttcactgcaacctgggtgggtgtgggccatctgctggccccagtggttt

SEQ ID NO: 117587 - DNA, 1065 bp, Homo sapiens
aggcaggcctcgtgattttgcctcctgcatgctgccatcactgaggtcccacacctcaagtactggtggcagaactagtacagagtgggcttcctgtcacttgacattctgcctagtaaaaggccttgtccacaggcagatgggcactgccaccgttccccagggctttctatggccaaggccatgtgtgactggcaggacccaccagtaccaggctctggggaaagatctctggttgcacctgaaccttctctggagcctgtatcactgcccgccacccgccgccacccccacttctcccagtcaagggcaaaacagcagaatgagcatttccccagcaacccctcaccagttgttgagctatgggcaggcttgcctcccccttccctggcctcacatctctgggctgtctggtcctggggttctgtgagtgaggcccctcagctctcctatcctgtgtgacctttggttaaatgaatcagcctctctgccctggtctgccttatcagcaagtgaggctatagggactgcccatcctcacaaatggttctgaggctcagttaattagtgctttcaatgcactttgatctgctctgatgaaaggtgcttccgcagagggaggcaataggaaactttattggaggtaataatttcacaacctttcatatgggtattgggaaatttttaattgaagcataaaagtaattctcataaaagagcatctgttattacaaacttatttacatttttcatggagtaaaaagtaggaataaaaataatcaattgaaagcttgaagagggggaaatgcctaaggcagcacatgtgtacagctacccaggccacatctgccaggcagacctcaccccatagagctgtgtaaacagctgccctctctttcatgagtaaaaaaaaatgggattacaccagagccggccagtaaatcacagtgggttttaggaggggaaataaaacagcttgtttgttgcatccagtgtctctggcacggaagtaatgttggaattaaaacagtataaaggtaagcatgttgggaaagagccattggt

SEQ ID NO: 117588 - DNA, 1074 bp, Homo sapiens
tgtgcaagtcgataattagcacaccagtcgacttgaagaagaagggttggaaacccaaaacaattattttgaggctgcaaatgttctgacacgttgagtttgcgttcagttgagttttgatggataaggctctgcctctgggagaaccgtgtatgctttctgagagtggagagaggcttactacgaacttggtcaaaattcctggtggtgacacatcataatgccaactttccaagggtgtggcttggctccagctcacgttggaatcacaacgcagcagacagctgtggaactcctcggacacagggcattggagggcccaggaagatataccgtggcaggggagtgggtctgtgtttggcatcttgtgctttgcagtgaaccagagctcactgtttctgtttcatccccgcaccactagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggtaggggcacatgcttgttacgtatcggtcatgggtgtgtctctctgcgcacacatggcccataattgtggtgctctcactctgtgcaaggcccacggaggctgccttaaccaaggagaccagaagcacaacacagggaagaatgcagacattaaatgatggtgagggacaattagagagacccaaatcccaaggatgatataaaacttaagttttgatagcaaatgtcatcacagaaggggaacccagtgtgtactgggaccacagaaatggtacctcagagagtaagttttgaggggcacagtgacttgggtggagaagatctggaggcgtgaatacagggatacaaacgaacagcttggctgtctcagaataaggctatagctgtgttatggtctgtcccccaaaccacagtattctttggataaagccctctgcccctttcctttctactcacaagtatatttcacctcctgag

SEQ ID NO: 117589 - DNA, 2883 bp, Homo sapiens
aggcagacccagctgtgccacccagaagagcccagtccttcctgaattgtgactggaatgggtctctttggaataaggatggtgctaatgcttttcctctgacatgttcacctacaactcattgataggcacagggtggggaattattagcttccaagccacaggagcaatctgggcccaggaccctggcacacatcattcaccgacactgtaacacctgcagaaatcctcagcaggttcagacaccccaactggccaaggcagaaagactgccaggtcagaacccagtcttccaaagcccttcagggcttttctgcccagcggaccagtccaaaccagtattgaccccagatatcttttacaatcccaatgataaaccagattcctacatggcctcaattggttccagctcccactttgatgtgtgagaggagaaaagaggaagctagtaatcactccatttctcatatttggtgtgaagtcctgagactgctggaagaaggaatccgagtgcaggaatgcttagccccagtgattaacttttacccatcaaaagttctttctaacagtgaaatagaccacaggcctagcctgacatttgtccaagcctaaattttcgcttaggctgttttgaacactgatacttatgcctgctttctaagcatgaaataatgtccttgttctcatgggagtaacacatgtttatgcttgggggcaaataagccaattgctttatgattaaccctgaagttaagcctaaaaagcaagagtcttacaataagagtgttgacaatatggttgaaaatgggcctgtttcttgttaaaaagtacatgtgtgtctacatgaacatgtgcatacatatgtgtgtgtaggagtcaagtcctgactgggttgattgcctgcaatctagggttcagtttttaagtttgggaaatgcatttaagtgtattttaacttggaaatttcacttttacttaaagcaatatttataagtaaaaattttaaacactcttcctaagataaaacacctttaattatagatcagcccattttcttaaatattttagaaaggagttggtaatcatgataaagtaaaaacattattttacctttcaaatttctcagttctcaccaaagagttaatctgataaagactgagaatgctaactagtccagcctccagcatttttgttgccctgcctcaagctggagaatgggtttaagacagaaggctagactgggccccaggggcagcagtgtgtggaatccagctggttccggctccagattcctttttctcagctgcagggatagtttaggtgaacctgtattggggtctcactcgcctgggttgcatccactttgtagtggtggagttgggctctaagcccccggcctgcttcctccagtgcatgccccattcagctgccacctctgatgctgactttactagaaacatgcagcagcaacaggtgtgacattctcactctgccatttaaagcctgtgctgctttccaggacaggtagaggcaggagggcagtctgagatcatgaagggtaacacaaaatcccacctcaaggatgctaagtttgtgccaccctctctcggacacagctgagagctcccctgggctatggctgctggtcatgttcatctgcacaccccaggtttcctacagcgggtgggtacaggcccagtcctagccattagccctggttcttatttgggacaaagcccaagctatttactcttcttcccagacacctcccggggttagttcacccctgcagaacaaacattcaaaggaggcaagtttcactaagataattaaccctggtcatcgcagggtgactccaaagagaatttgggctggtgcattccgatgcaccttgaccgtcccataccagaattgtgccaggtgcacctggaattttccaagacagatgtgaatcttaaggggagtattttgtcctcttgtgaggaaaagtactttaaaatgtgcaaaactgaggaatcagagcttaaggaagactcagaccccattctggccaaacttgaaaggctgatcttgttgctaactttgattgccacttgctatcccacatgagcatcaacccagagttctcataggtgttggtgatcttgtttgggaacttggttttcacagcaggaactgattacttagcaagtgccctaattgaagaaaacacattgctcccaatctccattggcttttgtgaaaaatctggtcctgagcagttagacatcctcctttccaagctttttatagaacacagattaatctttaagctctgcttctgatgttgcccttctttactgaaaacaattctgaatcattagtgtaattaagaaaataccgtctgaggccatttttattttgtatttgcatatgacaccaaagctgcaaaacaggaactaagcatggtaataatgctggtccaaaggtggccaggtatgaacacttccttctaggcctgctgccaggaggagagctggcttattgatgggagcattgtatgctgctgaaacctccttacttgggggttctccccagagacagagaagaaaacctaaggcaggcattagtcttggaaaccagtaccagctagtatctcatgccaatgaaaagcatccaggacaagcatgtttgcaaaaaacaagcatgtcctgtctctttcacatctctggcacatccatgatcaccctgagtcagacccaaataaggggcagcagagacagccagatgaagcagcaatttgagggtagtaactggtgatgacaaagcccttctcaattttactttattaacttagccaaggcttagttcctgttttgcagcctgatggaaatttaatagatc

SEQ ID NO: 117590 - DNA, 3607 bp, Homo sapiens
ccctagaaatgcagcaacttgctctgttgccaggagcttccctgccaagtgtcttgtgcacagccctctcctgggtgagctcctggacaaagcctcatgccctggtaaaccctgcagactgcagccactattctggcctaggtcatagtcttgagcaccagctctgctagggctactcaggcattgcacttgtctgcaggtgttaggaatttatgttactgaagagtgagcaatgtcattgtgagagcatgtgcaagagcaagctttcctgcaatacctaaagaaaagcaaggggaatagtaggacctgggacagcagtcctaggcccattaattccccttgcccctctgacagaatttcgaactcagtattcttcgaatactcagatgccagggttgccattgtaacagaataacagtggctgggggacacccattcagtggctcttcagaaagaacaaattcactgggtggatataacacttaaggaaaatgctcaataagccacccattgagtctcagagcaacctgaccaacaaggtgaaaaccatttaaaagacacattgtcttgctggagaaccttcctcccctgggtttcaccatggaacttcagcattacatgactaatgggcacgtaaattaaatgttactaagcaagagactattctcacttcttgccaccctgagcagggcagggaagccagccagcagtcacagtgatggggacagccttaaaggcccatagtcacttggaagacaatggcagagcccttaggggtttgcccaagccaggtaggatgttagcaccagcctagtgctcaaggatgaggacagtcacatccaccagcccccaaccctcagcaatgagtactcattctaggtcctgatagctgccttactttggcccccagatcacaagtccctttaaaggaaagctgatctcctcgtccactgtggcttgtgcttccttttgtcccaggtgccacccacgggctctgaacattcatcctagtttgcttgctcccgcatcccgagcagcatttgagtcttatgtttgaaatgggttcatttgagccagcaactccctgcttcccttttgtgcctcgtgcacttggagtgtccactgtcctttacctgtatcccaaggctccttctctgagacttcccagctctcctgttatttcccacctcatgcttttctttgcagctgaaccttattcacagtgaaatcagtaatttagccggctttgaggtggaggccataatcaatcctaccaatgctgacattgaccttaaagatgacctaggtaattggggacggggttcggcaccaccagctgtcagatgaaaagttatggaacccagaatttaggcatttcatcttcccagactttacagtggtcaagccaaatttccaaatccaagattgatatttgagtgtagacgctgaatatcaacttactccaggccattccaagtgtaaacggtctgtttcattaagtgtgattggctactctctcctcaattgcaaatacattgccatctgaattctcttccataatgatcaaactgactgctggttacttggggagggatttttaaacgtgttggtttttgtttgtttttttgtttttactttagaactgaaaaatctcaggtaactacaaaatgatagtttctccatttaaaccttaattagaaatgacaaagcttgaaagagaagacaggccacatcagtatgctattaagctgtctttagtccacaatttactaccatcacttcaacttttctttagaactgaaaacagtatatgactgaatgccaccttcttgaattatttggctagaggatggtattaaacagaagggcaatatctccaagtgagttcttatggaggaaaactgccccagagccatggtgtctccctgttcaagatggcagatggttcagggcagactgagaggtgcccctcaagtgtcctgcctctatggctttatctttgcatatgtggcactgtcagctcaatggcacgacagggctgctctgctgctcttcgatgtagaggcttgccaggggaaataggcacacagatgcagcctccttcctaaccctcaactgcaatctattttgtatcccttgagctctcagcttctgctgtttttgtcagatagcagacttccttactgggagatacactcattccatgggcccaggcctgacccacacgaactgggtgcaacagtgggctgaaaacatgaggactggactcaagagtgtccagcttgaacttgttttccaactgccttatacagatacttaaaaaaaaaaaggccacaagctagaaaaagcaaggattctatccaaagcacattttatactaaaatacaaaggccaggtgcagtggctcacacctgtaactccagcgttttgggaggctgaggcaggaggattgagtgaggccaggagttggagaccaacctgggcaagatagtgagacctcatctctacaaaaaataaaaaacttagctgggcttggtgacacgtgcctgtagtctcagctactcaggaggctgaggcaggaggattgcttgagcccaggagttcgaagctgcagtgagctatgattgtgccactgcactccagcctaggcaacagcaagatcctatctgtaaaaaaaaaaaaaaaaaaaaaaaaaaaaaaaaaaaaaattaaaccataaaaataagataggctagagtaagagatgggcctggaaaaatattgatagagatcggcccatatgttgaggggaaaaaataaaggcagtcctctacatatatcaatactgttctctgggttttcaagagaaatcccttgaaggtagacaaaatggtaaatgtcacaagaataaaaatcaaagcctgcaagttgactgctgcagacagaatggagaaacttgttgttttggttggcctgatggtccactttttttttttttaaacagatgccatgttttagtagccttctcagtgggatgccagctttataggcttttgcgaagtgaaacggggcattcattttatttcttttaacctttggaaatgatctcatgtgtgtgtttctctttttttggacttctcattcaaatgtttaatttaaacatgtcacatttgatattcctcctcctcctgtcctcacccccatccacatgtgcgcacactgcgtggactgattgccccttgggctcatatgttggaatcgaccaggtaggccagccctgccattggggcattagtaaatgtgcctgtgcgtgggtctcggtccaacacagttgatatacatttgtttacctgttatagttgcaagttgtacaggctgacattgcctcgatcgacagtgatgctgtcgttcacccgacaaacactgacttctacatcggtggtgaagtaggtaatgcctagccgggtgctgccgagtgtgtgtgtgcatggtcagtcggccgctgcagacagcttgatcctttgacagctatgcagggctgcattcatttcacacttccagctgtcctgaccctgtctcctgtccctgggttgtgaacctgagtaataaagctagctgtcagccagga

SEQ ID NO: 117591 - DNA, 1044 bp, Homo sapiens
tatcggatcccagtgctggaagggatcttgaaggtcccttggctacgaccctttctgccaactgtgcagccacgcggggacccccttctgctctataactggcagtgccctatgattactttcctcagtggctaacagtcttcatagctgctttaaattcctcatgctgtggtttaaaacttagttttccatctttcctaacgacggtacaaagaagcagtcaccttattcaaattctgaaaccattaatgatccttattcctcccagaaaatcagactaattttgggaatttttacagttcccagaaatctgatttcctaacccacaaggaccacttctctgccatgtacttcagatggacacacacccctctggctgataaaccccactggatctgaccctggctggtgggaggggaccctggggcctcctaggactggacctctgtcttggctctatctcgcttattcatttgtgactggacagtgggagcctgtccagacacatgtgtacctggtccatttgcacgctatgctcatgggctttcttctgtatagtggagctactgtcttcgttcatgatcatctcactgtcagcttctgcccactggcccacctgccaagctgattacccatttgtccttccaaagtacttgaattaatttgtcttctccccttcccattctcttcccctgatgcacacatcccaagcacacactttctagtcaagattgtttaaaaatacatatttgtacacattttacagcaaaaaaacttttgtggctcagctgcataccctgaggacttctgctgagccccagtgcatagcagagcatagttggaaaatcacagctctagcctcatccacagatgtgaagagtgaaacagcacttggttggcaggaaatcctcaatgctgagtagtagtggctccctgaggtactgtagtctgcacttccaagagtggggatgcctctggtcagaagggaaggtagtgagtccaaaggaagctgagaattctccatgagcttgagttctgttcgca

SEQ ID NO: 117592 - DNA, 1120 bp, Homo sapiens
ttctatctgtgacactgaaaccagtgcttgaagattgcaagcaagctggggtggagaaaggtgatattgtgcatgctacagccctgtaaggcatggttgctaagctactcaggaagcatggcccaggcttaggagcctgaccattgatgttaatgatgtatttcacatactgaagtctcaggagtcatcatagccattactctctgattttgcccaatgttcacacacattgttgaattgttttaaaaaagaaatcagtgctgtgaatctgagtcaactaaatgcttttgctttgtgttcagccaagatttgcagccttttttcagaggttttaaaattttcagaaaaaacatttctaatgtgtctaatgtgtcagtggtaacactgacttaatggtaaatggtaaatgatttaagtttccttgtcagagtcagtattatttgaaggagttaggaaggcagtctgaggctgtgatgagtctccttacctcccaaatgatcaagatggcaaccccagctcgcaagccattcaaggcgggcataacgtaccatgggttttctccctttgatccacatacccttctcccgggagctggaagaactgtgaggagaaagggagctcttgaagttgaagcatcagtgaggagaaaaaccattcaccccttccccccactatggctgaggactggcttctgagacagtttaggaaactgacaaagccatgaaggaatggctcagctatcgaccatctggacatccagcagtatctatccatgtccttatctttgtggggctctttctagctggacacactagattctgcccggcccaaggcctctggagaaatccagcttgggcatgcatgcatgcagggagagccacacagcacagctgtgagggcaggagccagccctggagtgtgccccagggaagacacagctctcaggaggagactggaaagggtcctatggaagacattgcccttcccattcccctcgttgaagtgaactttggggacaggaaaataactgcattttaggtggtcagccaggcttccttccttatctgttatgagaaaatgagagacaccaaaatctgacagttacaggctagatttaaca

SEQ ID NO: 117593 - DNA, 1717 bp, Homo sapiens
ctgtgggagatggggacccttggttagtctggaggaggagctgcttctgtgggataaactggtcatcagatagcaccagccagggaatcaggcagaagtcaagccttggtggtggaaggtgaacaacctagccggcagcctgcttgtcctggggggcactaacggtagagcctcaggtctgattcagggctctacaggggattgttttcagactgtactgatgggtgcactgggtttcttcactgaaccaccagatgactcttccagctaattgtttgtttgttttaaccatgggcaatatattttcagccgccccagtgatgcaactttgccaggacgccatggttttgtaaaagacaattcacttttattgaaaataaaaatgatgcaaaggcttttaagacctgagaatgagagttaactaatatttctttattgacatcaaaaaggggtgggaagaaagaattaaactcttcttaattttttaatcctatacttaaagaattaaaggaatgaatttgacgttccaagttaatctgtgtttagtttgagtgtggtaacaaacttggatctgaagctgcatcatttttaaaccctcactgtcaatttcttttgcatcacagtgacacggttccctcgctcacgtcattgcaagttctcctcctacccctttccctctttctgtcactaattgcactctctctcatgatgcaattcctgtggtggactctgtgttccagaaaataaccattactgtttacatttttaaccattctttgtattttgtatgcatttttcaaaagaaaaagtagcactagttgtcatcttaaggtctggggatttgaaagtttttgttttaaaatattttttgttcctttaaaaatttcgactcagcagtgaagacaactgcctgggtctactttcacccctgtaacatattccttgggtaatgtattgaaagttaacgtgacccatccacattacttccatttgaaatacagagcagttcagcccttggggtcaccttctccctcttttccccactctgcccttaggcactcccaccctggcctctcccctgcctatgttcttgttacctcctgccagccactccaaaggcagcctcagatcagaattcctcatacctcccttgctggatgaactaaaatatttccaaagtagcagcaaatatggctgtaaaaatgtccatgcaaaatgcagatgcccttcttgttgctgtgatcttctgaaagaaatgggatcacggcctcctctgggctctgtttgttagccctggaggggagggggcaaacaccacagacatcttgctagcttctcccaagagccaggaacatgtcagctctcagcaactcaactcttccttttcagatacatctggtctcagggccaggcatcacacgaataaaaataaagtacagtagagtaaaattttggctaataatgactgttccctactcagagttggtagggtgaggatacaaaaagccatagaaaagtattgatactctataataaattacaaacatatcatttaatgttatttttaaaaatggagaatgaaagcagtgaacttagcttaacagtgaaattaatgtgcttatcttgacttttggaaggaaaatttgaaaggaatggttaagctgccacccagtataaaatggtcagccataagaggggctgaatgtagacccagaca

SEQ ID NO: 117594 - DNA, 1552 bp, Homo sapiens
tagaccttacttttcattgtaagtaaaaaatgttaatatgctcctgttaatgaatttgaatcctaaataggcaaatggataggacacaggccttgcccagagtttattcagatttatccttcaggaaagcatggccatctgtaatatttctcaccccttctttctggattttctcccactagaccctccctcaggagtgaagtactttttattaataatttggggaagggaaaggtgaagtgtctaaatgaaaaccaatgttgttctcactatccttactctacaatttatttgaatgcagaaaatctccaaattagccaaagtatccatttctaatacaggctttgtccttaatagaaatatgccaaaaacacgcatccctactcccacagtggtgtgccatattagtatttactctgggaagtgggaggagggtagttatgaaaggagctctggcgtggcaccttgaccacaggtgtacttcttacggcagatcagttgtaggaaaatgttaggaagtagaggatcggaaagttgttttcttaaactctccatgtcatgtacctctctcagaagttccttgggaactccagggcatacatatttcagtcttaataatgctgaggaagaagctgaagaccaagccaagaaccatgggtcaaggggtctgcagggagacagatggttcatcacagccaccacatgcgtccttctctaacactggctttaaggaaggaagggtggaagcgagtctgaccttctggagtcaggaaggttagagggttatagtccttagtcggctttttgagaattagtgacctagaacagtttttcttcttaagcttgaatagtattacagacatctagaaaggaaagacacttaaagatccttaattaagagacatttacttggtctgaatttatgaaaatggttctattctaaatgatcactgtaaagtgaagttttacctttaagtggctggtttttttttacgatcataaagtgattaacatataacttaacacactccacagaactcttgtacctcaaaatgagtctgagctcccccttggagaaacgctgagaactggttgtggtttagtttcctgtttccccttgggtgttatgggtgaggcttgggagctgcctctctattaggatgcctgtgtctgtgtggcccacattctgacccttccgtctgtgcaagaagaagcagggtgaagtcagtaaggcagccagcgccgacagcacaaccgagggcacacctgccgacggcttcacagtcctctccaccaagagcctcttccttggccagaaggtaggcagatgcgcggcctcagtctactcgagggccccaagggacaggtgggcacaggctacttccactggaaggctggggggatcccgggggccactcccagcctcgtgggtagacagagtgggctgtgagctttgggagtggcctcagggagggctagatgctggggaggccacaatgctgagggaggaccctggcagctggggaagggagacagtggtaaaaaagaagag

SEQ ID NO: 117595 - DNA, 1804 bp, Homo sapiens
aagtaacttctccaaaatcacacagcacagaaaccttagcagtcagaggaattggaccccagagcacttcatccacttggcatttcctttgtcttgaagcagccaccgtacacctcaggaagactggtaaatgcccggtccccaaggctggctcgatgaagacacagcctgaggggacagactctgcaacagtcatgggtgattgccagagacattcctgtggcctcgtatgggcagggaggacaggggtcctgcaagataggccttgaaggataggcagccctggacagggatgaggaaagtctagagcgcacaggcaggaggtgggtgtgagcacaggaggggcgaagtcccctggagtgacatgtgctggcccgccgggaaggggcggtctggtgcatgttagagctgctgctgtagcagtggcagagcaagcgaggtactgggcagagagctgccctgaggagccacagcaggcgtcggagagggcagtgcccagtcaggtatggggagcttgtgtcactcagtggcactgaggagggctggagagtgggaagctttttggccaatgtcctttcattgtccccttagcgaagaggaggtggaatcctaggtgttggagcttaggcaaatccttagacaagcagtcctcagcatcgggaatccacaccggcagacagcacagaggccaggctggtaaagacctcaggagctatagtgccctctcaggggcctccctttctatgacacactcacactgctctaaaaacagccatgaaaaaagaacctagaaagtcttcgcatgctcagaaccattttttgggagaagcaggattaagcaggctgggacagagtgtctgagggtaagggggcttgtgacctgtggtaccaaaggccagctggggcagccgatagcagaagtgcctgcagcttctcatctatccagtgttataattattttcattttgaaaggaaaatatgcagaagataaattcaaacagcacaaaagggagtagagcaaaacgtctccctctgaccaagtccctgattctgctcccagtgggcgaagctgctcccctgtcttgatgaacatgtgtagcccgattgcagacgtcgcctcctcccccaacacagtgcagcccacgaaactcactgttctgctcctcgctctttcgctttgagtccatctgggaaaccgtaccatgacagggctccttaaatgagtttcctctttacattatactcttcaaatcatttcatttcagcagacatcgctgattgttcaccccttcctgagatgaattaagaacaaatggctgtggttttccctatcaaaacaaacatacatattaaccatttccttgtaacttaattgagagtccttgacagcaagtgattggtgggtcagaggtcctgcccagctgccagccaggccttggagtagaacaggtttctcagggcctccccaggcaccttctccttcccagggccttgacttctactgcctgagccactggctctgcacgctctgctgtggtcagacaaaagccccagacctcattccaaggtagagatgcctgtgggggcgccctgggtgctgtgttccatcaaggcaggtctggcagcaccgaggttaatcgagttcaagtgcatttttcaaacatatgttaactgttaagcataacagcaaagagtaaactattggcagaggaaacaccaggttttctgttgcttttttcctccttttggcacaaatccatccatcgaaatcatccagttatagatagaggaaatcgaggcaaag

SEQ ID NO: 117596 - DNA, 2042 bp, Homo sapiens
gctaagccttatcagagtcctgtcctgtgaagcccacactttaacttttctctaaatagccttccgtgagactggttatcttaagagtttggcacaacctttaaaagagagaggagtatgtagaaaagtttttttgtaaagcaggcaggcagtaacttgctgttaaaatgtagcaagctgcacagttccttcagtgcatctcgggaagcgcatcaccgaatgggtttgcagaggtgaaatttcaatcccagactagcttccccaaaactgtttcttgcttgtggtaaatgacatttgtgtttgtgttttgtttcttcctgccactgaaaacataacaggagtaagacacatctgctggaacaaaatgcatggtttatgatttatttactatctcagttggtctgtctcttctgtttgcagtcccctagttcactgagagtggactgtaggttctttaatcatctggctcactttttgatatggtgttttatgaatggagagagatatttttcctgattggctagaatactagaacaggtctctgatccaagccaatcagagtgcagcttgtgaaccccagctctgtgagcaatggttgtctagtatatccacatgcctctggggacatgacagcgggtgacaccgttaatcatttggtgtgataggagtaaacggaagagggaagagaatgctgtaaacaggattagtgtcttgtccttcagaattaagtttctcaggttggcctttgtgattggagttgatgggaaggtgacaaatgcatgtggatatgcgggcatttatccagctgccagaatggatggcgtggttcttcctcatcagcagttatttgagcactgatagctcagactcctctatcctcaggggctggagatagggctctttgactagcaactccccagcagttctaatcaatattgcatgggatcaataggcatgtattcattgcttagataataaaatacttcatgattgactattccagcggtttcatgagtgccctgattgtttaaggggtttctgtgctgtagcttaaacaggagtcaatctcttatagatgtgaggaaggttaagtattttcctgcagtctatggtactgagccagaggcaggaggagaggtcactggaaccatagaactgtcacagagtcataaggcctcagtgtgccttatgcccagctatcagggcaattggagtgttcctttcctgagaatccccaaggtagctctacaagctccctgaattttgagtgtctgggctcctatagggattttgccaggtgtatgtacatgaatgtccaagagaaggtctctgattggtgtcccactagccatagctcccagtcctgtgggctttggaaatgctgccctctcctttctccctatccactgtcagtgccaactaatcagctaccttgtagctggcatgtgcatgtctaccgggtgccaggcagggtggtgggtgcttggagatacagtggtgagtagagcaaattggttcgtttcatcaagacagacaggtaaataggcaatgatgataccatgcactgagtgctaagaatgggatagctggtttcagaacttatatgtaaatgggatctagagtgactggcaatcatgatggaaggaagggctggaaactgcatttgcagagtactgtatataagactaagaaaaataattgagtatattaaagaataggggcagcctgagggagattgtgaggcacttttagctgggccctgggtctgcagctgccacatccattgagggaactgggagggagaaattcatcccggtggatctctggttgttgcaaatagagagatgtgttggaggtcaacagggcctgtgcacaaggttggagtctggacatgcagctgccccaaactagactgtgactgacagaaggcatggccatggcaggaatgcagaagagggagcacattgatggatcattgccagggaaggtattgggaccagtaggcaggattactccagacaaagggctagagagatgttcag

SEQ ID NO: 117597 - DNA, 1244 bp, Homo sapiens
ttttgttcaaaaaagaaacctggaaaccaacttctcttcgaaacgcatccccctgcccgcgcctgggcgcttttgtgggaaaaaagcggtgctggcgcctaccctggcgacccttcctggggcgggctcacgggccaggcccgaggccgcaggaggccccgcggcgctggctaggcagtctgggcctgggcacccgggagctgctgtgagcagagttgtacttggtgaggcccccgccggcccgcgagttgccggccccggcacaataagtcgggcccgagccccggggggccgaggtgtaggcgtctggctcgctatctgcagggaggggaaggcgggggctactcgcgggattgaagccgggctggtgcgggggaccgggttggggagtggtccaaggatgggctggagaggggccacgggaacccccgctgctcccgattgtctcggtatcagccttttgtttgctttgtggtaggaagggtttgctttttttaaaaggtaactccggaaggctgtaggcttccccgggtggagaaggccagcaggaaagagcctcgctgggggtggggtggagtggggaggtgagtgtgcaggatgctgctggcagtgtcacctgacaacaggtgtgcgacatggcgctccctacccccactcctgcaggggccacagatcactcaaggagttggtcagtacattgcttgaaaggttcttttagacaagatgttaggggaaatgtttctgagtttcaaagtgagagacttctgtacaaacaactgggacaaaccttgaattcaacaattacaatgactataaaggccttgtaagattttaatgacccagtaaacagcacataagaatagacaattagagggggcactcctgctagcttccctcttttcttccacctttgtggtttgaggttttaccgttaaagtagggggtaagggaagtgttttgttccaaagctccctgctccagggagtcgggcattttttaacagtcttaggtttgaatgggagactcgagttgtaaattaggtggaattcacctactgcaggccacctttaggctactagcctgttgtcagaggtgttaactctgaaatggacacctcttgcctgcaactggaattaatacccattgtacacatttaactagagttgggcagcagcatctcagtcttgcacaagagactctctgatgaggatgagtatgttttcaaacttattttttcttaaaca

SEQ ID NO: 117598 - DNA, 1037 bp, Homo sapiens
tgaagctgagcctgtgtgtccatgttccaacttcccaggacttcttccatggagaagcccctcaccgtcctgcgagtgagcctgtaccatcccacgctgggcccatctgcctttgccaatgtcccaccacggctgcagcatgataccagccctctgcttctcggacgggggcaggacgcccacctccagctgcagctccctcgcctctcccgccgtcacctgtccctggagccctacctggagaaaggcagtgccctgctggccttctgcctcaaggccctgagccgcaagggctgtgtgtgggtcaatgggctgacgctgaggtacctggagcaggtccccctgagcaccgtcaacagggtctccttctcaggcatccagatgctggttcgcgtagaagaaggcacatccctggaggcttttgtctgctatttccatgtcagcccttcacccctgatttacagacctgaggctgaggaaactgacgaatgggaaggcatctcccaggggcagcctccccctggttcagggtagcagatccaggttgcctggggtttctccacggcccttcccagacttgggacagccctctccagccaagacctggaggaggaacagaaatacagctccagagggaacccccagacagtgcactctgctagccctgccactagagcaagcctttgctagatgaaacaggatttgaaatacttgagctgcatcatgcaaggttgacaagcaaaacccactggctgccttgctcataatgaaccaattctgcaaacaccgaacaaacagcccaggggggagaagcaccctctgtggccagagctatgcaatgtaatgggaacatcatatacttttagaggccctgaggggttctggggagcctctctcagcatttccacacatttctccctgttgtctgactaggagttactttatgtggttcattttgtgtgctgcttaagagcaggagtttgaggttgcaccaggaatgcgtggacacatgtaacaattacatttgtggtagcttg

SEQ ID NO: 117599 - DNA, 1050 bp, Homo sapiens
tgcattatttgggcaaaatacaaagaaatatacaagcctaagtcaagtaagggaatgcctcccacccttgctattttctctaaatagagaggctgagtacagacgcggaaagaaacaaggaggtgtgggagcagcccgccatgctagagaaagactacattcctgccactaacagtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttacacatgtgttttttctccccagggtctacgaagaatagggtgaaaaacctcagaagggaaaactccaaaccagttgggagacttgtgcaaaggactttgcagattaaaaaaaaaaaaaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagc

SEQ ID NO: 117600 - DNA, 1050 bp, Homo sapiens
agctcctcaaatccaaggacagaggttttggcatgtgcaccttgctggcattagctttctccacctcctgatcccaggctcagagaggctgggagtcctctgacctttgttccccaaaagaggcctgagccctggagacaacacactgcatgaggttgggggtgggagagaccatcccagactctcaggactcccaggggaaaagtgagggctgctcactacatacagggttaggccctaacatggagtcagagaataaggggacaaccagaaccttccaaagagccagcttggaagtgagcacacaagtcggctcccttgagaggaggcaggaagccacagtctctcagggccctgacttagcccagggctactcacaggccacacaagaggcaacatgttattcaggctcctcaaccctccacctcatcctgctccgtttcagcatcaccaccaagagcgtgtccaggtaccgaggtcaggagcactgcctgcaccccaagctgcagagcaccaagcgcttcatcaagtggtacaacgcctggaacgagaagcgcaggtacgccccgcctctactcaccttccttcccaccagacccagctgtggctctcaggatgggaagggacccccccaccaggtcatctagccccatctaatatgtgaacacccaccacaacatccacagcaaacagatactcagacaatgcttacatacccccagggacaaggaactcaccacttaccaaagctagctatccatctcttgtccatttgcaagcatggcaggtttgtcattttgtaaactaaagtctgtctcactctaatatttgcattataatcttaattcctctttttatttcagttacgtaagttgttaaatggcagagtgagcactggcatggctgccaggggagctctgaggacttcagtggggtgaaatgtgaccacttaggtgactgtgtatgttggctataaaactgcgctataaaaccatgaggtgctgaggatgatccttgccagaaacatgttttcttctccaaggtgcccca

SEQ ID NO: 117601 - DNA, 1014 bp, Homo sapiens
aactcttgtatttgaaggcaagggggatccgctttcctgtctcctgctccatctgtccccattctaaaacagccaaaggctccacaaggcttcctctgcactgctcaggtgcacgccagtttggaatgaaaccaactctcagccaattaaatggcgtacgggagcgttgatataattccgagagtaaggacttgtggacagttttccctttggttgttcacttcttttgcattgtgtttgagtgtacagatgtggagccacagctggtttcctcctttctgtgagggccctttgatagccagtcaactgagttttccattgttatttttcacaggtctaatagctgttggcaaccactttgtgttattttgttcacataattattcactgagcatgaaatacccctgaacaaccatcagcgtctcagctgtggccttgctagctggcgtcaccactagaaagtggttaaaaccttgaggacgaaatggggatttttttctaataagattgattcagccactaagcgcaaagcctgacacatgtgttgagttcgaattcactctgagttgctgtgacatggttgcgcaagtgccctgagttctgccaagtctgtgatcataacccttcttagaaaagtgtttttagggaagacaggtcagcctggtctctgctgctcatgattgaaattgagggcagagactactggaccccacatgaaacctcttccttcctgcctggggcttgtccttcagtggctcatgttttactagcagctgcttcatagttccagcactcaggaaagcatagatacccaaaagagaaaactcagagactttaatctgctctctgcctgtgtaggctcatgtgctgtttggagagaatgtagaacttctccctttatctcataacttgaactacaattgctggcagtgaagttcagggccaagggaggagtaaagagaatagggccaagggattgcattgatgggcatgaccaggcaataagatggccac

SEQ ID NO: 117602 - DNA, 1045 bp, Homo sapiens
ggttatgaaatgttcaacatgatcagcttcttccttgctcatttcaggcccaaaacccacattacctcctttcataacctttaatatccctcggaaaccctctccctttacattctccatctcttccctggaacatctccagaagggttcgtgattgggttacatacaagtttccgaggctgtaacttcctttcagtcataaatcacctcttacacactcactttttccttctcattgttcttctgtattaatagccccaaatcctgggagcatttgagaactgttccaattttggtttgaaaatcaatttggaagctaatggttggctttgcttagacctccaattcctctgggaaggccagttcctacaaattggccaagccagggattgggggcttctcttaaatgccggatactttggtctcagtgtttttcttctactctgtccctaaaattaaaaagttaattctgggtgggggtgggggagtagagggaacttaatgccttctgttgtatgagttggtagataatttttaaaatggttcatttcatggtaggtcaaattctattacgaaagaaatataaaaatgaaattaccttgtgtttgttaaaaggctctgatgttcttctcatttttttggaaacatctttctcctaaataagttctgcttcctccataggctgctgacctccctcggggaaagtgagaaagtgtcagattcatcaaatgttaatggggcggggctccccaccagatgggagcagcgaccctcggctggttgacaggcctgccctcaacatcagccagctgggatatgcattcagggataaaggaaacagactcttgggtgggtttcttcaggaagacaaaagaggaacctctcacatacagcatattgacttatctggtctgtaccccaaaccagagcaagaaatggaactgatattgtgcaaacctagaggctaacaccaggccagaaaagattcagccaagggcaccatggccagccttctagagagcctgctacataaaggaaaaaaggc

SEQ ID NO: 117603 - DNA, 1036 bp, Homo sapiens
ttttcatgcaaatttgacttgctaatttccacccccaaaatcctgttgacattttgattaggattacaatgaatttatggatgaatttgtgataaaatttagataattttcagtcatgttttagtctgttttcatactgctttgaaaaaatacctgagactgggtaatttataaagaaaaagtggtttaatggactcacagttccacatggctgggaagacctcacaatcatggtggaaggcaaaggaagagcaaaggcacatcttacatagtgtcaggcaagagagtgtgtgaaggggaactgccttttataaaaccatcagatctcatgagacttattcacaatcacaagaacagcatgggaaaaacccacccccatgattcaattatctcccaccaggtccctcccatgacacgtggagattgtgggaactacgtttcatgatgtgatttgggtggggacacagccaaaccatatcaagtcattatttctttaagcaattttttgtccatcctctctctcttcttctgaaactccaattatatgtatcctaggccatttgaagttgtctcacagcccattgattttccctatagtttttctctctttttcctctctgtgtttcattttctttttctttttttctttcctttttttgagatggagtttcgctctagttggcaaggatagagtgcaattgcacgatcttggctcaccgcaacctctgcctcccatgttcaagtgattctcctgcctcagcctcctgagtggccgggattacaggcatgcccggctaattttgtatctttagtagagatggggtttctccatgttggtcaggctggtctcaaactctgacctcaggtgatctgcccacctcggcctcccaaagtgctgggattgcaggcgtgagccactgtgcccagctgtgtttcatttataatagtttctatttctgtcttcaagttcactattttcttttcttcagcagtgtctaattttctgttaacttcatccaatgtatttttcatttca

SEQ ID NO: 117604 - DNA, 1088 bp, Homo sapiens
ttgtggggaggagagggtactccaaaagaagtactcaagctttgtgctcagaccgcatctgccccttgcacttggggcaaacctgcccttccacaaagcattctagacatgactgaggagcacatgaagtatgtttacctgttcccttcttcagactccgtttccctccagtgcccctgtgtctcactctgcaaagcaactatgcatgcatagaccatcctccatagccaccattcagggaggctctgtatgccagaacttgcccagtctcaggcacccaccccatcaaaacttatccatcctatgttccccttctgccaaattctgcaatcagctgatctgataaaccaacttatattttgggtttaacgaacagtgatcgctcagcattaacctaagaacttgctatgcaatatatgttccccaggccagtagcagtgccatcacctgagagcttgttggaaatgcagaatctcaggcccagcccagaccttctgaattgcaacctgcattttaacaagatccccaggagattcaaatgcacattaaattctgagaagcactcacctaatatatattttgctcttttcagcagtataatggctttcaacgctaggcatttcgtgttaatgatgctagtagtttggtatttcatacttttacgaaactttttcacaactatgaacttgtgtggttatcagagcagctagactgagttctcagaggcaccaggggcccttctgaggcctcccagcagccctgatgaggcttgtcattggaaaattgtttagtagctgaacaaatgaataaacgtagaacctccaaaagagacaggacacgggacattatgtattttgcaagtgaagaaactaaggctcaaataggtcaagactggctctttatagcttataagtagcagtaccgatgctccaacctcaggcttccaactttgcatctccaagtgactgaagttagttcttagggtgaggaggcgttttgaagctctgtagcagacagatttgagtgttcctccctcccccatcatatttcaaattctacaacgaggtttgaatttgtgtggaatgaca

SEQ ID NO: 117605 - DNA, 1035 bp, Homo sapiens
tcctcctctaggaggctaggagaggttggggctccggattcagcgtcacagttctgacacatctgagaaaagaaggacgttccatctgttactgcatcctgaattcctaaccacaccagctctgtccccagtccctgcctacattggagtccagaggggtcttacaaagcccaaacctgactgtggttctcctctgtgaaaagccagcaatgggcctcaaccatggctagattgctcaagcactcagggcttcttgccattcctaagtcacaccaaacttgtccttcccttagagcctgtgccaagatctgctcctggactctcagctcagaagagccttcccagccccagcctccctgcagggtgactccagatcatttcatcactggcatgctcttcctgggctgtgtggtctgcctgcttcatgtgtggggtggtcttatctgtcttatctgtctggtgcctctcgttcacaataggaactcaactgacactttttcaactagtctgctggctctcagtccaactcatattcccttcactctgtccagtccagccacacaggccttctcttgatccatctcacttgccaagcatcctcctgccacaggggctctgcatgggctaatgcttctgcccagagtctcttccttctcctttctcctaggtggtgacttcctcagcgcttggttaaggtcacttccctaatgtccctggcttagtggcatcaccttcttcatgactgccaccaccctcatacccctcattcagagcacccgttcctctgctgtgaaatatttgactgtgtggtttcttgattaatatctctcatcctgttagttacaaattccaccaaggcaaggcccatctgtctagatcacttctgtgtcccgaaggcctagaaaaaccctggcatatggtagacaccaagtattggaagaaaggaaagaagggtgggagggaaggaaagaggcagacaaaaagagaacaccttggccaggaacgaagtctttatcagactccatggtgatagga

SEQ ID NO: 117606 - DNA, 1053 bp, Homo sapiens
tcacttaccacagcagctgctagagtcttgctcagtgaaaatgtgttcaagggagaaggtttgaaggttgtattagttcgttttcatgctgctgttaaagacatacctgagactgggtaatttatacagaaaaagaggtttaatggactcacagttccacgtggctggggaggcctcacaatcatggtggaaggtgaaatgcatgtcttacacggtggcagacaagagagaatgtgagccaagcaaaagagatttccccttataaaatcatcagatctcatgagagttattcattaccacgagaacagtatgggggaaggtaccaccatgattcgattatctcccacccggtccctcccacaacacgtgggaattatgggagctacagttcaagatgggatttgggtggggacgcagccaaaccatatcaaggattttccaaaaatatgcaactaccctagctggggagggggtgcatagtggtttaggtaggacaagtacttagggctgggctgcctgtgttcaagtgctggctctcctacccactagctttgtcaccactccaacaaacttcttcacctctccagccttgccttcttcatctggaaaacagaaaagagaacagtactcaacccataagagtattttaaggatggaatgacttaacacataaaggtattgagaatagtacctgacattggtaaactcttatttttctttaataagccagtattctacgtgggcacatgcatgcactgttttttttttcctactgtttttttttttccttctgctttcttccctgcatcattctcaaacgtatagcctttcctaaacatagcctcatctggaggaagcttggaggctaattcttgcttttgttgtctttagaagcagaaatcattctaaacatttgtatcttaactacagagcactatgtggtttatgtagagcacagcattcaccccattcctgtcccagtgaaatatgaggagtcccatggatggaagactgaggaagaaaatgctgggaaagactggggaagggtgtgtt

SEQ ID NO: 117607 - DNA, 1048 bp, Homo sapiens
gctattgaaggggtctggggacagactcaatcacagaggcctttcagaagatctgcctgctgtgcatgggcaaagagggccacttgctgacctcagagcatgtgctttctcagtagtgcccaagctgtcccatggtcactgacccagttagaatgactgaatggactttggcttgtgtctcattaggaatcctagccccattctagtcttccagtgagatctgtccatgagtgaaggaatctcacaggaaaaaacaaaatgcttctatgggtgtggttgctggccttatctacaccacagaagccatcacacagactgtctttcttcccattgttagaatgtgccctgaccaagcagcccacagggcctgggacagaggctgatctctgcctaactgagctcacctctcctccctctcctcctgactggttagattttctaggtgactgttcccctgatgacacaagcccgctgggccccagcagtgtttagaggggttgttgactcacgagatgacattcctgctgatgtgtgtcatgccctggggtggatgaatgataaatgaaaacagcgcttttaacttttgaacccactttctccttccttgtagccaagacactatttgaattggctgcagagtctgatgtgtccacagccattgaccttttcagacaagccggcctcggcaatcatctctctggaagtgagcggttgaccctcctggctcccctgaattctgtattcaaaggtaacatggggaaggcatccctgttagattgtccctggaggcagcttccccacccctgtcacctccacaacactctccgatttacagcaccccatgggacattagaacttccactcagctcaaccaaaagcagatgtgacttcagcagaaacttcagaggctctgttgtttcattaggcagtgcagagaatgcctttggggagccgttcctcagaactcaagacttgacatctgggaggcagccgttcctcagaactcaagacttgacatctgggagagcagagcattcccttgcctttc

SEQ ID NO: 117608 - DNA, 1009 bp, Homo sapiens
cgctttgtgtttcaaagataaggatccgcgcttatcggtgggaattacactctgggcagttgtgaccggctactgcaatcagctggtagttagacctggtttctgccacttgccatgtcagttttcaccactgcaaggatttcttctacttcatgtaaacttctctgtgctgcaaagagaatgccaaagcagcgtctttttgccttcaccatattcagccgctggccgggtcctatacttcaatatcagggctcaaattaatattccagtctcttcccctccccttttcccctctcctcctttcagctgctgttactacgtggagtttggagcctaagctttgaaaactcccatgtggcgcgcccgtcttaagtctgagcatgctcagtagccaaaacagatttttggttgcagaactcgggcgaggatacttggggtatttggacgtttgccggcttcccaacagaatgttccggttctggtggtgatggcattggagaatggggcttaggcaagcctgtaggtgaggaatggctgaacaccctgagccagatgtttatcttgattgtaaagacaatgtttcctgaccagctggagctttggggggggggggggggtgttgcggggggagggagcaattttggttgcttgtgcatttaaatgggtgtggcgctaagtatatcttgtttaccttatctttctgtggaaaagttttgatgtctaggtttgtcacatcatgcctgttgcctagcactaccaaaagggttgttatctagcagcaaagattgaataggtggaggtcgtggcttggcctcacagaagttgagaggaaagggtacttgggttgcgtttttgaaaattcgtatttaaaactagagtacttgaatttccttagagtacctgaattgcccagagtgaattagtttttaattttaatttgaaagacaaaagattgaaaaccttagtcccagtaggtttagtaacattccaaatagcttacaatttctgc

SEQ ID NO: 117609 - DNA, 1019 bp, Homo sapiens
atacataggaggtagagcaacctggttttgcctctggttatcatttgacattgccagtgtcttacttgttcatattatggggaaggaatcgagtggtcacagaacttttggagaaaatttatcaattttttgtttactttgtaatgcttttctgttcttatttaataaaatatgcctttcgattatattaatttaaatttgtatatattgaattgatttaaactaggatcctttccccctttctctttcaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccaggtaggtcttattcctgagaagaatttggaaaaacaaaaacaaaaaacctctcttcctgatatgcatgtaactagatttagtaatgaaaaggttgtattagctttgtgtttccatcttaaatattctaatcttggaagggctattggattttgagtttagctttttatatgtaggtgatacaattctcaggtggctt

SEQ ID NO: 117610 - DNA, 1056 bp, Homo sapiens
tgacagattgccacaaacttagtggcttagcacaatgcatgtttattacctcacagtttctttgggtgaggagtccagtcacatttagctgggtcctttgcaaggcgctgtaatcaaggtgttggttagggccaaggtcttatcagaagctcaattagggaaggatctgcttccaagcccatgtgattgttgacagatttagttgctttcacatagccttctttataggtagttcacattcatgacagcttcttcaaagccagtaaggaagagagggtcttctggtaagaaggacattatattcttgtggaatgtaatcatacatacgctgtcacctttgccatattctgttggttagaaggaagtgataggtcatactcatactcaagcagggagaattacccaatggtttgaatacctggaggtgggaatcacagtggttaccttagagtctatctgggtttcacgtggagatgtgtggtaaaaagactgaaaataacattggatgtggagactagtagaaaggatagcagatagcagtgattatgctgtctgtgaaagttcaacttaagagctttagagtgtctttagacagttggtatgatatgattctcagtttcttactgagtccaaggaaagctgatagctgaaggaactgatgaagaaaggaagataaaaggatttaatagagaagtataggctgaaaaactcccaagcttgctatttgctaggagggagtctaggaattttatgtattcccctatagccaaagtgtgactagtagtcagccagccaatagaaatgtcttattttttgtatacatttttctcagctatgattcattctatagaaaagactggggcatagctctgatacttttaaataacggaaaatttcatgtcttactagttcaactattggaaagagactatagagacctcatgtttcgccctgagcccaaactcttgggggaaggggcagattacccagctagattagcttgctgaccccccatgattaagcagctatgacgcagaatggatcacttcatattac

SEQ ID NO: 117611 - DNA, 3950 bp, Homo sapiens
gtaatatgtaatgaaataattatacatttcaccataatgtcaaattagtgggagccctgagcttgtttacctgcagctaggttgtctcatccaggcatgatgggagacagtgacagatcatcaggcattagattctcataaggagcgcacaacctagatccctcatatgtgcagttggcgataggatttgctttcctatgagaatctcatgctgctactgatctgacaggaggcggagttcaggcggtagtgagagcaatggggagtggctggaaatacagatgaagcttcgctcactctctctcaccatcacctcctgctgtatggcctggttcataagagagcatgaactgggggggttagggacccctgatctaatagacagtattgtctattgattaagactgtgggttctggagccaggctttctggatttgaatcctggttttaccaaatactacctcaagccttaacctttctgagatttagtttcctcattgtaaaatggtaataatactacctacctaataggttgttatgagcattagatgagttggtgccttaaaaagtacttgttaaaacattaagtggcctggaatcagtttcaaattaaatatcaattctaatagaataatatattctggaaatagagcattgaggaagatggcagagagaaaattttccaagaaataatatcaaacacttccccaaactgaaaattgaaagggctcagtgaccaagtaatcagaacaaaggataaaaaaagccccacatgaaatttttgtatatcatagattaaaaaaaagattctgaaaactttccagaaaagaaagacaggaaacatataaaggactagaaatcagaatactggatttctcaatgcagttctggattctagaagaaagtaaagtagtgctgtcaaaattcagaaggaaatgttatctgcctgccgacaagcaaaaaaaataaatttttatacatgcaggaagtcaagaaaattcaactttttactttctcttaggacactaatagaggatgaggtccaggaaatgtgatccagcagtagagaagggaagtccaaggacttcagacttgtaggagacttgagcagtaaccaatataggttggaaccaaaagttggaagatctgggcctggcacggtggctcacgcctgtaatcccagcactttgggaggccgaggtgggcagatcacgaggtcaggagatcgagacaatcctggctaatacggtgaaaccccgtctctactaaaaatacaaaaaattagccaggcgtggtggtcagcgcctgtagtctcagctactcgggaggctgaggcaggagaatggcgtgaacccgggaggtggagcttgcagtgagccgagatggcgccagtgcactccagcctgggcgacagagcgagactccatctcaaaaaaaaaaagatggaagatccaagggaaaacgtagagtgaataaattatttgattatttgttgtatccaagaaatagtaatgataggcgtttaacagatctgttggaattctggaaatattagtggaatgtacttaaaattaaacaaatgaagaaacaaggcaatggttaactttagtaaaaacattgttcaagaaaaagtagactcatagtacacttgattcagcaatgaattacatgtatgtatatatgaatactggatattgatttaagcaaaatgttatatttaactctattttggggatgggagtgggatagaataataaaagaatgctgcctcatttgccctaagagcaagtctacaaataatatcttgactaataatagcaatataagcatattatttagcagtacacaaagtaaatgttataagagatggctaagagtttaaatttgttttctatagaaacagtatatgggagggggctaggaattgcagtttttgttataatctctaatagcatgtctttttttaaactgtccacatattaacattattttggatgatataaaataattttttaaaaatcgtgcatagataatgtacaagtgaaagagaagccagtgattttagcatacctctaaagaaaaaaaaaagcaaattcttactgaactgaattcctgagtagttatttcactaagtctctcagattgctagcctgctaaatgtagaaattcttgctgcctaatgcccttctctccaatggcagctgcctcttgttctgcgaggggaatagcagttgttaacacacagtagaacaaaacgattgtagtcagatgttaaccacatatttagtatactaatgcagtagaatgaaatgaaacaatagacaaaaatagcacaaatactgacttaacagaaacactggattgttgtgtacatccctacttcagggaggtgaagtgtgacttaggtagcttaaaaacaaactcattttgttgatgctgaatgatatcagaattaagttgagatttttctaagtgaaactacattgacagatacaggacaattgttaatgagatgagttgtaaatgtttgaagaatcaggtttgtttcagtttcctgcatggaaaggtaatcagatatttgaatgtgattggtcacttgggtctttagagaaagcgaatatttgaataaagtttatctcttaaaaatgtatctgttaaaaatgtttagactttgttgtgtatattttcattatggtcatatttagaagactgattttgattggaaggcttttacctagagaatattaccatattcaatatggaaaaccgtactgaacaacgtaaaacatgagatctttcaaactaagaaagatcaaagtgttcataattggaaatgtggaagtttttagggcattcacataacagattccaacttcactctgtagtcttaactccttgttcagtgcgtaggccaactgattttctcatctcctctgccaccctccccttctacctcttcccagccctagtactcccatgtgaaatcctcctgtatctttaaggttcagtcaggtatgtttttttcttacagtattttgtttgattctctgctagctgggagcgctcacctctgtttaactcctattgtgttaaattctctgttttatggttgttttttaatatcctttatctcatagaacaggagtggtatctttctctggattttctgtcttccagggtaccttatgcaggctaaatgcttacagagttttggattcagtttttatgtaaatagagattcagggctctataaaacagccctttctaaaagtaaattgttttaataggtttacagtcttacatgaatcctttctaccaaccccttagtgtggatggggcatttgtttagtcattcctgacaaatgacttttgatttttgtttttcagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccaggtaagactttattttattgataccaaaaaaaaaaaaattcctaagaatcacagttgttcttactgtgggccctctgggtgaactgttacatgccaaggtataatagctgtttctgactctttattctttaggtaattgtttgatttccagaagagtttagattttattttgccaattaccgtatgtttaaaaaatggaagtagccctatttgacttaaatattttcttctattttatgacactcagtaccatttattgtcttttatataactgatactgtgatgaaagctatggcattcaatttaatcttc

SEQ ID NO: 117612 - DNA, 3159 bp, Homo sapiens
gtatctcagatcagaaatatttgttttaattatgagatactgtactgtgttacctttctaagattaaaaaaaattatgaactataactggctctaagggtttcttttaagggaattatatattattttagaattcatgaatctttaaataatgtagctgttgtcttttaatttcatggtgaatactaagactggttttgtgatagttattctctttatgtaacttctacatatctctactgttaaaagctatctttttcttatggtaaaattggtttagagtggttgacagtttaaagagggatttgtgatgatatctgttcattttcatagggttggggagcagaatatcaccggcaggatgtaaccagcaccccatgttggattgagattatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaag

SEQ ID NO: 117613 - DNA, 2190 bp, Homo sapiens
ataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagct

SEQ ID NO: 117614 - DNA, 1073 bp, Homo sapiens
aggtgcctcacctgggtgagaagttggagaggtataccccatatcctcatccagattatcactgaagatattaggtagagaccacagataaaggatggggaaaatggaccccttaagagctgtgtctatctcagagttccccagctttttctaacattcttgaaaccttgctgggatacacaagacctggtatcccttgccctctcttcagtctcccctctcctcatctattctcctccctgcagtcattctccatctcccatcacctctcatcaccagctcagtcaggacacagtgacaagaaacaatgtgatgactacctaaggctgtctcctggatatgccaaaatatcccaaggtcctggttgggaaatggggctccaagatgctaacaccatttgctaaaatgtcaaaaacttcaaactagctatttaatatcatataaataaaaaagagacatggtttaattcagttttttactgaatttatataaaaatgttttatttgtccttacattttatctctatctctatcaccttcagtgccctatagaatgccactgcattctataactagcacatctgtctattgccaaaaataatctacagtccctatttttgtaagtaataaacattatacagaaatgttattgtaaaatatttgtgggcctattgtcagataaacatctctttatatttctgaagttattcctagtgtcatatgacaatatgcagatgaattctaacacaagcagggactcctaatgcttggatattttttaaaacctagatttttaaaaaagataaaaactaatactttattttaataaatgggttctatagcatcagaatcataataatgttatgctaataactacagtaattaaagtggatgattaacatactgaagcacattaaaagaacattatcaaaccatctgatttataaatgttgtgctgaacatatgtgactaggaaaattctacttagagaaggccctgtaattgatcttctgttgaaccaacagtctatctcctgggtaacatttcactctaggactcctgaatgaggcagaa

SEQ ID NO: 117615 - DNA, 1256 bp, Homo sapiens
gcggcatccttgcacgatactttgtgagacagtttggaattgaccgaaagtgctgaatgatctgaacaagggagtggttcctgaggttggaaaatccagaaaaagcttcagaaggagttgcaattgagtttggaggtggggaatgatttgttggtgaaagggataggtgtggaggaggtggtccacctggaccatctttctcctcggtgccctcattgacatttggcagctgatgcaggtggagctctggtgctttgtgctggctgagcaaaaatctactattcacgtgcacacatcttccctgcaggtcggggtctggaactcatttatcttggccctatgttctcttctgtactttgtcagaagtcagtacaggcttattccatgggagggagaggggcacaaggtgcgaagcaagagttcatctttctccaatttcaaaaggatcactaagtcaggcctcaggctcctgtggtcccttggctcacaaacagctcctcagagctgcactgtgaagttcataggggctcaacaggacactgcatttcattttgcagcagcctggaaagtgagcaacacacaggcatgagccaccactcagactctgcccatgcaagcaccctgaagtggatattttaatcaattaatatgcgaattctctttttgctccaggtttcttcacaatcaccccagaactttcaacaggcaatttgctcttaatcagaagtcactaccacatctcatgtgattctccaaataaatccacctcacctcttctaggtgccagatactgggctaggtgttgggaggagggtcatacaaaaacagcaaggcaggtgcacacacaggtgggcataatcagttcaactacaataagggaacagtgatgaggcacagcacgcttaattgccaagtgaattatgctgacaatcaatactctagggttcaaaagaggaaggcaagtgttgtcagagaaggatttacagagcatgcaagaactgaggagagatttggatcatgggaaagctttaaactactccaaaaggaagttagaggatgcactagacaggctgagcaaatactcagaggggcaatgtgcactccatgtttagcaggcaatgggcaaactggtttgacaagaaggggttactttttggtgggggaagattagagatcaaacatcgttaacaataacaacagtaatgatgatggacatttattgaacaccatccttgtcaaaccctgtacttagtgca

SEQ ID NO: 117616 - DNA, 1080 bp, Homo sapiens
aaccagtctttcaggttaaattttaaagtgccttggccaaggagggtgtccattcagatggttgtagggacactttgaattttatttttggtttacaaggatctggcctgagaccctgcctgaaaggaaccagatgtaggttagtcagtcccatgtctggggccaactcagacaatctgcagcaccagaggttcttacaagacacagcctcaggtatctgagggactttatggggaggtaggtactaagtgaggtctgagacaaactttccaagatacagttctccaaaacttgggttgagaggccaggatggcaaaagagccaagggcatgggctttgatgccagacacacctggatttacctcctgactatgacatttatcaaccatgtgatctggtgagttactttcctgagtctcagtttccctggctataggccagaaatgattttaaactgcctgccttttgaaactttggtgagaatagtgcttggcataaagtaagtgcaaattaaacagtacctaacatgatacagtcatctaacaaacacttatgtgattcttactatgtatcaggcacttttctaagcactttgcagatattacctcatttaatcttctaagcaaacttatgaggtaggtaattggattgtctttgttttctgtaggtagaaactgaggcacagagaggtgaaataatttgttcaagaaccccacagctagcaagtggattcaaacccaggcattctggctccatattagtctatgcagcctcatgatcataatgatgttctataaatgacaatggcaagggccgtgaggaggtataaatataatgcaaaaggccccacatccctagccaaaatgttgctagcatttactgtggcaagtcttgtgttcctttagggacagaattaatccacatttctgtgatcaaatacatgatcccctgcagacctagctacccctgcccctgatttctttttaagaaactatttttcttgaatggtggttcagaaaacagaacaccatgggcttggtttgtgcatttcaccttgttttcaaacttatttgcttgtgg

SEQ ID NO: 117617 - DNA, 1047 bp, Homo sapiens
tcaggattcagttctttcagagaatatagtgatttttttttctattctcattctatgctcttgtcagttggaattcagtgaaatcataactaatcactgaaactattttataaaaatttcttttcatctgaaactaagtgactgagcctattatacgctttattcttgattgactttattcttttctgttagaaattatatttaggtatgcatttctacaaattgattacaccgaatattgctcattttactacttaacttttagtttggatttaatttttaaattcaataatgttattttgctctatttgtactataggtttgtattatagtttgtctaatgacagtagtaatataatattttattcatgaatgcatgttaataaaaatgtatattatatacataagtatataatagtatgtgtgttgttcacacatggccccagttggtcatgtggataactgaggctttggaaacacggctctagttgagatatacttcattcaaggccaagatacatttttcttcctttaggaagccttccctgacaagtcaaaccagcatccagttctccttctttttaggactcttaattgtgtttatcttttttgtttatcagtcttaaaaagctcttggttttactcttttcgttaattgacagacacttcacttacagtgttgacctgtgtgccagtagcagggtggtggaagtggtctgctgtaggtgcaggcaataagaggtgcgttgactttagtgaatataaaaacatcagcaaaaccctctgggcatggtaataatgcgtatacctccaacactttgggaggccgaggcaagcagatcacctgaggtcaggggttcgagatcagcctggccgacatggtgaaaccccatctctactaaaaatacaaaaattagctggcatggtggcagaccagtagcctgtaatcccagctactcaggagactgaggcaggagaatcacttgaactcgggaggcagaggttgcagtgagcagagatcacgccactgcactccaggctgggcaa

SEQ ID NO: 117618 - DNA, 1033 bp, Homo sapiens
tagagagtcacagctccagtgctggaaagagtcacccgaattgcaaaaggaggcctcgctgcccatctcataacaaggatgcttcctagggccttctcaagtaaaataagagtggaaactggctttggatcaccttatgtggactgcagaagctcagctcagactagaaaatagtgctcctttggccacactgcttatttgttaatttttaaatttgtagattgcacaaagatctaaaactgttgtaattcactgtgctccattcacaatcattgtcttccttgcctacactcaaaactgtcaccattatctttgaagtacttcttcctctaactttgcccatccatcaacccagtttccaaaaggccattttatagaccaactcatcacaatcaactgagtagctttgtagatctactgatcccaggccctcatctggtaatcaaagagattcttattcaataactctgtggtggagctaaagaatattttaagaatattgccccacaatatcaaatgcattggcaaggtctcccgggagggaatcttggtgcctgggacaatggcgtagtggtgcaggggatccttttcactgcatacctttttcagtattttagatttgtatccagcgaatgttttacttatttctacaaaacagaattcacaatgaatgcataaataaacaaatgcataaaaacatgttcccttggtgattctgctgcacagccaggtttgagaatcactgcattaactcatcacaagggaaaaaaataaattcaaattgattagcccatttaccaatcttccagtgtagacatctgccttgtatccccagtgattaatacacggcctgcctggagggtaagcaataaatatttgttgaatttaaatcagtcttcatctgtcctttacaacagactgaggtgaacatcatctcttgaggttgagttctgtatgtatttttatatgccccctgcaaagctaggggccacagcaccatatcttgtgtgataaattccagtttctaagtgtc

SEQ ID NO: 117619 - DNA, 1049 bp, Homo sapiens
caaattatctagacatttcaaattaaaatcacaagtgtgttaccaaataaacagttaaaatcaaaataacaactctaatgggtcagatggacttaactgtttcatataccttaaatagatggttacttatcagtatgccccaagacttgacttgatactctcagcctttagggcaggcaagtggggcttgaggtggccagaatccatggggctcttggcatcctgccaagaacagcttcatatagggctccaaatccctctggagagtaaccctagtattcctttgtaatattatttattctatgacatggtaaatgttggcaagcactaccataaatgacaaacacacaaattgttatgattgcaaaaccttccaaagcaaaatttgttcataccttgggtgtggcttatgtattttaccagctgagggcttatttccaattttcccagggtacaaagacacttccccatataaggagagcagatttgccatttctggccaactgaggtcaccagtgtaagacctagggtactgatggatttggctacacgtccagaataattctacctgagccttagatttaaaagctgaggcttgttttatattcaggctgtggcttctttctcagctcttaaaaagactgtaatctgtctcacagttgtactgcctgattgttagttggctctattcaccctacctagatggtaactaaccctttcctgacactttgaaaattctttcattcccttggttttagttacctctctcgcacgcacaccatcattattctactgttctttatttatatatagcgttaggacagctttaatattacatttaagcccttgatgacgcgattattatctatcttcttcactagactgtgaattgcattagggccaagactgtgtctgcctttttctcaccatcttatccctaccatgcagtacaggatagctacatgataaatttaccagtgagcaaatgaagaatgaattattgcccagggaaggtgtggaatccactacaatagaaatcatatagataa

SEQ ID NO: 117620 - DNA, 1038 bp, Homo sapiens
gagagttctcccctaaagtatttctttattaatatattctgcttgtaaggcagcacagagccaggggacagatgaaagagaatacctccctaagggtaactgtttctcttctgtggctgagagggccaggaaagcttgggctcatttggatgttttcatgatggagaaagtaatgttgtcccactggtctcagcctctttttgagccttccttggtgagacccaagatagacgtttgaatttgccttctgtggaattcagctttctcagctgtagttggcttttcttggaaattgttgcatttctctctctctctctctctctctgtgtgtgtgtgtgtgtgtgtgtgtatgcttatgttttaaaatctaggagtgatttgtaatggagtggaatgaatggggtatgagcgtttatctatctggctctttataagctatgttgtcttttccagggcaaataaatgatgaagatttcaaatctaaatgtgatcatggtgacttcaggaatattgtgtttaaaggctctttaggaggtttaagtcaggatgtggaaggacgttgtaaaccatgaaacactgtgattacaaataatctccagttattattcttgatttctaaaaagctaatctcattgcagttaggcctgattcatttagttataaatgcagtaagaaaagttaactaatatacataagcctctttgtagtctggtcagaaaatctaaagccatgtggtgttaagcaactacgtagcccagaaaattaacttctgtctggagatttcttaaaaatcttaggaaatttcagaagcctctcttattctaggtatattgtttattgcttttattctgaggctagacattgccatgttgccagccgggtgtggtggctcacacctgtaatcccagcactttgggagaccaaggtgagtggatagctggaggtcaggagttcaaggccagcctggccaacatgacgaaaacccatctctaccaaaaatacaaaaatcagtcaggtgtggtggctggtgcctgtaat

SEQ ID NO: 117621 - DNA, 1007 bp, Homo sapiens
acaggcaacacaacaagaaaatagtttattgtgtgggtgaggttggttgggattcactttgaggaataggaggtgtgaaagatgaggaggggtgaggactttacgttttcagtggcttagtgatataattcattggtttgcagtgcgtggccctcagacagctgtgtggtctttacctgagaacttgttagaaatgcaaattctccatcctcacctcagaccctgctgcattagagactttgggtgtgggggccagcaatctatgttgaaacaagccctctggttgattctgatgcaagctcaagtttaagaaaatgctggtaaggtggaaagaagctgagactccgctttctggtgttgctatgccatcagctggtgtgtagggtatgtcccagacttctctgggtctgtagaataggagtgttgctacctaacttgctgaattggtggaagaatcagtgagctaatacaggcaagtgtgatttgtacagttttagcccaagtaatccagcttggaacatttgtttgctctgatcttcgtggactagtaaatatccctggtactccctcttatgatgtgcctttgaggctactttcatttacttcctttctccgtagcataatacagcctgttcctgaatactgaagccatccgtgtgtcctcttgaggctctcttggaaagattcagcttcccaagcctctgcacacaggggcaagcagctcgtgttggcaggcagtggggaggatgtagctgagggagcattcagggaggctgtgcagtggggcttcccccacttctatgaacggactcagacatgccattgactgttaaaaaaaatcctgatttcaatgttaaaatgtgagaagtaatattaaaaaactagtacgtgctgagcatttcatacatcattactttcaagcttcataactgctctgtggagttgaggctatctattattgtacctatcttacaggaaaggaaatggaggctcaattaagtcagttt

SEQ ID NO: 117622 - DNA, 1050 bp, Homo sapiens
cagacactctcatttgtttatacacaattttcctgagcttgttaagcatctttatggtggctattttgaattgtttatgagataattcatataactctttttctttaggaccaatttctggatatttattttgtaactttgactgggctgtgtttccccattactttgtgagccttataattttgtgttgggatttgcacatttgaaaacacaaccactttccccagtccttatggtttttcttatagggaaagaccttcagcaatcagcccagctagagattccaagcgtctcttaaccttttggggagagaaatcttttctaggcttgtgtgtgtaatttcccatttagagagatttgctggtctctttttcaggcgcttgtagcctcttgctccctctggtgtctgtatgaggtatttcaggttttctggcgctttttctggcattgagctcttttctgttctctggctcccaggtatccaaagttttctaagtctgtcagcactctaagtcaggcaaaacagaaaccactccttctagcagcccttgaaaagccagaacacaatatatacattccacccttcctttccctcccagtggagaagccatgagttgggtgctttctgaaaattgtggcaagctgtgctggtgtctctgtgtgatactacaagttctctggtgctgccacaagcttctgagctctcttttgttctctgtggataccaggcatccaaggtatgtcagtttcccatcagcactctgaatcaggcaggacagaaaccagtcccttgggcagtttcctgaaaagctggaacattggaagtgtttcaatttcttcaatttccctcccaagggagaatccacaagttggactcttctttttgatcatgagctgtgctggcttgggagaaggattgatgcagttggaataaaatagctttttgttacccatttcaatgtagctgttcttgattttgagttgcctggggtactgtgacttcctaactgaattctggagttctcataaaggctttttggatcatgtgtt

SEQ ID NO: 117623 - DNA, 1044 bp, Homo sapiens
agtgcagcagtgccatcttggctcactgcaaccttcacctcctaggttctaagtgatcctcttgcctcagcctcccaagtagctaacaggcccgtgccaccacacccggctaattttttgtatttttagtggagatggggtttcaccatgttggccaggctggtcttgaactcctgacctcaggtgatctgcctcccaaagtgctgggattacaggcatgagccaccatgtccggcctaagaggctgttttagttgatactggaaggacaaagaagcatgaaccaggtggagactggtggttgtgtgagatctcacattccaggcagtgtgcttaaactctgacgcgtgagaaattacaccctgttagaggaattacaatctttgagctcagagcactgggggcaacatgggcggcagagaggggcttcaggtcccaaaacaagaagtttgaactttccccaggtggtcacaaggagccactgaggcatttaaacattatttgatttgaaaacatgattggattgaagaaaaatcacttcagctacgatgtgggtgatggcttggtgcaagggagggtggagggctacccaggatacagaggacaggcctggaccaaggtaatgacgctgcaggggaggtaagtggtgcctttgagacatgtttaggaggcagaactggaaggaccctggaggtaacagagaagggagaggcccattaggaggtgccgttggctggtatcctgcaggaggtctgagtaactttttctgactctcacattctggagtctgccccactaggcatacaccatgtagatttggggtatttctcagttcccttctttatcagatcatcagttttttgaagacagggctcacgtattgcacgtttttgtttgacttaaagtgtctaacactgggcctggcacacagtgctatcaggagttgtctttctgagctgcaaactcctttttgggagaacgttggtagaaggaggcaagcctcggaggagaattgtctggaaaaccatgtttccctgtttgtttc

SEQ ID NO: 117624 - DNA, 1059 bp, Homo sapiens
tagcagaggacagacaggtaaagtccacaatttgacccagtgttggcaaggaaaaggagacagttgtgaggagcgagaggacaatgaataaacctgacatccagggctgcctctatgagaggagaggagcttatggtgaagagaaggacagacttgatctctgtccttaagatttttaaggagtttatgatccagttaggaaggtaaagctggaaagctctgtttgatagaaataaaaactacgatcacatgtacagcccagatgttgatctctaggagatgacagcaagcggtccatcaccactggcatccacacatacccagtcctcaaacatcgaggaggagtgtgcgtggctccactcacttcttggaccagcccttgctaggtgggatgccattgctgttctagagggtcatccatggagctccctgcatcccacttctggatgagttctttggtaaggctctgactctttggcctgacatcatggtgggatcatggagcagggtgttgagcttttggaccaagaatctggaagtctcagttctgatcctgcctcaattgctcacttactgagtgaccttgggcaacttgctcaacatctctgggccctgtttcaagtaataccacaaggtacacaggtgttgatggttgcaaaagtttttttaagcattcaaagtataaacgcgtaaggctctttggagagcgagttcttagtgttatattttttaagggggatagatggcccctgagacaccctctcttgggtggcagtgaattggttcagccacatgtcaaggccagataagtcactcaatgcacatgagattaataagtatactactttggacaactacttaatgtatctgggttttttctcctggctataaaatgaggaggctgagttttacctcatagggttattaggaaaattaagtgagacagtgcataaatggcttctgaaacagagtagataaccagagaatgttcattgccttcccctaatcacaacctagatgtgtgctcataggtagctgcaggtgcagcaggtgcactag

SEQ ID NO: 117625 - DNA, 1037 bp, Homo sapiens
ttctaatccatactggcactgcttccactttatatcattctgatccaacccattcgtgtctattttctctttgatcttcctctgaaaaatttataaggacctctgcaggtatctgtgtatgtgtgggtttctgctcaaaaccagccatatgtgaaactccttcttcttgatagtgaagcctcatcttagctagtgatttatctatctgatgagttgctttcaaatttcaatttattctctactgaatatcaagctaaactgagagccccagaccattaagtaggataactattggaaaacatgagttggccaaacaacttgcagacttacttcagatttactgaatagtttcttgaaacaaaggttaatatacccactagcagaggtatagtagttggtagtgtgtattaacaatgaatttcttctgtaggtgtcaagctatcttgtattgaagtagtctgtttggtatcatgattatagtttcatagataaaatttatataaatttcccattggttctaggtgactagttattgtttcagtctaccacggtatccattacagacttctgtcatagtccctatagacaatcattttactggttatgggttctttccttcatcattcattattacctccttgaggacaaagactttctcctttcatatacattcccagtggtgataattgtgacagaacataatatcgtttagtaagtgttcattgactgaataaatacatcaaaaattctaattaagctgatgggtcaaaaacacccttgggtcgttggatataaatatacaatctgggatcaggaattaccaagattctttagcatttaatatagttagagaattagaagttataaagggcacatttcttctcagtttgccaagaggagagaagaaatcattgtatttataagtattaaaagtatgtacaaacagctccatgaattatgacacatgagttattggttatgttagttttgtaataatacagaatcctgtttctcctcctgtccaaaggaaagctgtg

SEQ ID NO: 117626 - DNA, 1043 bp, Homo sapiens
ttttatgtcccaatacactatttttttttgtttttgtttttggagcggttttagacattaaactaatatttttagcagcatatatttaaaaaatgataatttaatccagcatgccattaaaacatctaaaaatgttcaaaaaaatcccaaacttcttcattcatcacccattttatgtgctgtatggagtcacctgacactaacagtggctcagacataatttaatgtcattaacctctttaaagtgttgtggaactcagaccagacactcttttagggcaagtccctggaataatcacaaagcctgagcctgggaacagagggtaagaatttgctttctacagaaacctactattcagtggacaatcgataaagcctcagctaatcttgcagttgctcagccagcctaatcattttcattgagccaagccttgcttgaggttgacaaagcctcagcttctttgctgtttctttgttttgttgaagctactgataactttgaaaggctgtgtcccacaattattgttatgatgcatgtcaatttttggaactcattgtgaaagaaaacttcttgccttcctcctgacttgtctctttgttggacttgggggagagattcagatgtgatttttgaaacttggaaactgaaaactaagggctgctcttagagagttgattgtagcccttgggtgttgttacagggtcaactttgaaatgaatatgacagtggggtgcgtgttccatatcccttgactactgggtgtgctgtgacattgccagaggtgacctggcaacctctacttatcattttgaaaagtgtcctattgctctagatgtataaatacttcctatccccttctttttagaagtaaagcctttagaacaactccatggcttattccctggagttacagatccaggacaaatagaacaatgctcagatgattgctcctaaatgtatttgtggtctgttagttttgtcattcttcttttataaacactagcaattgggaagttttggccagatggaggcctggactttt

SEQ ID NO: 117627 - DNA, 1052 bp, Homo sapiens
aagagctgcttagtcaggtttttaaaaaattttgactttggtgagtgcagaactgaggacgatgtgtttctttcttttagatgggtcaattgagaggaccctggggcagaaaacaaagccaggctcgatgatgatagaagaaaaacatttttatatttgataatacagcagtagttctggtagcagagtataggtttgagcctgagaatctttctaacttaaaataattgcagattttcaaatactagtagtattcttggtgtctgtccatcaagaaagcacatgtgaccaaaaaatctactgagtaagtaatcctgttaaatagatttgcatttggtgatatttatttagtctacagctagtgtgactcctccccctgttcccacagaagagaccatcccattgcattttaagactaaattttaaacccaaaatgtttgaatttctgctttgggatagctcaaatgccaaatttttcctcctgtgtccaacctcactctcagccctcagcccccagccccaggcagaaatgatgctcttgggtagcagcttaatggtattttaatttaaaagtaaatgacggcacctcagggctcttgtgcatggctcagagatcacagggtagtctgcagaaaaattccagccaccctggcccacaatgtacaaagaacactccattcacacactctacctgccaaggttgtggaaggggtagagacaatggctaagacaggttttgggttctcattgaataataattttccatatttacttcatctgctatgtcaagcctttagccagaaagatggtctgcctgcctatagctgggggccttctagctttccatctatctggtgctggtgtcttgttctagagaaaatttaacctaattcatcagcaagattatgttgagccccagtggtgccaggccatagctttgtgctgggtatttgcgggtacttatttagaaagacgttaagtgtttgcttctaaggagctcatggcttaagagcaagtagaatatgtgaagaaatgtgaaggatgctttgctt

SEQ ID NO: 117628 - DNA, 1812 bp, Homo sapiens
tggggttctctaccattgctgcctcttgagacagacctgtgacctcactctactgtaagtgcaggggtgcaggcacccactagggtcacacacaagggaaagcattggtctctgtggtcacaggtctccctggacccaggccttgagttagaaggtatttcatgccaacaaactacaaggagaccttccagatcagaactaggaatcagaccagctaacactttggagctgagtaatcctgagcctattttcttctctctatcatgggagtagcgcatcctatcctgtttccaggatgatctggggaacagggggaatggggaggagagcattctatggaagtagacaccacaggcgctgtgctgtggagcctccctgccagcctcatcatctgcagtgagggagcttcacagttgggtccaggcaggagacacaggaatcctcaggtcactgctgctgcagaccacatgcacttttggggaggaaggatttccaggacttctggttttgttttctctttatctagatgtatagtgcaggcaggtatgtcctgtccagcctcccctactcttcccagtttctggctagctttgctttgccttcacttgtctgtagattccagtttagctgctgaattctgtttcttttccttctctaaaaagctttctttttctgttgttattgttgttgttgttattattgctattttaataaaaactcatccctgactattacagaaaaagcacatgggtggaaagaattataccacaatcctacccagagagaactgctggcagcaccttgatgtatatccttccaaatctttttcattgtatatgtatgctttccagcttaaaaaacattttagccaggtacagtagcaggtgcctatagtcccagctacttgggaggttgaggttgatagctcaagcattcatgtgtagcttgagccacggaatttgaatccagcctgggtaacataacaagacaccccatctcttaaaaaaacattcttagcagtatattctgaatttctttccatgttagcagatacatttctagaccattgtttgaaacatttaggtaatatattcaataaaagcaatttatactcatgaccaaaaaatgcaagcagtacatagaggtataaaatgcaaagccagtcttctcccagcctgtctctctgaagtggggagatccttggtatccttacagaatttatatattatgctttttaacttacacaacagaaagcactctgtactcgttgtacttttgtttgacaatacaaatcttgcaattatttccacacccttgtgtatggctatatcttattcttttagtctgctgcatctcatggatggagtataatttatttaaccagtcttctgttgatggacattaatgtttccagtttttttatttaaaatgcttccatgagaattcttgtacataatattttggagtacacttgctagtatacctgtagggtacaatcttagtagcatagttgttggatcaaagagaatgtacattaaaaagttgtttgatagattttgccaacttgctgtctaaacaaatgtgactttattttaaagccagtcttgccttctgataggtcctcggcttttccagcgagagcacaactttgtgggggctgaagcatcatctctatgtccagctgcctatttggtttcctgtttggaagggccctgtctcttcctgctgtggcagtccctcctgcttcctctggattcagtttccccctcagggaagttccccagatctttgctatgatatatgttattctgg

SEQ ID NO: 117629 - DNA, 1050 bp, Homo sapiens
ttagaaagccagtacactttaaatgttgagttttgtaatgtcaggttgaatgctggcaagacccagggaagagcaagtgttgagcaacctagccttttttctgttcccagcggcaagtcacttagtcctcccccaaccttagaagtcagggatagaaaattctgtaaaaagttttgggcatcactgctgcctgaagcagatgtgcacgcatttcaaccatgataattgaaaccaaatttttccattttggaaatactttttgacaaagtaaggttttcaactgcaaaaacaaagtcagggaaagaaacctcttgatatccctgcacccagatttggatttttaggattttgcttgctaagttttgaactggtaaaacagatctggacaagataatttttgtgtaagttttcctaaagcaagtgctttatttgatgaaatttgccatcatcaaactgacctatttttttttttcaatttctggatgaatgttcaaactaggttaaacggaatagagcactaataaaccatgtaaaaaatagcttgaacatgtgttggtagatttttttttctgttaaataagttcaatgcctctcaggtcagagatctaactttttatcatttatgaggattttcagagtcttagcacaactttcctggacttttcattttcacttatgaaagtatatcatagccactatcaaaaccacacacatacaagggctcagctctcctattcaaaccaaacataagcttggcttccaaaatgccacataatgaggagcatgttttcttttagtctttctctcttcttgtctaattctatctgtctgtgtaaaatgttttacatttttacacagcccacttaagagttttccccttgagttttaaagaaagcagtttgtgacttggggttttaggaatgtgattagtaacatacctgttcttgagcttgtttatgaaggagcatgttacaagaatgacagcatctgctggtcatctttggtgaatcatgattggcttgtgtgaaggccccagtgtggaaactccaa

SEQ ID NO: 117630 - DNA, 1061 bp, Homo sapiens
caaatagttgtacactttccatacatttctgtcttattttttaattctagtgatacacaaattacatgtgggctacttcatttggtaatttggtccagctttttggtggctgtagagtggcctctaggatacagaaaatgattctctgaaatttttcgttgtaattgttaaatactactctgcttgacttactcagttttggtgggaagatctgggtcaattggaatagtacacctttctcagggttttcagtttaataaggttgtcatattattcccaacatgggaatatagtggcttctaaagtttgcaaatgaattatgtaaaaggattttctgtgtattaggaaggcaacctgttctgttcatggtatattaacacttcattgtcatgtgtctacccttaaaattgctatttgtagtgaagaaaaaagcatagtggtatttagtcacttctgggttcctcttgtcagtttatatgcaaacattttggcatgtgggacttggggaggagggacaattggttgtatgttttgaccacttccacctatgaaaattatctgaacattattcagatttaagagttcatgggagcaggtggtacagaacctagtgttgaatataatttttgtgccatgcttgaatgtattttgacggattagcaaaataaaagtgaacctcctatttttcatcttaatgtgaagatctttggcatttacattcttttaaaagtataaattcagtagtcattagttgaaagtggtttgaaaggctgttagagatgatacaggttgagtattccttatctgaaattcttgggcccagaagtgttttgagttttagatttttttcaatttttgaatatttccattatgtttaccagctgagcagctctcatacaaaaatgtaaaatccaaactgcttcaatgagcatttcctttgaatgtcatgtctgcactcaaaaaatttcggattttggagcattttagattttttgattggaatatctgtagtgtttttcaggtcatttaaaaagctctcattggtactgatttactgtatc

SEQ ID NO: 117631 - DNA, 3401 bp, Homo sapiens
tgaaagtgggctggcagaagcggaagcgggagcggcacaggccgcgggcttgaatagaccgcggagggcggggagtccgtgatctagagcggcgctgcggcgcggtaggcgggattaaggggagcgaggcggggattggctggtagccctaggctgccgtacgtcggcggtgacgcacgcctcggggagggtgcgcgcgcgttcagcggcctctttgtgtggtgcccagataggggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttacatgattgagtgagagtatgtataacctggtgggtgggttcagagtaccttttaatctagtatgcttaacttgatgttaatatttaacttaaatatttgacttacatgttgacgttgaaggctcaaagctatactaagaagctttctgaaagattgggctttaaaataaaataatattttaatattgaaccattttttaacttcttgtcactgttcaattcctaaggtctagttcttgccagttttttttttttttttcctgattggcagggcttttaaagaagtaagaagaaaggttaagattattaggctaggttatagctgctcagtagtcattttgacaaagggtagcggatggttggtacaaatagtgttatatcctctatgacaaacggggtgg

SEQ ID NO: 117632 - DNA, 2691 bp, Homo sapiens
gcggtgcctcacgcctgtaatcccagcactttgggaggccgaggtgggtggatcacctgaggtcaggagttcgagaccagcctggccaacatgatgaaaccccatctctactaaaaatacacaaagaaattagcaggttgtggtggcacatgcctgtaatccagctactccagaggctgaggcagaagaattgcttgaacctgggagacggaggttgcggtgagccaggattgcaccattgcactcaagcctgggcaacagagcgagacctcgtctcaaaaaaaaaaaagaaatttttttttgtagaaaaattgttttggtagaaatcgtgtctcactatgttgcccaggctgggctcaaactcatggccttaattgctgagattataggtgtgaaccacagcaccaagccctttcttttagttttaagttttatgttagaataaatattcccctacctgctacaactttatgcaaatgtattatctttggtttaagactgattcaagcttgaggttgaaatcacagtatttgacagactacactcagctatcctctactgaatgtgtgtaatctaaagttatatttgttatagcaagatgttatccagtgaatttttttttaatcttcaattttactctcatgagagaccagggtggtattaatgagtcctgggaataagtagagagattatttggtctagtgttaaaggatattctgtggaacacacattcaggtgttaatagttgatcctatagaacgaaggggacaagtttgttttaattagtagagtatgcgagacttaccatatttatttgtctatggagcttgtttgtggacaaatgaatttgggaagcattgcttactctgctaattagactactaaaagctgtgagaagagtattgcagtataaagaatgtgccaactcagatgaagggaaatggaggtaatagagaagtatgaggtcacaaatggacattgttgagctttttccaggatctttccactatactgcttccagattttcttaatggtttagaataaatattgtattataaaacctatgtgtgtatgcacatgcgcatgcatgcccactcatcttaatgccaataaaatgccaacaacattaaatgaaatagcaagcagttatgtatgtttactctgtgctaggtaggcagtgttgcaaatactttacatagaactcataaatagtcctctttagagccctttaaggtagaacgaagtattcccattttacagatgaggatgttgaatacaaagaggttaggtaatttacccaagccatattcataatctattcagataaaatgtaaagccatcaaaggggttggtacctacttattataagagcaaattgtacaggagactgaaaattttgcctgcaaatctgcaagcaaaggcctgggctagactgttgatcgtctgccctttctacctaattatttacattgtgggagtgaggagaatattaatggtgccagtggagtttttttgtttttgtttttttttttttgtattttgttattttttttgtttaattccagaaaatgaccaaagatcatttggtagaagagaaagcttctcttcagaaaagtcttctttactatgaaagtcaacatggaaggccggtaatatctctcttgctaaaaagatttgattttatgtcttaaaaaagaacatgaatcaattttgtggcctacattcttcagggctgttttttgagcattatttcctacaattgggggattgcctatgtatttaatataaaatttgaaattgggcgaataagtcattgtttaatgttttggacattttagatttgtgatgactagacaatttcttttttttcttgcttcaggtgaccaaggaagaaaggcacattgttaaacctctctatgatagatacaggcttgtaaaacaaatgctgacaagagctagcatcactcctgtccttgtaagtaaaataagcaataattctctggttcattttatcaagatgtactcttcccaaaaaaaattattattgtggtatattggagaaatacacagccaagacagaaataattgtcactgtaaggtgagattactgattttaaaataggaaactaataatgtctgctagtatatcccagacacttgtgtaagcatttttatgtatgcttatgtcattaaatcctgacaagtaaaatcacagcaggtagaatatgatagcatcatttcacaggtgatgaaactgaggcttaggcagtgagtgatgtgcctaatctactttgtaagtgacagaagcagaatgggaaactcattcagactccttgtctagtttctttccatttaaattcatgtcgttgaaaatgcatcagttttgtggtggccatgatgatgtccttttatttgcataatgatataagctgacttttaaaataagttaatctttttaatgagaagaagtcacttaaaataatgcttattggtatttgtgtgcatttttaaagaaaaatgaaaactttagtgtttaaatgcatattaagtgctgtccccaaattaacctttagatagtatgactgtagatagattggtcttgggttcaaatagaaaacagcatgtagcccattttacattatttcctatgaattaattcactgaaccttctggtttgctgtggctttcagg

SEQ ID NO: 117633 - DNA, 1093 bp, Homo sapiens
ggcatcccaaagtgctgtgattataggcgtgagccaccacacccagccttggctaatttaaaaaattttttgtagagatggggtctcactctgttgtccaggctagtctcaaactcctgggctcaagcagtccttctgcttcagcctctcaaagttctgggattacaggtgtgagccaccacacccagcctagaatagctgtcttgctgttttttgcttcttaaatgttttatttggctttgaaatatctaagtctgtgtgctgttaatgtatactttcttgttgtgtattttgcttattctttgacccggtcaaagctaaaaccaattattactgatctgtccttatttctgacatgtagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaaggtaatcttgagctatgatttttgcccagattagcctttagaattcctgaaacaaaataattactatagcagggtagagatgtctaggtagtctgattttcctgaatctgctccccatctttgcagattcagaaacatgatttaatcagcataacagaagtgccaaatacttcaagaattgaatcataataaaactgaaaaaactagaatgctgatgagttcatttatgttggagtcagttggcaagatgagtgtataaagagcatgaaacaggtagctcatgcctcaattccagcaatttcagaggtcgaggcaggaggattgcctgagcccaggagttcgagaccagcctgagcaacaaagtgagaccctgtctctacaaataaaatttaaaaattagctggatgtggtagtatgcacctgtagttccagttacttggaaggctgaggtgggaggatcaatggagcccgggagattaggactgcagtgagctgtgcctcca

SEQ ID NO: 117634 - DNA, 3377 bp, Homo sapiens
gtgtgaggaaaaagaaaacatcactcttgaattttgacactgtcaagccctctttgcattcattttcgctattgctaatagccaatagcatcaaaatttttaagtgtagttacttaaaaaaaagctgccgggcgtggtggctcacgcttgtaatcctagcactttgggaggccgaggcaggcggatcacttgaggtcaggagttcgtaaccagcctggccaacatggtgaaaccccatctcaactaaaaatacaaatattagccaaacatggtagcaggcgcctgtaacaccagctccttgggaggctgaggcaggagaatcgcttgaacccaggaggcagaggttgcagtgagtcaagatcgtgccactgcactccagcctgggtgacagagcaagactccatctctaaaaaaataaataaataaataaaaagctaatgtgtagatgggaattttttctttccctcctgtgcttaatgttgtatttggggtatatttgtggattgtgtgtatgatctgtatgtgttctatatgtaatcaaacattatatttgcaaagacatcaaatgtattaacatagctttcatttgagggcatacaggataactgcagtaaagtaaatgtgcttaagaaggcctagtgctattaagttttgtcttagtaacactgttgggtattattaaaatatatattatacataggaatcctgtagcagaagataaccatcacagtttaatgttagaggccaggtgctgtcaggtgaattagctcctcctttgggaatattagaattcttctaaagtcagagaactccatttggtgagtgttccatgtaacatggggaacagctcccactttttcttaatatagctatttgacagtgagggacaggtcatacacctgacatcatttggcttttaaattaaatttctaagaaagaactgttcagttcttgctgtttctggttttcccctacttgaaaactaacatttgtaaataaaacatcttttgaaaagttcagaattatattaaataacatctttagaattaaattgagttttaaagagcttgacaatgtcctttcttgctttgccactgggttcagaaatttaaatttatatggaaatagaactctgggctgggcacagtggctcatgcctgtaatccctgcacactgagaggctgagatgggaggatcacttgagcctagcagttcaagaccagcctggccaacatagtgagacctcgtctctaccaacaacaaaaaaaagaaaattagtcaggcgtagtggcaagcgcctgtagtcccagctactcgggaggctaaggtgggaggattgcttgagcctagaaggtcgaggctgcagtgagccaccatcatgacactgaattccagagcctgggcagcagagcgagaccttatctcaaaaaaaaaaaattgaactctggactaaaaagtgaagcttgaataattttaaactatagtaggctttatgaagattatatatatatatatatacacacacacatgtatgtgtgtgtgtgtgtgtgtatgtgtgtatgtatatatgaaccactacataatgatatgatttaaggaacacatagctgatattttgtgacttttttcccacgtggaatcaagagacccatggtactattctttgtgtttgttttatagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactaggtatatgatttttatgtacttacaagaggcaattcctattatgtacccaagtcttttgagagatttagtcttccagcctgggcttcaatagtgaaactccatctcaaaaaaaaaaaaaaaaaaagagagagattgagtcttctagacatagaattcagagctttctcactgattttatagagcacatttttgtaagttttggttttttttgaccctgctgagttcagtgaggtgtagcgtttgaagtttgctctcaaatagacattttctcgtggtgtattattcatttatttatgtattcatcgctgaaatacagagctctgtaaaggaagcagcaaatggtgctgagcagttcctaatctttttttatcaaagctttaaatggatctgaatgtcaaaaactttgttatgcagtttgaacagttacaagagctctgagctgctaggtatctttgtttctttgctgcctttgtccaaaccagttttaaatgattccaaactgttttcatcaccacttgtattagctaaatttgtggtctgtaacattacagtgtttctttatactacctgtcctttagtgttagggacttatttttacctttaagatttacttattgctaatagtgccatgtcagggcaataagagatacagtgttggtacttgaaaatttaacagtgttggccttttgttttaattcagaattcgaagatcatcctttagttcaaaagatgaaaagagagaggacagaacaccttatcagctggtcaagaaacttcagaagaaaatcagacaatttgaggaacagtttgaaagggaaagaaatagcaaggtaggtttgtagcattccccagagtgagcttaatctaatattagaactgagaggatagtttttcaaaagcattagtttagatctgtgtgagaaaggtaacaaatctgagatacccggaggaacagtgatcatgtagatctgagattatataactccttggtctcctgacttccaggccagtattcttgccatttgcaccgtggcatctttatatttccactggcaaagcagcttttagaatttttaaagcaaatactttacattgacaaatcatgttactgctatttctgctctatcaaaaactacaagtaccaagtggggaggagagggagtttgtgagggatggagtggaggaggggaaagagaattttaatagttagaacatatgaagtggaaagagtcctgtacttggagtcagaagacccatattcaaatctggcttctgccagttacgagaccttaccttgggagaacttgacttaatatcctgccctatctaattaaaataagatgaaatgagaattgagcagtctttgctgtgggaattgtaaaatactatttggacataaattaatgtaactattgcttatcacaagtgtcagtgattctgctccataatttttcagccctcctacagtgatattgctgccaatcca

SEQ ID NO: 117635 - DNA, 1031 bp, Homo sapiens
gtacatagtttctgttttgttttttcctcaaaggataagaaaaatagcagaatgcagtagtagttagcaagcaggtagcacatgactgtcaccagtatgaatttgtagcagctgtttgcaaagttttgacttttaatggaagtggataccatcttcagattctctcctgctaactctggaatgaaatgcagtaggattttttcaaagagcaaactaagggagatattttcctttaaaatcatttacactgaaaagcttcaaacagtacctgcttaagaatttccatttcttcagttttatgtttgagttttaataaaatagcacgactttgagttttccccccccttttttgcattgcttgctgaaatggaaatgttatgtttgtgtttgttaaaatctagttagtagtgatttcttttaataacgtttttgaacagaatgcctaactggttttagggaaatgtttttggtatctttggctttgtgttatgtgtatggtttgttctgactgtgctgtgtgttcactttagtattttttgccattttttccattttattagcgtcatgccctatcacttttcccctcattgatttcaaaacaatgcatctgcagagagatggggagggtaagtatggttcaccatagtttagtttttttgccttttatggttcactttgtttgtctttttattaagcccttctcctgctgtccccatatcttaggaaaactgttctgggttcaaagtgaacccagaaaaaattgctattacttttgtcttttcttaaaataggatatttctcataaaatgtttactaccagttacttatttgctggggcacaggtacaagggttgctttgaaaatcactttattgttgggtttattgtgggattgcacgctttgtacccaatttttaattctcagattgatctgggcttcaaaaacaaactaaattatgttcttattattttgaaaggaaaggtaatgctttaaattgctaatgcataaagttaaactaaattactaaagca

SEQ ID NO: 117636 - DNA, 2019 bp, Homo sapiens
gggaagaatatttgttatttgacagtgataaattgtcacacttgattctggtaagaactatttttttgtcttagtctttaaaaacttgcctaggtttaaactgttatgtctggtctttaatgtgggttagctaggtttaaagatttaaatataaatactcttaccaaatattttacagttaaacagcaacttaatttgccacttttggttacaagagacttggttgtgaaaacactttcctgaatttgggatccaaacttgtcttccaataagacatattctaaaactgcatgtttatatttgaaaatagtttgcacagtgggagtgggacagttggctgtataggcacagtaaactaatgaagactacacttggatatgtgctggatgtgtttaagctgggtgtgaaaagcttccgtagttgtgaaatatattctttattttaaaatacaggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaaggtaattttacccacacgcattattttcctgataatgttacttgtaaccgaaattaccctaagcaatgataagactacagcccttttctggataaccttattcatcttgatcttctgttctccctttcatgtaagatgaacaagtgggtgtttttagtgaaacacactgagattttggggcagcatctcatatgaactagaagttcttgtctgatccatcaacagctttgaaaatggatgttagaactgatttttttaaaaagtcacccagcatacgtttttgttaatatttaaatcaggtgctatctcctagtctttggaagcccagtatgttaaggcttagggatctcaccagtttaagcagagcgtgtataattaccttgtccttagtatcatcagtagtacttttttgaaaaatgaccttcaagggtacttctaaacaaatattgtaccatattcctgtatttctgtcttaggttatgaaggtatggtgcaggggactctaaaaatttgcacaaaggagagaagttaaaatttaacaagcaaacaacatgggtatatgcatttctcaaaactcagcaaatacatagatttttgtgtttctttgtatataaagttctctttttacttcaagaggataaaaaactgtaaacaaatgctgaacttcagtggatgatttgcatgctggagtgtttatggggaaatttactgatacctgcagtttactctgaaatccatgaaaaaaataagatggttaatgggatggataaatgttataaagcaagtatagtagaatgttaatggtagattgtgattggtatatggatattcagtgtaaagttctttcaattttgctatgtatttgtaaactttcaaataaaatgttgagtgggggtgggaatcaagcaataaatttggatctaggagtttttctggatcatacactttggtaaagagacaatgagataactcaagaatcttaaggatagttacatattcattcacttggatgaagatccctgggttgtctcacctttggcaagtatctgttgacatacactggcaataacaggaattctaatgccagtgccacggactccttttggcactgtttaagtgtactcacctgatcgcaaatggagtgtgtgtgggtcttgtttttttttttaaggtctaggcatttttttttaagagccccaaccaagtcattgtctgtgccaatttttattgccatctcctccccaccctcctttttatataggtctagatgtttggcatgcccagtggcatattatctgttttaacttagactaaattagaaagttgtctttaatttgctttgttctgggttattcaggacatctggaatttatgaagatgcttcccagtgttgggggatatgttagcatactggtggcag

SEQ ID NO: 117637 - DNA, 2181 bp, Homo sapiens
attggcaacttctcttatctgagtattgggagctccattaatacatggtagtgttctttttgtcagtctgtaggtatattgttagagccatgcagtgaccgtggtgatagtgaagatggctgtcttgagaggtaagcattttttcttgttgctaattaatcattttgagaattggagctcttcacagatttttgaggtgatttttttagatgaatgtccattataaatatatagtttagataatcttaaacagccttcttgttataatggtaggcataaaggatattaaatacccataaatgtttggatttgtacaggttcagacagtagttataacttggaaaacattcagagggaaaaacagcctttttggagacatttaaatctttcagttgattgtggaacaattgggaatttactgatattctgagtatacctgtcagtgagttaattcatgatcttgtaactgtgtataactaactgagagatactgtatttgattcaacaaatatgtataggatgtttttcttcctctttgaatttatccttggtgtgtctcagtacactcttaggcagctggtgcttttttaacctctttggctggctgtaatggtagagaaatactggaggcaatgagtatttcgactaatgtagagtctcaatagatagcctctttgaatagaagctttctagaatgttttaaatcacagagtaagatttgggttcttgttaccctttgcatcagtcttcaagatgctgccaaaaagtataactttcttaggaaggtgatttgagattctgaaaacacttcagtaatgaagttgcaggctagattgtaaatattgagagatcccagacagtatactaatttgctgacagcctgttggccaggacatatttgtattctattgtttcttttaattataagtaggaagcctgttctttaagggtaagcaaattctttggagccacgtctctggagcctccccatactctgaaggtccacagatttccttatagcagttccttgtccttcctttcaggaggcaggaatcatcctcttccagcccaggaagtattggagctatgggctgaagatataaaattaacaacattaacaggcacccccagaatagtgacatctggatttggtagaacaataaggacccatttagtgaggactcttctgttgttgttgttgttgttgttgttgttgttgtttttggaaaaagctctctcctcttcaacttcaactgtgtataagttagcaaactggtttttagatccagagtaccttggttaggtggattacattttgtatgtttaacattcatgcttctcaaatgtaggtgattaggtcttttaggctgctaaggtagtaattactcatcctaccatttgctcctactctaagcaaaggaatgcctttaagcttaacagagcatttagttcatttcttattctcagcaagaataaggtaattatctgtatgagaagatgacttgcaatatttagatcaaggcatgtctcctgagtgcatactctgttatggccggttagaagtgacatctcgatgtgtcattgtaaattgccactgtgtctttggggaaaagaactttcccccagtaggcatattgataatctactgtataatagcaggtgctctcttgactggtaaaataggtacagatcacttacgacagcttgctataacacttgttctaaataagggttagtttttctggggaagtaaaaggtggactgaaattttttaaaatttccttttagtatgttactgttatattttgaggagggaaaggtttggaagtagtaaccttctctgattggaagtagtatccttgtgatagaatacagtcaagtttaaagtaaaagacatagtgatacctttttaaaaagttttctttgaaagtctcaagaatggagagaatagagctgtttatttggttaaaacatttattttataaaatctttattatacattcattcttttgggtttctacttactgtggattttagttttcattttataaaggtttttcttttttgctgtggtttgtggggtggagtagggattgttacttgatttttctaaacccgaagtgattctgtggatcttttcagtattgtgtgatttttcagatatagggctccaaagaatgg

SEQ ID NO: 117638 - DNA, 1028 bp, Homo sapiens
aaaagggctaactagaatagctatcaaatataaaatgaaaaatgtaaatggatgtgaaaaccagtgctgggaatgtttatttttggaataccatatagtacaattgcaagcgtgccatggatggcactgccagccagtgcagctctatttgatggccttggtttgtgtactttgaaggcatgattagaatgcatacaactgggaaaaggcgggagagggaaagaaaagagaaagaaaaacattaaaaaaaaaagcatgtatacaactggatctattgggagtatttgggcagaatgtgaaggaaaaaatcagtatctaagtgttagaaatagtgggaaaatgtttcaaaggatgtaagcagatttcttggagtttgtccttagcttagctagggatcctgtaaacctatacccattgctcaggtgatagtcttattttcaccactggggaacacatgttctattgagggtagtggtatcatctttgaaacaaaaactgcagtgttttggatattctaaactgtaagatgacaactctgcagtaggaagctatttctgttttacttgataaggtgttggacactgtagtgtctagtactggacttgtatttgatcaggacagatgtgtcattattatgtgagagtgtgcatttacaagggaaatgattatttcggcccataaattattttaaaagctatttattcgcttatgaacatttttagaggggataacatggtccctcacaacatcccgaggagacaaaaacatagcagatttaataatctaatttagcaagataaaagtgtggatttttgtgaaaggtacacattttctttaacaagtaaaagtttcagatcattattgatatttacttattttaaagtaaaggcattacacactcaacatttggcctgatctgatttttaaacttcatccctaggattgatattgctgatgatattattaatgccagtgaaagtaacagagactgttcaaaacctgtggctagcactaatttagacaatgaa

SEQ ID NO: 117639 - DNA, 1133 bp, Homo sapiens
acttagaagttagctgacattttctaaaatgtagctaacatcttaaggcaacattttttttgcgcttcttttttcacacttactatattaaaatgacttgtttaaggcacctggaaaatcagatcaattaaaagtctgttgtaagtgttacatttacgaaactagttagaaaattaagttttcttaatgttaactataccttacaggcttacttatattcctagatatactaattttgcaatatactaatatactaatttgcaactagtgatacactaatcctgcttcaaaatgttacatttgtctggttgcaattttattttgatatgaaaaagttgacagttacttactccataagagagattggtcctaggaaatgaggaaataaaaatgagttgtttgtgtttaaaattttcatagaatagtatgtcttagatgtgttaacggtttcattacattttaattctgaatttctttttatttatataggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaaggtaatagctcagttgaatgaactttagcttttgagtatttcattctaagtgtaaactcactccagcattcagaaacacaaactgtaactatatgtgaaagtttggcatttgtgtgtgaaaaagagcaagaagtaaaatttaaagatgcagtcttgctaaggaattttcagttattagtgttaataccttttttcaaaaacataacttcttacaaatatttcttgttaaagttggttttgtattagcttattaattgggctggataaaatttcagaacctctggaagtagcatcgttagagaaggatacagtgactgaattgacttgtatatcccgtttccaggctacaattagttgtaactaggctgtaaggatggaactctgatccattaagatagtgctttccaattcttttcatgtacaaaatgataatatttacatggcatgctgggtaaattcgataaatgtggtaggctgaagaccctat

SEQ ID NO: 117640 - DNA, 1054 bp, Homo sapiens
agcagaaaccaacatgaatttagaggagaaaaacagacgagaaatgaaagaccttttaatttagttatactgatattgctgaagttaattgtttattttaggacgccaggagaagaaaatcacactgttacctttttctttccttctttttactttcatctaagctgaaaggtatcactgatactattagcccctcaaattgcatctctgctttgctcactagtggtttgtattgtctggcatggccagtgcattttgacttcttatagttggcactagtgtggaaacacaggtacagtcatgctggagacagtaggatgagaattaaaaaaaaaaaaaaaaaaaaaagagaattggggccaatgagtaatagatgaggaaaacatcctccagcaattaagggattgagttccttttttccagctcctcttctccacctcttctccatttcataagtgaaatacaaagccctaaggcatttggccccagtagaggaagtgaagaggttttgaattgttgtattaaaaaggtgatgtgggtggagtaatgtgaacctggcaaaatatcagagctttgctttttcctttattgaaaaaaacctgttattattgttttatagattataataatgaagatgaatttggaagaaagttgaggttcctcttgcaacagcttccacctgttaattatagtttgttaaagtttctgtgtagatttttagccaatgtagcatcacatcatgaagaaatttggtccgcaaattctttggctgctgtctttggtccagatgtcttccagtaagttgtttaaaaaatttttgtttaatttttaaaaattagatatgtgaggccgggcacggtggctcatgcctgtaatcccagcactttgggaggctgatgcgggcggatcacaaggtcaggagattgagaccatcctggctaacacggtgaaaccccgtctctactaaaaataaaaaaactagctgggcatggtggcgggtgcctgtagtcccagctgctcgggaggctgagacaggagaatggcgtgaacccgg

SEQ ID NO: 117641 - DNA, 1047 bp, Homo sapiens
gaagttgatgtagaagaaaaaggagtgtgttttattctgggctcaactgcgcccctttttaaggtcacgtgagatgagtggttgcggacttccttaaatcgctcagagaatatagccaaaattgggctgttggtgcactggggccttgtctagaatgcgctctgcataggccaggctggagggggacactttgtatagcattagggttcgcgtggcacgcctggtttcctagatgaggttgtaggaatcggttggcacatttgcgcagtgggaaactgttaagccctttttgtttgtaatcagttaaaatcaaactgacttttagaaagacggtggattatttcatttggttccccgtttcgccttctaatcagtgaaaaaagttgggcatttactttgaaggatctgataatctaaaatggtagccagaatcattaccagtagtaatgcagactattaacattaactggggtgcacctgtttagagagacagacattaaagggtggttttgaattatttgtctttttagagctgggttagtgtgaggctattttcaaccttccttttttggtaaccttgaaatgcttgttggcctggttttctcacaggtactgtgcatttactaagtgcttgttgatggaattgaatggactgataattatttgtatatccattgggagcgccttcttacttttttttttttttccttgagacagtttcgctctgtcgtacaggctggagtgcagtggagcgatctcggttcactgcaacctcctcctcccggattcaagcgattctcctgcctcagcctcctgagtagctgggactacaggcgcccgccaccacgcctgactaatttttgtatttttggtagagatcagatttcactaagttggccaggctggtcttgaactgacctcaagtgatccgcctgcctcagcctcccagagttctgggattacaggcgtgagtcaccgtgccttgcccccttcttacttttttaatccgtgctgcttttaaaattggagtaatagtttctccagttt

SEQ ID NO: 117642 - DNA, 1050 bp, Homo sapiens
tgctccatagtcccacagctccatcacctcacagccttgaaggaagtggtagggatggcgcactcactggtttaggtaaatgagtaggaagcagccccagatggagttgctttatgattattaacaccttggggaggatggcaggacagagagtgggctctcactgacagatgaggacactgtagctccaagaataggtgacctgccttcagggttaaggacccagcctgctctggcctacatgattctgagaaatgggccaaagaagcaggaagagacaaaattgacatatagaagaaagaaatctcacgtataggagaaaagcagcctccttctcattctgggagggaagaagggctggaggggctgggcagggcggggcttttggcgaaaactgagtccctcctcccagatcccccactgggccggtggctcctgcagccctgccagttaggaacaaatgagaagagctgctgatttcctcccttggacattcagaattttctcacataaatactgaggaagaccctgccctctcctcacttctctggacttggccctgagctggacctggtccactggggtaggcagggcgatggggaacctgtttatgctctgggcagctctgggcatatgctgtgctgcattcagtgcctctgcctggtaagtcctttcccaaccctcactccttgccaaggaggcccccattgtctcatccccattcacctctgcctcactttttctctttttggtaggtcagtgaacaatttcctgataacaggtcccaaggtaggatgatctccagcttctgtttttacccactgagggccctaaggggactcttctggagaaaagaggggcggggacagtgccagagcccctcacccagaggaacccatggttgattcttaatggagagctggcccatctgagtcctgcctgctcccccaaccacagatgacccataccgggcagaagctcacagcccttttccctttgccaggcctatctgacctacacgactagtgtggccttgggtgcccagagtgg

SEQ ID NO: 117643 - DNA, 1034 bp, Homo sapiens
gccgagatcatgccactgcaccccagcctgggcaacagagtgagactctgtctcaaaacaaaaacaaaaacaaaaaaatgaccagccacagtggttcacgcctgtaatcccagcactttgggaggccaaggagggcagatcatgtggtcaagagatcgagaccatcctggtcaacaaggtgaaaccccatctctactagaaatacaaaaattagctgggcatggtggcacgcacctgtagtcccagccagctactcaggaggctggggcaggagaattgcttgaacctgggaggcagaggttgcagtgagccaagatcatgccactgcactccagcctggtgacagagcgagtctcaaaaaaaaaaaaaaaaaaaaaaaaagaaagaaaagcatcctcttaaacccaaaggaagtgggggataagggagataaacagtattatttttccaaagcctctgctttgggtaatcagggtccaggtttccagtcagttccctctctctctccaaagctaccagagagacttccttcatacatgctatcagctctgctggagtcatgtacatcatcaccaagaactgtagcatgggtgacttcgaaaactgtggctgtgatgggtcaaacaatggaaaaacaggtaagttgagctttctaatgggggtgggaagaggtgaggggctacagagctgagtgcagactaaagtcttccagagaaaggctgagggacacagctcccttaaacctcaagactccagcaactccttcaattgtaggatctcctagccttacactctcagagttgagcctgggtccatgagtctaggtgttagcaagtagctctaaaagcaacaaggcaattagaaatgagaaagccgaagagacttaaagctagccctggtatttcaggcttggaatggttcatccataatctagagctactcagcaatttacagattacctaagacacttactcagatttatcactaatgaaggaggtagtagcctttacgagatgattgtagaataatggtgc

SEQ ID NO: 117644 - DNA, 1127 bp, Homo sapiens
ctcccaggttcacgccattctcctgcctcagcctcccgagtagctgggactacaggtgcccgccaccacactcggctaattttttgtatttttagtagagatggggtttcaccgtgttagccaggatggtcttgatctcctgacctcgtgatccgcctgccttggcctcccaaagtgctgggattacagacgtgagccaccacgcctggccaagctgcagtgaacctttgagagcatctgttagcccccagtgtacctacttttactgtgggtatagaagactaattgcttatggctgggaagtgtctgaagggtgggcagttggctttggcaacaggactcccacccaccccaagcacctccatttccctgtctcaccttcagccatagctttacactctagggctcttgggggtggtttggcgggtgactgggactgagcatggagctacacggagaacttattctgtccttgtatataggaggccatggctggatctggggaggctgcagcgacaatgtggaatttggggaaaggatctccaaactctttgtggacagtttggagaaggggaaggatgccagagccctgatgaatcttcacaacaacagggccggcagactggtgggtataggcattgtggccagtatttctacagcttcacatctgcccggcccttcacaatttaccaagagctgtcttatacgttctttcctcatactacccagccagattgagatggctacccgcattctctggatgacaaaaccaattaaatctgagccaagtggcttgtccaaggcaactaataagtgtcagagacaggcagtgaactcagatcttctcactgagtcctcttgtcattgtatgttctgctctgcccctccacacgcgggcttctgagaacacagaaccgaggccttgcttctatgacttaaatttttatcacttcaactgcatgttctagtaaattaacagggccttgttgtccagccttgtgtcctaaagtctgtctgggctgtggggaattgggattgatctaggcttctctggagtgtcaaactctcccccaagacttctagtggggtggcagtctctggagtattctgaacacaaatctggaaac

SEQ ID NO: 117645 - DNA, 1013 bp, Homo sapiens
accagcctagtcaacatggtgaaaccccgtctctataaatatacaaaaattagccgggcatggtggtgggcacctgtaatctcagctactcaggaggctgaggcaggagaattgcttgaacccaggaagcagaggttgcagtgagccgagattgggccattgtgctccagcctgggcaacaagagtgaaagttcgttcaaaaaaaaaaaaaaaaaaaaagaaaagaaaagaaaatggtgatggggataaggaaattgggaagaagcagtgattttggagataaaggaaatgtgatttttattttagaaatgttacagcaggtggtagagcatctaaagggaattgacttttggatgcatggagaaatgacaccagaattcatataagaagtaaaggtagagagatttgggagccacctgaatagaggtcaaagttgaaacctcaaagtatatatacatttttttaaaatacattaataagaaagcagaggaccaagcatgaacatagaaggtagggatttattgaaagttgtaaaagggagaggacaaagaaagatataaaaaaaccaagatagtggtgtaatgagagcaagggaagatatattttaagcttaatgtttctcaacatcaatttggatatgaccagaaggatgccaaaggcaatcctaaagtgtgttttgaaggtttaatggttcataggttaaaaatgtttatacactgaggaaaatatcccctgccccctcaatttgtttgccttacggtttagttatggatgatttgggctagaggaaaataattgagctagctatgctccagttctttcccttcttttggtgtgaatatgaggaattccaagtaaaaataattattaggtaatattaatgtctctattatactgtattgtatggtgcaatatctctgttatactgacatggggctttctttattcccaaagacaaatataatttcatctcatgtctcccttcagcaagattttaattcttcctaatgatg

SEQ ID NO: 117646 - DNA, 1358 bp, Homo sapiens
gggtgacagagcgagaccttgtctcaaaagaaaaaaaaaaacaatctcagtaataatgaccactgtggctgggtgtggtggctcacacctgtagtcccagcactttgggaggctgaggtgggcagatcacctgaggtcgggagttcgagaccagcctgaccaacatgtaaaaaccccgtctctactaaaaaaaaaaaaaaaaattagccgggtgtggtggcatacgcctgtaatcccagctactcgggaggctaaggcaggagaatcgcttgaacccaggaggcggaggttgccgtgagctgagattgcaccattgcactccagcctgggcaacaagagtgaaactctgtctcaaacaaaaaaaagaaaaaaaaaagtgaccactgcatcaatagtggctgctggaattacagataagcttaggagagctagcctaaagacttttattactttcctccataaattaactggctctgactctgtgttgttcattatgggacagtgaggtatgatgtaatggaagggcatcaggctagaaaactacatggtcttaaggtcattggataatctcttggggcattgttttccttggtgtgtgataaagctaatataatgaggtacttgtccagcctacctcacagggatgttgtgaggataaaatgagataatagatatgaaactggcttggaaaaaaaagaaaagcattatacacatgcaaggttaccacctttttattttcactgttgcctcatgggcaacttatgttcatggactctaaaaattttagagtccttgcatattagaaatgtaaaaatggcctggcccagcaaaggtttcagtaattcatcttgcctacaggctgtaccacagacagaacattataatctccgttctttcttattggcctacaacagtgactctggatcccccaagcaaagcatttggctggctattgcaaggctggttaataggatcttttatctattgaagacagcaaaatattgcacaagaggaaggagctgggctgcagggagagagcagcagatggaaagaagccttctaattgtcctgatctcatggaaaaccactgtcaggaggtgctagggaactagtgccagggtcagtctgcaggaaaggcctttcttatagggaccaacagttggacaggtatgttagtcaagaacctcactacccattgcccattctgactctcctacctttcttttactctcctgctcctttgcacatgatttgggcctgggtgggatgactaatagttattctgtgggaccctaggtgaattccaaggacctctgtagtgggcatgagcaagatattccatcctacatttcctctca

SEQ ID NO: 117647 - DNA, 1253 bp, Homo sapiens
gccacgcagttgattatgcaaacatccgagtctgggatcagtgctaaaagtcttcgagggagagattctacccgcaaacaggatgcttcagagaaggtgaggcgatcaggaaggaacctgtgtgccagtgttccagtagtagaagtctgaagcatccaaggacccttatgttactacttggtattgggcttctagattccaatgatatacagacacatagatcttagaatgatggtggtttgcacccatctaaacgttgaataagcctattgtaaccgaaaggcccagtcacatgggagaaatcatgagtaggggaattattaattcctctgggagagtgctctcaaggcgggggaaatggcttagcctgcagcagttggggaccatcagtttctgtgctagaggcgtaatggacagattgcttttggatctctttcctcttgttcttgagttttaaaattttgtccttgtgtgtgtggtgcttgtgtctctgtcctgaggtttggggtgcttgtggctgagagtttctgtggaacctgatcagtgtttgtttgtcctctaacaggacagtgtcccaatgggctctcctgccttccttctctctctctttgtaagtattgaatggctgcaaggggtggtgttgccacaaagattctcagctcttaatgggggtgggtggcagagggaaatccaacatgcagactgtggcagtgtcttgaacttctgtttattcaggtcattgaataagaaactcttttcttctgcattcctgtctttctgcatgtgtgtgtgtgtgtgggctgggtagggactgtttttgagatcactgggctgaaatgtattctaggggtgaaggatctaggatgtacctgctcgtcatttcctgacttcaccttttaccaattcttttcttaacaaatttaaaattggtcagagcaggagctgctagctggctttttaacagtgtttctcataatggcagtactcagcaaatagtttttctcttgtctcctaaaattaagttgcaagactaatgtaacaaacagtaaaatttaagctaaagaactcagtataggctgggtgtggtggtttacgtctataattccaacactttgggaggctgaggtggaaggattgcttgagcccaggagtttgagaccagcctgggcaacgtagggagaccctgtctctacaaaatttaaaaacggcaacaacaacaaaaaaccctactagctgtgcagcggagtggtgcg

SEQ ID NO: 117648 - DNA, 1218 bp, Homo sapiens
atacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggtacttaagaaagatcggggctggggagatggaggtttataccttagataagaagtgacagcttaggctttttggttttccagttgcattcctgagttctgacatgtttgatgtgtccaaagcccataggctgtgattagtgttatatatacttattcctgttaaggtgaccattggagtcacattacatgagtaggacttagaatttcttctatggtctcattatcactgaagaataaagttgtgtgagctatagcgatttatcagtacttagggtgttttttcttttctggttttcaggcatcccctgaaagcatgttgtctccatcacatggctcaaatcccattgaagatcctttagaggcagagactcagcacaagtttgaaatgtcaggtaaataaagtcctctttcactgacttgaaatcatttgctttggcttctgaggggttgtgggttgtgggcaagtagaggaggtagaacaggtcagcatgtaaaggagagctgcaggggattatggtccataggaaggggaaggctaaggtggaaaaatcttcaggtagtctttctctcctctgcagactcattgaaagaagaatcagggactatttttggaagccagataaaggtatttcagacttttctttattcctcttgccatgtgattagatttccctatagcactactttttaatgaatttcagtaaagtcacatctttattctctgataagagactggtatggagttgcatggggaaaagctgcagtagacaggcataatgggagtactatagcaacaggtgcctcccatatgaaacagcatgtgaatatcacacagtccttaagaaggcttgatacacttagagtgatttgtagtgaataaggatacctgagccaaggagaacatacaggaatcaagtttattaattagactatccaaagagaatcatccagagttttctttttagaa

SEQ ID NO: 117649 - DNA, 1300 bp, Homo sapiens
actgttgccagtgagcctccagttaaacttgtgccaccccctgtagagtctgtgtcccaagctaccattgtcatgatgcctgcgctgccagcaccatcctctgctccggctgtctccactactgaaagtgtagctccaggtgcgtccctgagcagccactagatctaaaatttcattttgagctttagttagagaaaaatgaccaagagcatcagctccgattcagatgcttcttctctgttctacatagacatgtgccatctttatccttagaaataaatatccttagaaatagatgtgagaagaggtgggtgggcatttatgtattgcaggaagaggctaagtatacagatatgagcaggcttgaaaatatgttctcacctttctagataaaactggggagaagaaaacataggcacatgttgatgactctttctgaccttaagtgtttggatatttgacatctgtctgtagcgcttatgtgatctcaaggtggtcgctttgtacccaataagcttctgagatgcttttctctttctgttactcagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtaactattcagcgaagccccagagaatctcatgggtcctacataggcttctcttttcagcctcactttggtgctgctgctgcttttttttttttttttttggagacagagtcttgctctttcatccaggctgaagtgcagtggcacgatcttggcttactgttacctctgcctcccagcctcaagtaattcttgtgcctcagcctcctgagtagctgggactacaggcacatgccaccacgcctcactaattttttgtatttttagtagagatgagttttaccatgttggccaggctggtctcaaactcctggcctcaagtgatccacccacctcggcctcccaaagtgctgagattacaggcatgagccaccatactcggctgctttgcttcttacagtaagaattacttaaacaactctcctacttctgcccatctccatctttgtagccctttggtgctaacatact

SEQ ID NO: 117650 - DNA, 1034 bp, Homo sapiens
gacattgactgacctcagtttcactgttactaagcagttgtcagtgctagatttaaagcccaactttttctaacttttttttggagctactttacctggtaaacaatgtagtctccatattataaagccatctatcttcaagatagtgatagccctgattgaccacagcatggatattgagagtaatattgaactgctttcttagggcttgcaaaatcaaggtgctagagatacctaagattatagaatagtggaataagatttggaaccagagaattgggcttgaatctcaggcctgccacacattggttttgtgaccttggataggtaacttagcttttgagcctcagtttccttttttattgtaacatatatacttcacaaggatgtgatgagaatttaatgaggtagaaagtataaagcagggaaataaaaaaagctccatagaataccatacaaaccttattggtatttgaatggtgttgaacttgggtggtttacaatatgctgaacttcagcagaagcgacagatttattcataccagtttttcgtttcttggtgattaattttcctctgaggaaaaattaccaccctttgttgttgttgttgttgttttttttgagacagagccttgctctgtcgcccaagctggagtgtggtggcacaatcttggctcactgcaatctccacctcctgcgttcaagcagttctcctgcctcagcctcctgaatagctgggattacagcacccaccaccacgcctagctaattttttttttttttttttttttttttttgtatttttagtagaggcagggtttcgctatgttgcccaggctggtctcaaactcttgacctcaagtgacccacctgcctcggcctcccaaagtgctagcattacaggcgtgagccactgcacctagccttaccacccattttttatatatgttgtgtgttctagtgctttggttcattcctaacttggaggaagatcttaagtaaggttagagtaaggatatagatgatgaacttat

SEQ ID NO: 117651 - DNA, 1832 bp, Homo sapiens
acaggcggctgccaccacacctagctaatttttgtatttttagtagagatggggtttcgcaggctggtctcaaactcctgacctcaggtgatccacctgccttggcctcccaaagtgctgggattacagccgtgagccactgcacctggccttcctgttcttaaaagcagaatattagtaagttgctaaagagaatattaaaggatgtttaaactactttcccactccaaggacctttgggataattaagtagtttgagattgttaaaggagtttcttagtgtgagaattgcccttaggaaaaattaggctaaaaagttatccatctctagaagtgttaaagctttctaatccaaacttattatgctgctttagtaatgcaacatacctatttgtcctttattgtataatagcagactagtgtcaagtttcatttatttaatcttgaagatttggacattgttctcttttatgttctagctcgtcaagcagtaaaaacacccccccggaggttacccactgtgatggttcgctctcctatagattctgcctccccaggaggtgattatccacttggggacttgactccaaccactatggaagaggctacctctggggtgagtatatttccatctgtgggaattgatcagtgaaggggcaataagccggcagagctgagcgatgaggaaaccacttttggcctagaggcaacttcctctcttgatctgaatgctaaagacttaatttaccatgttctgtgctctgagataagaacggacctaaaagcattgaggcttttgacctttttgagagataggtaaaaaactattttaagaaattgtttcatactagtcttatgaaattcctgctgaaataagggacaaaatccttgtaaatgtaatattggtagtgggtaaggagttcataaaaggcaggttgggtgggatggttgagtcactgtgggtttgagtggatgaaagagaagattgtggggaagaaaagtatggctaagagcaggagggatagagggtttctgggcaattccactcaggactaataaaataatagttagacacactaacccatacagattagtagggaaccttccatagtttgagaagtcagataaaggttctctgttgtctcttaggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtatggagacttctgtgggtgtttgagagctgtggtgatttagtacttggaagggagtgcctgggacctaaaatgtgacatggggaataaaagttcaaaagaggaaaagatctcctaattaaatgttaattttttaaaaatacagtaagttgatagtacccatgggtcctgaggtatctgaatcacaattattttggttctcttctccagagaactcttgtcaaataagttttgaacattatagtttagagtttcccttgggtcttaaattattctctgtggatattagctattagttttcatgaagtttgatcaactgctggagctttgttgggaaatggtagtgaaggaaagcttgagtgtagccttcacctctattcttccctggtaggtcaatgagagtgaaatggctgtggcttctggccacctgaacagtacaggtgtcctcctggaggtaggcgggg

SEQ ID NO: 117652 - DNA, 1006 bp, Homo sapiens
agtactcggagcttttagagaccactgagacaccaaagtgagtacaaagccaggtacttcagccatatttctttagtggagagtatttactgaggaattctggtttatacttagttatgatactggatgattaaaaaatagcagaagttatctatgattaagtggtaaaagcaagtaggagaggggataaatgttatgttatttgaatatgaatttttttttttcaattttccacagacggaaacgaggtgaaaagggagaagtggtggaaactgttgaagatgttattgttcggaaattgactgctgagcgagttgaagaactaaagaaagtgataaaggaaacccaggagagatataggtacttatcagagagaatgccaaaaaattgagaaagacataagggactgtcttctggtactggtcagaacttttaaaatagcagattaaaaaacccagtctacctacctctctttcttcctatagacggctaaagagagatgcagaactaattcaagctggacacatggacagcagactggatgagctttgcaatgacattgcaacgtgggttatattatattgttcttctgtgcttctttctttttaccctcttttcccctcaagtaatctggcttatttcctccaattgccgtccctttagacttgagacagattctggaaggggaaagctgcaaagtggtttggtggctgggaggggggagtgagtcctagaaggtaatataatgggacatttcagtatgaaaacataacttagttctaacttaagagtggctatagtttgcctgggtgaagaactgggagttaggcagtataccccaattcactgttttgctggttagaattcctgtttaggcctttcttccagaaagtgctggcctggcaaaaaaaattactttgtaagggttctgtgaactctggggaggagccagagctgtctagcatctaacccttaattccctgtttaggaaaaagaaattggaaga

SEQ ID NO: 117653 - DNA, 1057 bp, Homo sapiens
gcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggcagtgagtatctgagcaggttttgcgtgaaaggcctttgtagatccgaggctaggcaccatatttttgttacacgcttagggagtgggagaagtgggttgcttgagagcccagggttttcagagacctgcgctctacagcatcgtgaagaccaacgtttgggggcccagaaatctggggtcttgtttctcagggagagagcggaggtgtgagagaagcagcttagtgaatcctagtgtgttaggaactctgcgggttaaccgtaaaagcactctagaaacttgggcgtgcagacgaaaagatgttatgagccagacggagtaaccggcacctcaaagagccattcatttttttgtctgacgtttgtgaggcagtggaagtggggtcttttaaccatgagcttttcttgccactcaggaaattgcatctcggggatttcagccatttttctttttttggactgaaaagctcttttacccccgacatttggagtagaggatctgagagaagtaaacaagtttatgctaagagggaggcggggtagtaggaggggctggccgctcgggttcctgggaaataagccctgaataagttcaaactggaataaagtccagtattcttaaaactgggcttttagggagaactgcctaatctgacattccctgtttcttaataaagcggagcttcaagccatggcgttttaagaaataaaatgttaataattcacatgcaacgaataggtaccccggtcactggtgatatttcacttggagaggtgaaaatcaagatttggttatagtagctcactttgtcctaacaagttgggatgttttgtattaggcttttagtcctctttttggggattttggagcttagcactacagtctcagtggttgtttccaa

SEQ ID NO: 117654 - DNA, 1392 bp, Homo sapiens
acccggacccacattagaactcagaggtcaagcagaagcgaacgactggaattccagtcaggcccgccccctttccttacgcggattggtagctgcaggcttccctatctgattggccgaacgaacgcagcgcgtaatttaaaatattgtatctgtaacaaagctgcacctcgtgggcggagttgtgctctgcggctgcgaaagtccagcttcggcgactaggtgtgagtaagccagtatcccaggaggagcaagtggcacgtcttcgggtgagtgtgcggctgtgctggagcccgggttaccagctcttgcccgcgcggaataggctttaagaaatcggagctgcagccatctgtttttctcttaatgctgcatctctgttctcacggtggtccttggggtgaggttagagaaggagccgagggatcctgacaccacctccacagcaccggcgggcgaggtgccctactttaggcgtagccttctgcttttggagccagatgtctgtggacttctgttcgcgttcagaaatgccgcctcaaacttctctcaattgttcattaagtgaacttctctcattcccttcccctttgccgataattggaggggaaaagaagtaggaagcgggacacggtgtcctggggcaagggacttattacctaaaattcgcggccccttctgtccctaaaggttcttctccctgcccactttttggtctctttttagacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggtaaaggaactggggagtggctggggcggaaagtgatatcctcaggccaataattgtccatacagggtagtatgaggtcaaagactagcaatcctaaaggtctgagatcaattcaaaattaagggcatttaggacaaaatggctatgaaaagaaaaaaagaaaaaaaaattaagggcatgacaagtaaaaaaaaaattgagttgtgtgtccagaagaactataatttgcattgcattaatgaaatagcctcaaatgcatgctcttagttaatctttcagggaataatagttatctctctttgccttgaggcccagttgtgctaaataatttgcacaaggtcatataggcattatgtaagtggaatgtatgttcaggttttaatagtatcaccatagcttcaatttgttgtaggtttcctgctaggccagggtttctcagttacagcattattgacatttggggctagacagttcttgtag

SEQ ID NO: 117655 - DNA, 3314 bp, Homo sapiens
cccccaggctggtgtgcagtggcacaatctctgctcactgcaacctccgcctcccgggttcaagcagttctccctgcctcagcctcctgagtagctggaattacaggcacctaccaccaagcccagctaatttttgtatttttagtagagatggggttttgctgtgttggccagactggtctggaactcctgacctcaggtgatccaccctctttggcctcccaaagtgccgggattataggcgtgagcccctgcacccagcctctaagtatctgttgaatgaatgacataggtgctattattaaccccattctgcagatgaggaaactgaggccaagaatttcaagaactcataattcaaggtctcatagttactaagtcatggaattgggactcaaattcaagtgtttgcctctgctttgctttaatatcacatactaattttcataccagtcaataaattcgaactcagatcatcggtgtggcaagccacatttgcaggataatgacgagacagggaagggtgacaaagtagtaaaaatgtccatgtgggttggaatgattgtggaaccaaagagtagctgcacagagacatttgaggtgaaatggggtagtgttatcatagttcctagaaactactgtttgcccatttgctcagaggtaactgctgaaattaatctgtggttctgggctgggattctgccacaggttccatctgaggacagtatggagaaggtgaaagtatacttgagggttaggcccttgttaccttcagagttggaacgacaggaagatcaggtaagtgtctgagaagggaggattcaaggtgaaatgatgcagtacaaaagattcccaggaatgccttctgtgacaactgtattttctcccttctcagggttgtgtccgtattgagaatgtggagacccttgttctacaagcacccaaggactcttttgccctgaagagcaatgaacggggaattggccaagccacacacaggttcaccttttcccaggtatggagggtactggtttgtgaacaaaagaccaacatgtaagggcaactttattccctctttagagggaaagcttctcttcctgactgtgagttccttgtatatgcacacctacaattttgagggccctagttatgtgttagtcaatgtgtcaagtaacatatgtatatcagttctgaaaaattctattgttattatcattatttccttattttcctcacaaggatagtgtggctcaatgaatgtaatattgctgaagccatgtagctagtcactagtagagttaggacctgagtctagatccatgtatctccaaagcccatacttgtgggccattatattgccccattgtgtgtgcagcatcaggcctagggcatagcattccttaagtgtttgttgatttggtggaaagatggactagcagagagtgcttgagtcctcagtgtttagggaacagccagcagcattgcaggaagaagctgcttgagtggtctccagagccaaccactcaggaaggaatatatctgctggctctgcacaggaggcaagtgggagatgaaggagaggcctctaaaaaactgggtctctctctagatctttgggccagaagtgggacaggcatccttcttcaacctaactgtgaaggagatggtaaaggatgtactcaaagggcagaactggctcatctatacatatggagtcactaactcagggaaaacccacacgattcaaggtgagtagtaagccttcacgggattcctgattggctggtaatggtgttgtttttaccttttgagactctgagttagggggagaagggcacttgcctcagctgtccatctttcatatgcctccaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggtaaagcattggtatccatggcagtgggggtagggggtacaaatctcggggaagttttgtgcttaccttctccctgtgcccctccaggaggagctgtccacttccttgaagaggagtgtctacatcgaaagtcggataggtaccagcaccagcttcgacagtggcattgctgggctctcttctatcagtcagtgtaccagcagtagccagctggatggtatgtaccgtgactgggctctgccaaaaaatagtaggaactcactccctgttcctaatagctgccaggagtacagaccagaggttgcaatctaaggtctgccttccaaggcccctgcaggccaaaagagaggtgaactgctctaggttgatgccctatacattggcttcttctccagaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaaggtaaaggaacatggggaaagctggcatgaaccctggagggcaactggggagagactggcaaaagagttggatgttcccatcttacacccctctcctttggccccagatctcaactggattcatgtgcaagatgctgaggaggcctggaagctcctaaaagtgggtcgtaagaaccagagctttgccagcacccacctcaaccagaactccagccgcaggtgagtagattgtaagaataaactcttcactgtgttccaggaaacattagtcctctgcctggtcatggaaaatgtgcaatgactttttgtttttcttaacttccagtcacagcatcttctcaatcaggatcctacaccttcagggggaaggagatatagtccccaagatcagcgagtaagtttatccatttagaaatttgggcttcttggccataaatgatagttgggaaagcatggaggaggtcctcaggggaactatgtgttctccttctttgggtacagagattcttagtgggccgtcccctctccagaattatacaaagggccagaaggctcataacatgtgaggcccttatgtcagatcctgtgcatcattctaggctgtcactctgtgatctggctggctcagagcgctgcaaagatcagaagagtggtgaacggttgaa

SEQ ID NO: 117656 - DNA, 1055 bp, Homo sapiens
gaattatagtcaaaagctcaccggttctgctggttttgacgaagggcagcaatacagcggcccagggtgtgtagagaggtgttaatgtttcctgcttccttcaaccgttcaccactcttctgatctttgcagcgctctgagccagccagatcacagagtgacagcctagaatgatgcacaggatctgacataagggcctcacatgttatgagccttctggccctttgtataattctggagaggggacggcccactaagaatctctgtacccaaagaaggagaacacatagttcccctgaggacctcctccatgctttcccaactatcatttatggccaagaagcccaaatttctaaatggataaacttactcgctgatcttggggactatatctccttccccctgaaggtgtaggatcctgattgagaagatgctgtgactggaagttaagaaaaacaaaaagtcattgcacattttccatgaccaggcagaggactaatgtttcctggaacacagtgaagagtttattcttacaatctactcacctgcggctggagttctggttgaggtgggtgctggcaaagctctggttcttacgacccacttttaggagcttccaggcctcctcagcatcttgcacatgaatccagttgagatctggggccaaaggagaggggtgtaagatgggaacatccaactcttttgccagtctctccccagttgccctccagggttcatgccagctttccccatgttcctttacctttcacatagggattgccattttgatcctcgcatagccgcaaagtctgcctcttgcgctgttggctaggcggttctaataggtcataaagcagttcgttgtagatctcaaagaatgagatccagatggagaagcgaatgtttgccgggacaggtagtggggcagtgtctggctgtgcccatcgatgacttgtttctggagaagaagccaatgtatagggcatcaacctagagcagttcacctctcttttggcctgcaggggccttggaaggcagaccttagattgcaacct

SEQ ID NO: 117657 - DNA, 1647 bp, Homo sapiens
gccaagttctcagccattgctagccaggtgagaagctagaggtgtgatgggtgtgcgcacttggaactggtaactctaagaaagctcctagggactacttatggagtcaagtaagatattttttttccctctagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggtgagaatacaagaaagctttagtgtagcagcttagtagctacacatttttccatggtgccttccaggtgggcttgtgccttctgagggcatgagcatctgatgacctctgacatgtgtgtctctcctaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcaggtactagctgagtgacccctcttgctctgtcacctgagacagagggtgggaagtaaggagttaggtggagttgtgcctcaagatctgttccccaagttcactcctcagaaccttcacttacctctcttttctcctctgtttctgacagtgaacatttggacacccaaaaggaactattggaggaaatgtatgaagaaaaactaaatatcctcaaggagtcactgacaagtttttaccaagaagagattcaggtgagttgccctgagccagctccaattagctgctcagatttccatcactagcttgcctgaagtaaagagattttataaactactccagtaagggcaggaatatataactcccttttctctattccccatagtgctttgggttcaatctatgtttggtgaattgattaagggtttagttggccaggaaatcgtattaagtgctaacaacaggttttcaagggatcagtgtcacaagtgctttgtttgttcagtcatctgtcttagcaatatttttctggctctgcaaagaattgtgctctctgcttccctcttaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaaggtgaggaaagagacaggcaggaaacataacagtggttcagggaagagctgttacttaaacccaggccttctaactcctgctctaacataatttcctaaactgcaagctacatccccctgacatttcaatctaggatacacatagcctcactttttatatttgctgcaagctactgttacctcagttaaagaggttagtccaaggctaaaaaaaccccacatattttaagtttcctgtttccttccctcagagttgcataagtatcagaaaatgttagaaccaccaccctcagccaagcccttcaccattgatgt

SEQ ID NO: 117658 - DNA, 1018 bp, Homo sapiens
ttaaaattgtgtatcttaaactaaactcaacatttaatttgacatttagagactgaggcacttagaaattaaatttactcaagctcatactaccttatgtgttagaagatgtcctattcagcactgcttatgttttgttctcagaaaatgtccccttattcagttataagctccgaccttaaagagttttaatctttgaagaaacagttgttagtaactagtaatggatggtatgtattacccttagccctctcgtttctctaatataccagacaaaagtgttttctataactttattgatcttccttaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacagaaaaattaagaatcaaacatcattctggaccatgggaaccttgaaaaggcatggcagtggagaccagtaactagtatacagcttg

SEQ ID NO: 117659 - DNA, 1034 bp, Homo sapiens
tgtgtccaggagttcaagaccagcctggacaaaaaagggagagcttgtctctacaaaaattaaattttgccaggtttggtggtgcatgcctgtggtcccagctactcaggaggctgaggtgagaggatcacttgatcctctgcagtgaggtcgaggctgcagtgagccttgatcacaccactgcactgtagcctgggtgacacagtgagactccatctcaaaaaaaaaaaacaagcaagcctcccgcctccttgatctgtggaacttgtttaacagcatcttaataacttgttttcgagactagctttggacatgttttgaaacatttccctgactttgttgcagacccgggaagaaggtaaggccttactccggcaaatcctacagcttcggaaccaaggcgagactcctaccaccgaggtgcctgctccctttttcctacctgcttcactctctgctaacaatacccccacacgcagagtttctccactcaacttgtcttctgtcacgccatagttggctactctcaagccagcacattgttagacccatcttaattaagccttacctccatgtaaagaacagcacgtctgttccaaggacctcagctcttcttgtttctacagatggcaacagctccatagggacagcttgtataattaccttcagaggccaactgacagaatcctggcaggaacagacattatcttgccagttagaagtacttctgtctcacttatgtccaaagagtggctatagatcttggccttcttccctgaatgctttttttttttggcccccaagaaagtcccttttatagcactttagcacaggcaatgctacaggaacaaagtttcaatgctgctgagagtgaaagaaaggaggaaagtctgccactctaccctgagctggcagtagggcactgagtaccctaggaagaagtcagagcaatggatacaaatgaccttgctcttggatttgctgagcatgatccctattctgatgtcagagattaggtttaaatggaatagagc

SEQ ID NO: 117660 - DNA, 1018 bp, Homo sapiens
agtataattatgaacacaaagtaatctattatatggagcatcaggttaaagaccagttgttgcatagatttgaaatagtggtgtactggttcctcaaaagagaacttcagtttctgtaaagtctttgctcagactgcctgttcttctttctcagacccaatgattctcgcatgctggttgctttaggagaatgttacgagaaactcaatcaactagtggaagccaaaaaggtaccttaaattgggtcctgaagaatttgagtggaaatctgctgtttagatgaaggttgggctatctgtgctctaatttttcccttattctgatctaggtgcataggaaagtctgaatatttatagatacatagtctgaaagcaaagctgggccaaggtcatcagtgggaatgtcagtgtgtagcctagacctatcagaactagtaaaaatgtcttgcattctataaatctgaacttctgggaggcttgcagggtcttaaccttcatatgatttagttgtgacacatgggacaatggtcaaaatgaccagtttatttttttgacagtgttattggagagcttacgccgtgggagatgtggagaaaatggctctggtgaaactggcaaagtgagtgaaaggagtgaaatgctattgatatttctgttggcttctctgggatggtgggtcctgcatggtctagagcctcccatacacccatcattctacataggtgtagggatgtagcagggtgtgtgaatgctggtttgtgaatgtagccatcttgttcctagagaatgccacttctggccaggtgcagtggctcatgcctgtaattctagcactttgggcggctgagggaggtggatgacctgaggtcaggagttcaagacctgggaggtggaggttgcagtgagccgagatcgcgccattgcactccagcctgggcaacaagagcaaaactccatctcaaaataaaaaaaataaaaagagaatgctacttctcttgaaggagggccgttgctttcct

SEQ ID NO: 117661 - DNA, 1052 bp, Homo sapiens
tatgaaaatgagctgggtacagtggctcacacctataatcccagcactttgggagtctgaggcggaaggatcacttgagcccaggagtttgagaccagcctagggaacatagcgagaccctgtctctagaaaaataaataaataaataaaataagaaaatgaaaaccagcatcctaaccttagaacagagactctgtttctttcctaggccccctggaaaaaggacaagtgaaaaatgaggcgcttagagaattgagagtggagctcagcaaaaaacaccaagctcgagaacttgatggatttggactttatctgtaagtgttacagtaatttggaactttctgtaacatattctcctgagtagaaagcagctattaaatagcattaacttctgtgattgtttcttttttttcccaggtatggtgtggtgcttcgaaaactggacttggttaaagaggccattgatgtgtttgtggaagctactcatgttttgcccttgcattggggagcctggttagaactctgtaacctgatcacagacaaagagatggtaaattgtgatgagctatgtgaaaaaccctctgcttcaagccttttgtaattctgtagtaatataggggtggggaaagttttggcagggctttggttatagttctccctttgctgcgcctctggtgtcttttcgctgttttggaagtaagtctttgtttgaaagactgatgactagctctttttcagtagttgctgttggatttgtatccagttatactagaatatttttttcatattcatgttttcacatttcagttctattgtgacttgtttttgtttttgtttgagacggagtcttgctctttcatctaggctggagtgcagtggtgcgatcttggctcacggcaacctctgcctcccaggttcaagcaattcttctgcctcagcctcccaagtagctgggactacaggcacgcacaaccatccccagctaatttttgtatttttagtagagatggggtttcaccatgtcggccaggctggcttcgaactcctgacct

SEQ ID NO: 117662 - DNA, 1042 bp, Homo sapiens
ttatgagtgttcgtttagttttttaaagttttcttttttctccatttttttattttgaaaaaattagaaagaaaaacttggccgggtgcggtcgctcatacctgtaattccagcactttgggaagccgaggcaggcagatcacttgaggccctgagtttgagaccagcctggccaacatggcgaaaccccatcactactaaaaatacaaaaattagctggaagtggtggcgcacacctgtaatcccagctactctggcagctgaggcacaataatcgcttgaacctgggaggcagaggttgcagtgagctgagattgcgccactgcactccagcctgggtgacagagtgaggctctgtctcaaaaaaaaaaaaaaaaaaagagttctatgggcttacttggtaataaaataaatatataaaattatatatatatgcatctacatattctaggtttttaggaggaagaaaacaatcctttttcttttacatcttgaaattaacgaatatactttttagatttgaagttttgttgtcctattcccaaccacttacataagcttgtttcttttttaggaagatgcccaggatatggatgcctataccctggccaaggcctactttgacgttaaagagtatgatcgggcagcacatttcctgcatggctgcaatagcaagaaagcctattttctgtatatgtattccagatatctggtgagggccattttaaaatgtcattctgcctttagtgaaacatccatatttagaaccaatggaaaagttaaatcttttaaatagcttagcagtgggccactgaatgaatgtactttatacatagcaataataaaaaaaagatatcataaataaagttaaaaaggatggtagagaagaaaatattcttaggaatgactaacaggataagtaacaacctgattatttatttactttaggttatataaggttcttcatgcctgtgaattaatattattgtgtaagaattaagttaaaaagcctgggctgacttttaaatttataaattcattt

SEQ ID NO: 117663 - DNA, 1311 bp, Homo sapiens
acttactattcatgaacattcctcgcagtgatctctatacttccagtggttcaggtctataaacatttattgaccatctacaagctctatgccaggcgttcagggtatatacagagatatacttagacccctgccctaaaggtgcttatagtccagcttttctggtccacattatcccaggttggcgtctcagtcatttctaagtattggcactgtctataagcccctgaggaaatacttactaaaattcttcttctacagggagccttaaacttatatagtcaggaagaactgtttaacttctttctgaagaagcccatcgtccctttggacacccagaagagaataatcatcgtgttccactgtgaattctcctcagagaggggcccccgaatgtgagtgtctaaatggggtctggcgggtgatggaaatggattttgagttggacttcccacaccagttcagacagagactgactggattctacagtttgaagaatgttagggaggttgaaggaagacgtttctaaaattgaaaagtttgaaacaataaaggaaaagggattgagaatgaggctgcagtggaggaaaggaggaagggtggtactacttggacctttttttgcaaacacagggagattggaaagtcctttttgaggttggcaatagtctactcctctcccccctccccagtgaatggcccctgggatcctgaccttgtttctttccaccccacccatctctgggttctctctaaaggtgccgctgtctgcgtgaagaggacaggtctctgaaccagtatcctgcattgtactacccagagctatatatccttaaaggcggctacagagacttctttccagaatatatggtaaagggtggggcatgcggggagccaaactttaacaactcaactcccagggcctgcaaagccttcagagaagaaactgctgctcctccttagccactgccagcagcagcatctctattatccttcataggtagagttcaggagtctagagaatcccttactctgttccttacctttcaggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctg

SEQ ID NO: 117664 - DNA, 1052 bp, Homo sapiens
tgacagagccagattccgtctcaaaaaaaaaaaattagccccaatacactgtgctggaaaattagtaaattgtaaattgtataaaactcgttcatctttggaacatgttatatggttatgcaggcaaaatgagggtcttatccccaggatgtcacttgagtcttgatatttaccacagagaataccctatgtattgttgttggaagagacatatcaactaggaatagggctcctagaatgaaatagaaaaatgttgggatgcaccaatccactgaagaataatcaaacagtatttgggactaacctgacaggcagtttgttttaatctgcaggaatcatgaccagcacctaatgaaatgtagcccagtgagtagcctctctttttttgggttttgttttgcttttcaggtgggaggcagagggtttccattgcacctgtggcttgaggatgctggacgttctcagcaaactctcttttttaggcacagcttctttgtagcactccgaatggtttggaccgtggccatagaaagagagatgcaatgtgtagttcatctgcaaataaagaaaatgtgagtgtttaatggaaacctagatatattggcagttttattttttgagtgaagaaacttggtatcataatgagacatagaactgtttatacctcgtatgctagacaaggaaactgtattactataggggagaaaatttctttgtttttgttttttcttattaaagtttggccctaggacagacacccagctccaaatcttccacagtaggtcatcattatttctcatgttcagttgatcattttgaggacaaaaattacccttactgtagtgtaagggatttaggagttttttgtttgtttgtttgtttgttttaacaggtagggataacttgcataacttgttcatggatttttttttaccactttacatgcaagtgtagattaatttcttatttcccccttagtctagcttttaagcccttattccgaggaggccatggtactttttatctaaaccttaggccatccgtcgttccaa

SEQ ID NO: 117665 - DNA, 1047 bp, Homo sapiens
aatattccaaaaggaatgtttcataagttaaccttccagaattctaatttcagattttctgagtgataacctttcttttctacccataagaaaaaaaaaaactccataggtagcatagtgtagtgtttcccaacacttgatttcttttagtgacacatataaattcttacgtttctgtgaaattgtaccttgtaccatgaaatgggtaccaatcgagaggctttgtattcaaaagctcagtccttgaaattaatacggcttactggtaatgaagaaaatctgaaggaaaaacaggatgcatggacaagaataactccttttactgattctttatatttgattgcaggtcacctggattcttcaggacttcaggaagtgcatttagctgggatgtaagttctgttgttaaatgaaccccacacaaaagccttttagcactggtcatagagattttatcctgtgcagactctgcagagtacaaaacctttcatactgggtataagtgggctttgaggcctagttccttaccttgaacagtttctaagttttccacatctaaatagtgttgtgaaaatgaaggctattcattttaaccatcataatcagaagtatctataaggaaatgaaggaaaatggtatactacacttatgtataggcttttatttgtatgtgaaaggtgctgtatcttagtaattgaaagtacagagtggccggacacggtggcttacatctgtaatcccagcactttgggaggccaaggcaggcggatcagttgaggtcagcagttcaagaccagcctgcccaacatggtgaaaccccgtctctactaaaaatacaaaaattagctggatgtggtggcacatgcctgtaatcgcagctacttcggaggttgaggtaggagaattacttgagcccaggaggcggaggttgcagtgagccaagactgcgccactgccctccagcctgggcgacagagcgagactccgtctcagaaaaaaaaaaaaaaagaaagtacagagtataagctctggaatcagtgtgtggat

SEQ ID NO: 117666 - DNA, 1059 bp, Homo sapiens
tggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgaggtaagtccgcagccgtctccgccacggaatcacggagaccccattgtcccccttagggtccagtcgggcccccacagacagaggttgggagggccgaatggggactatcgcgagttacgagacccgggttctttctagtcaggagtctcgagctgtgtggcgtggaacaagtcaaaatcctctcttcattccatctttaaggtcctaaggttgcctctcgtcggtgaattcaggttctaaccttaagccaggctgtgaatcacccttcggggttgcccctcttccagtgttgattcgcctggctggaaagggtggaggagtttaggaaagctgagggaactgtgatgtaccgatttagatgacgttttcctcctagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtaaatatacttttatttttacactgtattgcctttgctatttccaaacagttgggtttgtttgttggtttgttttcaattatcccggctcaaaggtcaggctttaagtctcaactctgcccttgactgtgtaacccttttgagtctcaccttcttttctgtgacaagaaataatctcagccaggcgaggtggctcatgcctgtaatctccgcactttgggaggccaaggagggcggatcgcctgagtctaggagttcaagaccagcctgggcaacatggcaagacgccgtctctacaaaa

SEQ ID NO: 117667 - DNA, 2568 bp, Homo sapiens
ctgagcaagaatatcaacagccgcaggcgttgaccattcaaaccttccgccagcccagtaacctatccccgctcgcctctaagctgcgtcagccaatctccgcgcgcgcgcccagggcctcatggcctatcgttgggctcgcagatcacctgggggcgtgtgcttgctctggaaatggtaagacttgccccgccccatagccagagcaggatagtgtttggcccaccagcgttaggcaggctgcggggtaagctccgcctcacggggagcctggcgcatcattggctctccctctcaccaatctccacaccctttctgttttcctcgttccctcagccccacgaaccccgggagatttaaaccgcgccttactagtgatgtccattcactagggtaatactaggagagattattttgggtggagggtgttgtaagcgtttcattttcttcgcttctttctcgtgccgttttcgcggacgttttcttctaagttttgctggccttccacgggagatggagcgtttgctgccggcgtggcaagtgttggggcgagacgggtgtgtgtgtttatgctgagaggcattagccccttccaagagctttgtttggtgtttcttttagtgtgcagcatctcagagactctagctcacgtgggtaaaaagaaattccgttgcagggaaagtggaggaattaaatcatcttggtataatccttatcgcaatccagaggacctcaaagattggttattaatgaaaatttgaacattgacgaggtgatatttataaattattggccggacgcgttggcccacacctgtaatcccagcactttgggaggccgaggcgggcagattacatgaggtcaggggttcaaaaccagcctggccaacatgatgaaaccccgtctctactaaaaatacaaaatttagccggttgtggtggcacacacctgtaatcccagctacttgggaggctgaggcatgagaactgcttgaactcgggagacagaggttgcgccactgcactccagcctgggcattagagtgaaacaaacaaaaagacattcctaatgttagggatttgcttttaaataatcctgtgctgggggaaggtattgatgatacaagattgaccctgactgttgagtgatgggggcaggagggtccatcatatctgtgcttctcaaggtttaatttgcacactaaccacctgaggacctgctaaatgcagattctgattcgggatgtctgggttgcggttgcggcccaagattctgcccttctaacaagcccccagctgatggtgaggtagctggtcctacgaccatactttgcgtggtaaggtattaccccatacttcttacttcaatgtatatttgaaaatttccataataaaaatgttcaaaataaccttggaagctctttaagatgtaggctccaaaaacgataattcgataggtctaaagtggggtcattatcaaggcccccaggtgctacccatgcagacggcttgcagatcatgctttgagaaacaaaagtcaaaatgcaacttgtgtctgttgtcaggatcttggtggtggtagtggctgagaggcacagtgtagccagctggtttttatcctaatacccttttcatctgcagaacctgcttccccagaaaggagatgtgtgaagattctttgtcctctaggatacagacagtgagtgtaggagttagcacagaaccttgctatgccaggtgagtttgaaaatcaggctggggattaagggagtgtgggatgagttgttatctgctttgacgactacagtataatcacactttgtgggaaattgtatacttccctgcaggtgggaagtagagacaaagttattctctattggtggcaaaagcagatagattatggcaagtgcacacctggctaccagtgctttctgcaccaggtcctcaagtaagtgcagttgtgggtggtcacaacaaaggtgtcagccaagtggctttagttcaatgtcaggtgatggaaatatactaaaatctgagcactctgacaaagttgcagcattcctaaaacaaattctccaaaaatctagccccaaaaataagtttctgagatttctcaaatggaacttatacacctagctcttaagagtattttttttttttttaagatggagtctcgctctctcccgggctagagtacagtggcgcaatcttggcccactgcaacctctgcctcctgggttcaagttattctcctgcctcagcctcccgagtagctgggactacaggtgcccgccaccacgcctggctgatttttgtatttttaatagaggtggggtttcaccatattgtccaggctgttctggaactcctgacctcaaatgatccacccacctcggcctcccaaagtgctgggattacaggcatgagccactgcgcccggccgcccttaagactttttacagatgcagtggtgcgcctgtagtcccagctacttgggaggatcacttgagcccaggagtttgaggccagcctgggcaacatagtgagactgtctcctaaaaacaacaac

SEQ ID NO: 117668 - DNA, 1026 bp, Homo sapiens
agcagaaagtcttgcctacaaccactgttcttccttgttctcttattactatttctgtagtttaggagaagggtacctcttttcacttctgactggaagataaaatactgggctgatcttgatggaaataatcatttgggcatccctctctctcacttgagcagctgttttctaagtggtgctggtattccagttagaaacaacagagcatgaaccagtttaagggtagcaaataagtttcaacttgattgccaactctattttatttcatatctggactgccaagttcataatttctgaagctgtgtttaggcttagctggaaagagctgtgatcaattgatgtctgccagaggcctggcttaggggtgctgtggtatgtgtgccatgcattttccatctctggaccaggtgcatctctaatatcacttggggctggtccctctaattggcagactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctggtaaaagaccagtcttcctgcttctccacgaccccctcccccttttttctgaggctgattgttgctattactttactcttgtcctgtgctgtatgaatcatggtacttaacctggaagagcccactaatggctcaaaacccagcccaaaaggaagggggcagggatttttccaccgatagagaagggacagcaaaacttgggtggagaagggtttgagatgttggaagatgtggattgtttgacttactaactttgggaagacaagaggaagaacacttaatgtccctaacatccctgtagctcatgaatcgcagaggagaactgaagagggcttcctagaa

SEQ ID NO: 117669 - DNA, 1400 bp, Homo sapiens
ccaagcccaggtttcactgtcaaaggccttccccaccctgtttgccctccctaggaataaaagtgatctcttacctgcctgattacctcttacttcttggcagtcctaactcctgacttggtgctgttgacacatgagaggaggaaaggccgagaaagaagagcataggcctgcttttcagcatccagggcaagcgtgggggaggggcgagggagagatgagcaggacactcacaaacgtgtttgtttctcttgacttcttttacctttgagagggagtggcaggcagtagatgaaatgtttttgattccaggtagttggtcacaatggaggcaatagagcatagtggtttaaaaacctagccttcgcatcagacagacctggatttgaatcctcctttggtcttttgagtgctatgtgattttgggaaagttattgaatttctcttatctgtgaaatggggataatgataacgatactacctacctcataaggtttttggaaattttcacataaaatgctccatacattatgtggcaaatggtaagttcttaaaaaatgtaagctatcattaatattattcttattataaatgccttccagaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcaggtgggaccagcaa

SEQ ID NO: 117670 - DNA, 1088 bp, Homo sapiens
gctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagcaaccttgtgtactacagtgtcttct

SEQ ID NO: 117671 - DNA, 1040 bp, Homo sapiens
cttgccggcatggcttccgcgtcggggtgtgcgccccggtttcccccggggggcggccagggcgtccggagctgctgcttgcagccagcaggccccgcctcctgggcgacccttttctcggcgttccccccaacacgccttcggagcaggctctcgaatcttgagctcccgggagcctcagagttcggccagtgttgccgctgccctctcgaagacgcggacctgtggtccccagcctctcccaggagacctgcgccctgttccttttctcccagagccccaagtggggcgggaatgtgggcagttatgggaggcacggaggctgcagttggagctggtcggggcttttttatctggcagttacttcctcatctgagctgggctcggcctggcggtctccagaaaggccagctctcggcactgtctcgagctctcctctcctttccttaacgcttctgggtgacaggagctgcagttgtggctgtttttgttaagtttgagatctttcttagtggccgaacggggctgctgggtagtgctttttgctcccagctcagctactcccccaaccttgggagaggttttgttttgaaactttgtgtttgggcttggccctttttgaatgccttggtgtgttttgtgattaaagttgttcagtcatacaacttaactagcattcgggatcatgatgtgttattctcgttaatgtggcggtaaaatatagtgtttgagttttggcaagccactttatttcctcattttgataggggccctagcttctctggtgagataaggctatgaaaaatggtgtgtgtgcgtgttggggcagggggtggtcttttggaatgtaatagatcagcaagcagaaagtaaattttcttgatgaacttgcttttgcagatataaacgggaacgcagtttgtgagatttggaagtaatgttgtaggcttccgatgttcatttttcttcctattgatcaacggtgttagactgtcctttttcactaatatacaagctttatggattttttttgtggatgg

SEQ ID NO: 117672 - DNA, 1362 bp, Homo sapiens
gtcggcttgctgcaacctccacctcccgggttcaagtgattctcctgcctcagcctcttgagtagctgggattacaggcaagtaactcggattacaggtgcctgccaccacacctggctaatttttgtagttttaatagagacagggttttaccatgttggccaggctggtctcgaactcctgaccgcaagtgatctgtctgccttggcctcccaaagtgctgggattacaggcgtgagccaccacgcccggccattaatttccatttgtttctaagggacttgcttcactaactccccacctgccaagggttcattcccttttttttaaatacacagcttcctgggtctcttctccaacttgtagtttatttatttagttccccttccaccagcagactcaaaatggtgggtaagaaacatggcattttccattgtgattttctttgcaacagctggggtgggttctatataggctttgcttccacaaggcctgggggatgcaacacctgttgatgcttctcagttttccactgcctttgacaggttggtggtttttaagccctttccactgtaccatccctactgcccctggtgcgaaagcatcatcttttgctcttgatctctaggtgggtaaaacctgcctgattagtagtgattcagatagtgtgacctccttcagttttctaagggctgaaactcctttttttttttttccttttttcatgacttcagaggtaatcaggctctaggggactgattctctctaaccaaactctggagactgaattgtaaatccacatgcaaggttattaatttacagtgggaggtatacctatccagagatctgcatagagccccttcctgctctgctctagagaccaaattactataagaagggtccttgatgtgcaaagaattggacaagggaaattgggtgttgccaaaaggctgtttaaagcaagcagccttgattttggtgatccttcacttttctagtattttctggcttccgttgctttgttccttctttaaacttttcttttaatgctgtcatccattgaaatcctatacagagaaaagaaagcctgctcatccttcaggcccatgcatcctaggagctacaaaccctataaagcctttctgattccccagcatgttgtttttattctttgttcctttagcactttgtggataccactttttggaatatttattgtagtttttcttgttatagatatgtgtagcaagatgtatagcttgtgaagaagttcaggaaacgccaccccaaaatatgctgcattggatctcaaactgaaggcacttggggagcagcagatggagggctgtctctgaacttact

SEQ ID NO: 117673 - DNA, 1092 bp, Homo sapiens
gagaagctcttgtataataagtgcatgtgaggtctcttcatgacttttttataggctatttatttatgaaatggtaatatgaattaaccatgcatatttatgctgttaattattttataaatttcacaaagatttcaagagttctgagatgataacagtataactctttattctgggaatttactataatttagctcccttgaagcctaataagattagcctgatccctaggcagaattaggagaatttctgattcctcttgtcctttttagccaataagagtattgagctgactttctgcattagttagcttcccatgactatttgaggggtagatgctaggttgggaatgtttccaaggacttatgctttagcttatctgtatttactgggatgaaagatataataattatttctttgaagttagagatttgtttgaattgctgtttttttattcccaagttctaatcaatttcttgtcattgtacttcacagacttttactccccttgtagataaactgggtttgggttctgtggttccagtggaatatcttctggatcgagagcttcggttcctgtcagatgccaatgggttgcatctgtttcaggtatttaacacttgctttagtcttgagcctattatttttttcgctgctaatttctttgttgatataaacataggtgtttctccttttactgggtgggaacatattagcatttcttttattacttcctccaataaatatgctgtgccttttttattttattttattttatttatttatttatttttttttgagacagagtctcgatatgtcccccaagctggagtgcagtggtgcgatctcaactcactgcaacctccgcctccccggttcactccattctcctgcctcagcctcccgagtagctgggactacaggcgcctgccacaaagcccggcttatttttttgtatttttggtagagatggggtttcaccatgttagccaggatggtcttgatctcctgacctcgtgatccgcccgcctcggcctcccaaagtgctgggattacaggcgtgagccaccacgcccagcctattttattttt

SEQ ID NO: 117674 - DNA, 1035 bp, Homo sapiens
ggctggatgacttataggtgggatgtttgtttttgtttttttctttttttttttgagatggagtcttgctctgtcacccatgctggagtgcagtggggtgatcttggctcactgcaacctccgcctcccgggttcaagtgattcttctgtctcagcctcctgagtagctgggactacaggcgcacaccaccatgcccagctaatttttgtatttttagtagagacagggtttcaccatattgaccaggctggtgtcaaactcctgacctcgtgatccgcccaccttggcctcccaaagttctgggtttacaggcgcgaacgaaccaccacgcctggtgatctttggtttttagcagcagatgttgggtcttccttttttggtattaacatgatattactgttttctttgctagcagagtccaattattttttatagttctgccaagttttatagtaaccctttttagagatccatgatcacctcatctcctttaagtatgggtgaatgaacaagaaagaacagagttcactgattgtgatctgcaacagtgaaaactgggtggtgatagagattgagaaagaatttaaaagcttttaaaaatcaaaagaggccgaggcaggtggatcacctgaggtcagagtttgagaacagcctggccaacatgatgaaaccctgtctctactaaaaaacacaaaaattagctgggcgtagtggcgggcacctgtaatcccagctacttgggaggctgaggcaagaaaatcgcttgaacacaggaggcggaggttgcagtgagctgagattgtgctattgcactccagcctgggtggcaagagcaaaactccgtctcaaaaaaaaagaagaaaaaaatcaaggccaggcgcggtggctcacgcctgtaatcccaacactttgggaggccgaggcggctggatcacgaggtcaggagatcgagaccatggtgaagccccatctctactaaaaatacaaaaaaaattagccgggcgcggtggcgggcacctgtagtcccagctact

SEQ ID NO: 117675 - DNA, 2007 bp, Homo sapiens
gttagagaagatgtcctatttcagtacttaaaatgcaagtttctttcaagcaaggaggtaaatatgtaataaagtgagttatttcatcaaggggtaaatgagctcccaccctagctttagcactctattttgtaaaagaaactcaacaaattgttaaaaccctcaaagaagtccatttaaggcagtgtaatgttttatttaagagaaagtttgccaagtgagttaacctctagtaactattatcttgaatgtgtgtgtataaattgagtcacacaaagattagagcttttaacaaaggggatgttttagaactggcattggaacttggcagtctatgcctgctttgtctgcttctagagatgggaaagagctaatggtgtgtggtattcacaggatgaaagtttccttgtaatcttttttgaattttgttttgtaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagaggtgagttacttcaggggcagatttgcaagatttgggtttactctttcgccctcctttattgctaacattaaaaaacattcaagtgccccagggaaggagtatttctgagatgtgcttaaattatactctgtggaaggcctttactgctcactgggcaaatgtgtatagtttaataactttatcagctcttaaaaggcaccagaacagttgggtgaatcaaaaactgatgatacaacctaatttaaagacatgttaaagtagatctggtggggaatgttttaaattctattatctatttagttcacgtagtgatcaagcctctgctaggcctataagaggtgaggttaatgaattacagtattggtaatagtgaatactataattaaggctatgtgtgcaagctaccattaccctgttttcaattcatcattttctatgatattttcccttgaggctgagttaatttccatcatttgatatggccatggaaggttttttctccctatcttcacctttttaagccttacctgaaaatttgatggatttcatcacaacagtatctgatttcctttgttctttatctgatatgcatatattgttgctaaaatggaacctctgttaaatgtaagttaacatcaagttgtctccctaatccaaaatatcaaaatcagtataatatattctttttgactaattttggtcaccaaaatatgatttatggtgctagtcatcttttttttccccaaacagctattaactcaagctaaaatatgaaatacagagatgaaatgcttaatgatttttaaaaattatatataggaaactactgtgtgctgagtactgtatattatatataaggaattgaaactcctatttgaaggagctcacatcctaaaacggaatcatttcagaaaaaacaatgccagacaaaacatgacaaacgtgacttctttccctccccaacaagtgca

SEQ ID NO: 117676 - DNA, 2255 bp, Homo sapiens
ggttgacttgaacccataaatagatgccgaaatccaaaagggtccatgttgtggactttcagattaataaggaaaacacttttctttaacgtgcagtaggcttgtcctaggattaaagccactttttgtaaaatgggcaattttacagtagcctaaataaatcaaaactttaacaatagctcccaaggtcattgagatatattaatattacaggggtcactgtaaaagctgatgtctattcaggaacccttttctccagttccttagaggagctcttcacttccaaatagataccaaaaagcctacaaggccttctagcactgtgacgaccaattggataacaaccaagggaattgcaggatgaatgacatcctgctatctctggttcaccttgctaaagatgccctcagtgtagtctgtggcagatttcttccccactgctggtgaactccagttacaagagcagatccatggaattgtaaaagagaaaagttgatggacccccaagaaatgttgatctggtgatagtgaggtccaagaaagagatcattagattgtcatgagaagccagcatcactaattcaggctatcttcctttcagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaaggtgatcctgctggggctatatttgggctttgctctggcactgggctcaaatgcctgtcgtgttcttgtgcagcagaggcactcactttgatggagagttctgtaatctcatagaattacagagccaagaggacctggcagaggcccctcgtcaggcctggttcagggcaggattgcatctaaaccggcactgtaggaggagtatctgtcccaaataatgataatcccccaaaggaggactcttgatcttccttggcggtcagttatttttggtcaggaactatttctttgcatttgtctcatccctttttacttcactttggcccatcctctttacttcagaggggttactgggaactggtatccattcccacatagcagacatttgtagacttgatgaagcaga

SEQ ID NO: 117677 - DNA, 1387 bp, Homo sapiens
agaatcacccctcagtttgctcctctctgaaacctacataaggattttaacagctctatcaaaatccattaacttgtgtggtgtgaggttatggtccagaagcgggtaaaacaaagtctcatggtaaaagcagctgttctcaataggaattgctatgttgtgggagctcaagaggtcctgatgaacagaatagccatatcgtgagagactagaggcaggtgatggctacattctggcttcttatgtttttcacatccatattcaaagttgttttgccatagtggggcacttcccacaagttctgcatggttcttagctcccaatggaagcttctttgctccttgctttcccttcctgtcaaggatggacataatgggtacatgcccaagcagggaaaggagtagcaacccaggtcagaacaaatgtctgtccccaaaagaatcatgctattggttcctgtttacacctcatgacaaacttttcttctctcccccttgccacagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggtacccaaactcctgttttcctcctttgctagttttcattagtgacacataacttccactctttctctgagtctataaacatgtttcatcatcttggtctttgctttcctcaactcctttgctctcagcgtctgtgaagaggctctggcatagtagtcacttagttgtttggattgtaaaatgacatgtgattttgtccttggagaattaaaattgagcagtgttagctgcagctctgtgctattccctgagtaattcctaacttgggttggttctatttgaaaccactattataagcagaaggactgcatttcatattatggatctacctgactgcttattcctcctcagtgctagagtaacttgagtcatgttaaaaagacggggaggtaagatttggagataatgtgaagcatctttgaaatagatataactgatggaaatgtgggaatatcgtctgcttttaccaaacaatatctctttagttacttttcttctgcttgataaacttagaaggggagtttcttctgagtgacctttcaagaatctttaatttttaaagtaaatccaaatggtttaccaatatggtgtggattcacttagcaaatgtttattgagcatttaatgtgtgccaacccttgttctggccattgaatattcagcagtgaacaacaaaaaaatc

SEQ ID NO: 117678 - DNA, 1474 bp, Homo sapiens
ggcattgtggcgtgcgcctatagtcccagctactcaagaggctgaggcaggagaattaattgaacgcaggaggtggaggttgcagtgagccgagatcatgccacggcactccagcctgggtgacagagcaagactctgtcttaaaaaaaaaaaaaaaattggaaagtaggtctgtgtttttatctggtcacattcagcagtatgggtgcaggtgtagaacaggtgaatggaaaaactaagaggaactctgggacagctttttaaagaatctagacctactaaatgttatgttaacaagctttactattagcagagaatgcatactgttttggtcgactggtgaaaattcttagtctgattcctgttgtctcattttacttctgtttaggtcccaggagtttaggtgtgtgttagtttgcgttgctcctgcgatttaccatgtatttgatcatgtctcaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccgtaagtcaccttctcacttgtcttccaggtgctcctagtgaaaaacttttattttctttcacttaacgggaagattggggacagtggcagatggcattttctgtgaatgaattaagaccgataagacttctctttgtagcaacctgtcgttgagaccttaactatatccagcagacctcattctttcagtctttggcaattaacaaaccaaatactccttctctgcttgcctttgtttttgtagcacagcagccataacatccatttaaattcccatttgggtttgcctcactctgaatattttcagtttgctttgaaccaatttgtattaataagctctgtggtttgtaaatagatggtgtgctactaggtgccatgtttcatacctagaacccacattattcatacatttcaaatatttccatgtctgtaagatactatgccctattttccagactaagaaaaattatactgtgaaattatatcctaaatttctttttttttttttttttttgagacggagtctcgctctgtcgcccaggctggagtgcagtggcacaatctcggctcactgcaacctccacctcccaggttcacaccattctcctgcctcaccctcctgagtagctgggactacaggcgcccaccaccaagcccggctaattttttgtgtttttagtagggacagcgtttcgccgtgttagccaggatggtctcgatctcctgacctcgtgatctgcccgcctcagccttccaaagtgctggggttacatgtgtgagccaccgcgcccggccctgta

SEQ ID NO: 117679 - DNA, 1179 bp, Homo sapiens
gtaatcccagcactttgggaggcagaggcaggcagatcacgaggtcaggagttcaagaccagcctggccaatatggtgaaaccccatctctactaaaaatacaaaaattagctgggcttggtggcgggtgcctgtaatcccagctactcgggaggctgaggcaggtgaatggtatgaacccgggaggcggagcttgcagtgagccaagatcgcgccactgcactccagcctggatgacaaagcgagaccccatctcaaaaaaatatatatatatatttttttacaattccttaagtgacaacatgtggcagtaattcctttttgacaataggttatatcctggtattaccatgagcccttgaaataccattatattataaataagttatatagtctctttgttcagaaatactagaaattattgtattttgtttctcctacaattatagaaacacagactttatgaatctttgagttttattgctgaacaaaatagcttgagtagggatcagtgggtctggggtcttttgttattggtcaggatgatcaatgccaattctgtttcctctttccaccagagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtggtaagtaaacattgtcctgtgtagctcgaaaggtaacgtggaggtatgtccaagatgttgtgggatttgaaaattgaggcaggaatgggcttatgcctctctttagctgcttggcttcattcaactttgttgtattttaagaccttaaaatggcaaatatttagcctaggaaggctgaaacaagacaagaaggattattcttaatttttccttggttttttttttgtttttgttttttttaaggcagattctcgctctgttgcccaggttggagcgcagcggcacaatcatggcttactgcacccttgacctaggctcaagtgatcctcctcgacctctcagagtgctgggaatcataggcatgagccaccgtacctgtgtttttttttaaataacatctttattgagatgtaattcacatgccataaaattcaccccttttaatgtg

SEQ ID NO: 117680 - DNA, 2020 bp, Homo sapiens
gtcataaaaatagaatcagccaggcgccatggctcacgcctgtaatcccagcactttgggaggccaaggcgggcagatcacaaggtcaggagttcgagaccagcctggccaatatggtgaaaccctgtctctactaaaaatacaaaaattagccgggcatggtggcgcatacctgtaatcccagctactcaagaggctgaggcaggagaatcgcttgaacccgggagacggaggttgcagtgagctgagatcacgccactgtactccaacctgggcaacagagcaagacttcatctcaaaaaaaaaaaaaaaaccaaaacatacactattgtgtctagtctagtgcatagctaagtaacttgctaaacagtttgattcttccaaggcttgctttacactttgttatgccttctgtgactagcccttttcacttagtgtaatgttttaaagtttcatctgtgttttagcacatgtgaaccattcattcctttgcattgccaaataatactccttttttggatatacttcattttgtttattcaccagttgatggacttttgggttgcctccgcatttggctattatgaatagtgctactgtgaacatttgtgtacagtttttttgtgtgaacgtatggttgcatttctcttgagtatatatatacatgtaggagtggaattggctagggcatatgacaattctacttttaaccttttgaggaactgccagactatattctaaagtagctgcactatgttacaatcccaccagtaatgtatgagggaattttccacattcttgccaacacttgtcctttgtcttttttgttatagccatcacagtggctgtgacgtagtatctgattgtgtcgttttgatttgctttcccctggtgactaacgatgttgagtatctttccatgtgcttttttttaacttttcttttttctttcttttttttttgttgttgtttttaagaaagggtctcgctttgtcactcaggctggagtgcagtggcatcatcatggctcattgcagcctcaaccgcctgggcccaagcagttctcccacctaagcctcctgcatagctgggactgcaggcatgtgctaccgtgcccagctaattttttttggtagagatggagtctcgctacattgcccagtctggttgctaattcccaggctcaagtgatcctcctgccttggcctcccaaactgctggaattataggtgtgaatcactgtgcccagccatttgtttattttcttaggaaaaatgtctattcaaattatttgctgcctttggttcttcctttatcttattacgtgccagaaaccctccttgccccttgactttttcattcttccctcttcggaggtataatataaccattgtacagtggtttagagtttaggctactgtgatgtggcacctatttctacctcttattgtaccaactattgtatcttgggctagttacttaatcctgcagagcctcagttttcttgtctgtaaaacaaagatatcagtacttccctcacaactttgttgttttgaatgagatgttgtatgtaacatggttagaataggacctgacacccaccaggtattccataaatgttagctgctagagtattctgcacctgcccatgaaagattaactgtcacaggaattgccctcctgccataaacaatgagaaaactagataaaatatatgaaaccacagtttttgacattgaacaacaggcaacatgggactgttatctctaagagaagggaaaaaaccaaggtgatccctacagttgccctggcttactgcttaggcacagtttctaggctacagcaagggaaagagaaccaaaactgaaactggcaaccttactgactagagacagagatgacagtctgagaagagtaaggcaaagtgctgaaaaggctggaactctctacagagacagccccttggttttttgtatatatagtaatctgtgcatgaatgagatgaagttcctcaaagccca

SEQ ID NO: 117681 - DNA, 1057 bp, Homo sapiens
caaagtgctgggattataggcgtgagccaccattcccagccatatacaagacttttaacaagcttctgagatggttctgttatgcagccagggttgagagctagacttagagcagaagttttcactgggcacaagaatcatctggggaatggttaaaaatgcagattcctgtgtcccgcccagaactatgaaatcagaatctctgggggtaaagatctccatttttaacaagcactccaagtgacttcagtacaggtatcctgaagatacacttgaaacactgtcttaggaagtgagggagatgaaagatggatgacaacaaaagggagtttgaaattcagatctggtaaagaagtagtaggagagtttctccttggctgtgagacctcctataattatagcttgtaaggcttgacccaaacaaaccatacacagtttggggggtgcaagggaaaggagagaatctttcctccttcccatgtgactgatttttaggagtcagttgtgtgctgattattcctttttgtacctaatgctgttcctggttatgttcttacagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcagtaagtgtcctctgcaactgtagccttttcagcttttccatgaaagaaccatcagagatcagataattgggttagagggtacatgggtgatttgtgttctctacattgtcaagctgacaaggtctctctttaaagttttgggaatctttttaagtagtgaaccttttgtaccatgttaggaagtctgtaaaagttgagattttgaaatgtttcggtcatcagcagaaaagttaatacattg

SEQ ID NO: 117682 - DNA, 1372 bp, Homo sapiens
taccttcagttctgtgaccttaggtatgtcactttcatctctgggcctgagctttcccatcagctgaaacaggtgagtgattctcagtgggatggtagtgaggaaaaaattggagagtaggagactgctttcagaatgtacttcctcttggacactctgctacacccttcattgaggtactccctggtagaaaaccattgccttgataagtcacttcagttacttaattgaagtattgtatcccttgggcatgctggttaggaaaaatttagaaccctcaaactgagtgacctttttacactcagttacagcatttgatgatccctacagtctacatgcatgtgtgctttgtatactgaatggctgatgccaaaggtatttcttaggtctcagatctctcgaggcaaaagggatctttctatacttttctttcctaaatgttaaggtaaaatatgaaggataaaagaatttaagatgttgacttattatcccccttccagttgtaaaagacattttaataatttttgtagaatttaatcagacaggtcagaactccttgtgaatacaattgtgagacagttttttgaatgccgttctcatggtgcctcagtcaagcttacctggtggatttgtgtctggcagggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcaggtaagcaagaataagtcgttccaagggccaattctctgcctgcctaccacagatacctggacaattccaggtctctctttttgccagggagatttagacatagtgaggttattgtaatagccttgctacttcgagttgtcttggatttttaaaagcaaggagatggccaggcactatagctcacgcctgtaatctcagcactttgggaggccaaggcaggcgcatcatctgaggtcaggagtttggccaacatggtgaaatcctgtctctactaaaaatacaaaaaaaattagctgggcatggtggtgggtgcctgtaatcccagctgcttgagagggtgaggcaggagaatcactttacccgggaagcagagggtgcggtgagccaagatcataccactacattccagcctgggctacagagcaagattccacctcaaaaataaataaataataaataaata

SEQ ID NO: 117683 - DNA, 1875 bp, Homo sapiens
aaaataaatgaataaaaaattaaaaacagacagccgggcgtggttgctcgctcctgtaatttcagtctttttggaggctgatgtgtggatcacttggggtcaggagttcaagaccagcctggccaacttagcgaaaccccacctctactaaaaatacaaaaattagctgggtatggtggtgtgtgcctataatcccagctactcaggaggctgaggcaggacagtcacttgaacccaggaggcagaggttgcagtgagccaagatggcaccactgctctccagcctcggtgatggagtgagactgtctcaaaaataaataaataaataaatccaaattatacccacttggtgggggaacattctgccctggtgccaactgtgtagcttacatggcaatcacatgactcccagagcatgcctggacttaatcatgtgattccatgggctatgcagagcactttcactctgaggaatggggatagaatccccgtaagatggaaaaataagacacacactaaagtagcaagtgaggaaaacaaagcccaccttgtccattatgggggtttacaagtctgaaataaaaggttaatctcccagggccaggcacggtggctcacacctgtaatcccagcactttgggaggccgaggcgggtggatcacaaggtaaggagatcgagaccatcctggctaacatggtgaaaccctgtctctactaaaaatacaaaaaaattagccgggcatggtggcagacacctatagtcccagctactcggcaggctgagccaggagaatggcatgaacctgggaggcggagcttgcagtgagccaagattgggccactgcactccagcctgggcaacagagcgagactccatctcaaaaaaaaaaaaaaaaaaaaagattagtctcctaggctgggcgcagtgccttacgcctgtaatcccagcactttgggaggccaaggcaggcagatcatctgaggtcaggagtttgagaccagcctggccaacatggcaaaaccccgtctctactaaaaatacaaaaattagccaggcgtggtggtggttgcctgtaatcccagctactcagggagaatcgcttgaacccgggaggccaagatcatgccactgcactgcagcccgggtgacagagcaagactctgtctcaaaaaaaaaaaaaaaaaagaaaaaaaagagattagtctcccaaaagttactgttgaaaatcggacaccagccaaaccagcagatgtttgtgggagtattctctgtcttccagaacgactacggtcagaagatgggcagccaatggtgctcaaactcaaggactggcctcctggggaagattttcgagacatgatgccaaccaggttagtgacctgcagtggtgtcatcttcagaagccatcacaaagtaatcacagaaaagtgaaatttgtctattggctttcttcccctataacaagctaagtcatctttcctgcacttttataggtttgaagatctgatggagaaccttcctctgccagaatataccaaacgagatggcaggctcaatctggcctctaggctacctagctactttgtaaggcctgatctgggccccaagatgtacaacgcctatggtatgagggagaggctaaaattgctcttttgggggactgttgttcttatttcaactatagaaggatatctgtggtcaatgtcaggtatagagatgattgcaggcaagtgctggagaagtgaatagtatccaaggtggtcttgaatatgtttgcttttgtcatattggttttcataacatccatgtgggcccagaccataagcttacatgtctccagtagtgaggaagtttcctgttaagaactctaccca

SEQ ID NO: 117684 - DNA, 1679 bp, Homo sapiens
ctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgtagaatacttttaatttcactttctgtattttaattttgttgaagggctgattgggatttccatgttcttattaaaaatctaacaaatctgtttggagtggactaaattattcgtgtaccaacccttctaaaatcaacatcagattgggagttgggttggaggtgggggattcatttccaggtcttcatgactgtgctacacccagatatttttctttgcttgttgagactgtgccatgttagaaaaaaggaaagtgccagggtgaggtcagtatggtttggggaattgggggtaaggggaaggggccacatgaattagagggtagaaagagagacatgtttccccatactttatgctttgtgaatggagtgggaaagttggggtcctcccttcctgtggcagagtctggggggaagggtcatggtgtgtggcctcagcaaagttggacagtctgtggtgggattcttaagcaggcagcctggctgcctacatgaaacgtgtggccatagatccac

SEQ ID NO: 117685 - DNA, 1146 bp, Homo sapiens
tggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctgtcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcatttattttggcctctgtgctttgttcttgccacaccagctgacaggtgggaaggacctcaagtgagaagcagggt

SEQ ID NO: 117686 - DNA, 1003 bp, Homo sapiens
ccaggagagagggtggggtctggatgcatcagcaccggctatcacaggggctcctgcaggggcctcctaggtagagacagaaagacagccagaaaagctgacacccacaccgactgacaagctgcccagcccaaaggagcatccatctccccgggtacagtggcagcagggtggttgggaggctgatggaagggccctgtcattcttccttcctccaaccatcttcctatcaactccctccatatgggaaccctgttttaagccaaagtcaacatgcgtgagtgagaaggaagctggcgcccagcacaggagagagagagcgcttccatccacgatcatgctgacaaatagccataagggcaggagggtctgctcctgtccctaggaacatcctcagaaaggtctcagctatactcccggcagaggcagcacttctcttcctaaaagcaggcacaggaaggggtctagaacttacaggatccagtttccctctggtccagttgcagagagggctgttgtggcaggacacaactgtattttttttttttttgagacagagtctcgctctgtcgtctaagctggagtgcaacggcgcaatcttggctcactgtaagctccacctcccaggttcacgctattctcctgcctcagcctcctaagtagctgggactacaggcatgtgccaccacgccgggcttattttgtatttttagtagagacggggtttctccatgttgggcaggctggtctcaaactcccgacctcaggtgatccgcccaccttggccttccaaagtgttgggattacaggcgtgagccacagtgcctggcctaaaattttaattattaatgtttatattttattgtaaaatacacaaaaatttacaatttgaaccattttaagtgtacaattcagtggcattaagtacattcacactgttgtacaactatcaccactgtccttttcagaactttctcatcatcccaaacagaaactctgcacc

SEQ ID NO: 117687 - DNA, 1332 bp, Homo sapiens
gagtagatgagacggctcacacttcagcactccaggacgatcctccctctctctcccttgtcttcctcatgctgccccctctcacccaccccctcagggcaccttctgtcccatctcatgcctggcctcctcaggtttcttctcacccctcaaagccctccctggggtaggagcagaactgccccagacccattcaaagcccatcagccttcggctggaaagtcagtcggaaagtgtgacaggtgccccagacaaaccccaagagagtcacttcctgaggcccgggctggccacgtgcaaaccacggcctgaacagtgcacttgggtgctgacgtagcccagggctggggaggaggaagcagcaatggaaaaaggggcttgttttcctctgagagctgcagccggctcagccctgggtcgagtgttggagatgggatggttccactggctttctcctggagcctcagcggccttgggcaagctcaattctctctcccctctgcctcttcctcctctcctgtttgcaaggaaaggtctaagtgcagatatcagctgagggcctcttaccttttccccggcttctggtatcagtcacttggccagaaaggtctgagagccccaggtcatccctaagcacccttgaggcccagtaggcccctagaccagggtgcagagtgactcggagccttccttacctccaacatggtttcctgcaggccccaggctggttgtttcatctgggctgttggtcacaagtggggtgctcactagccccaactgagatttggctcctcgggaggggccaattttttcaccatctcctccctttcctgtccccccaatgacagcaaacagaagtgtgccattggccaaaatataagaccagaggggagtgaggtggctcagatgccccagccttgtgactgagaagccaggtcagcggcataaccctatctagggaggtgactttcagcccttttcatgacaggctaaggcctgggcagcatgcacggttctgagctcagctcctcccaccgttcctaggtggaagctgccttccaggggctcacaccacaggggctgggcagggttgggaagggccaccttctcctctctatgagctgtgaggacagaacaagggagagagggggtggactggtacatttggctctgcacaattcttgctgtccacaccttcacctgaggccccagaaagatcacagccagactcccttccctcctgaggcctttgcaaggctggccctctgcctgcaatgctctccccaccacacccctctatgcagtcagtttcctctcctcttttttatcttt

SEQ ID NO: 117688 - DNA, 1068 bp, Homo sapiens
ggcgctgtcggatggggggcttcacgtcactccgggtcctcccggccggtcctgccatattagggcttcctgcttcccatatatggccatgtacgtcacgacggaggcggacccgtgccgttccagacccttcaaatagaggcggatccggggagtcgcgagagatcccagcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcaggtaagcagtggcctacgccgagggggaaccctttcgccaccatcctggcgtcctgtccttcaccgcaggagtgctcctggatcttagaatgagagccgggtttccctttcattcctcgcatccccagagtcatgtgttagagggatgccaaggaaccccacacagcccaccccctgccctcatccctagcggagcgcagaggaccgagcttttgttttggatggagagctctggagctgcgtgggtgggtggagggggagggcttgttttgatgagcggggctgcgccccccacctccagtaagacttgccttgccttg

SEQ ID NO: 117689 - DNA, 3401 bp, Homo sapiens
tccttggccgtggatgtcccggcagcccgggtttgggggcgcgcactagccgcggccatgggggtgctggcgggaatccctcgcccgcacagccgccgctgcggagcgctgcgagctgcagtggagggggattctccgtatttgcgtcagctgttgttgaaatgggctctgccactggtgcgggtccaggaacattgcaatgtgctgctatcaattattaactacctcgggagtcaatggtagccggcccggtctcttgcctggcagctcgggtcgtcctcgtcctccagtgattgctttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattgggtatgtgtttcctgggttaggggaaggactctgccctattgagggctgtgaggttttctgaagacttggcctttagagatacaaggatcctccagccagagtcaggcccactgtgtgaaactggagttcgttatttatgaggactgagtatgggtcttcaaatagggtctcggtctatccacccaggctggagtgcagtagtgtaatcacagttcactgcagctttggtgtctcaggctcaagtgatcctcccacctcagcctcctgagtagctgggactataggcacgtgccaccacactcggttaatgtttatagagacagggttttgccatgttgcccaggctggagttcttcttgataatgggcctgttcctcttcagtctgttgggctgaagctttaccttggttagctaaagccaagaaaggcaagagttagggctgggacatgtgtggccaaaggcagtgttactctcctggcatcaaatgttgggccagtcccgtcc

SEQ ID NO: 117690 - DNA, 1029 bp, Homo sapiens
tgggggccattctccctggaagccctgccccttgaaggagacgctcctccttaggcatcttggggcctcctcgccaagactgggccttctccataggcatgcctgtggccccactgccccagtgacctgccatgccctcttctatctaacccagagcataggtaacctcctagaccatcctgtgaaggcagaaagaacctgggggaagtcgaggttcccatcacagccagaaactggtatctaggacaccgtcccctcccacgcctgctgtcagtaccacacccacacatttcaccaagagatgggtatcaatctcagagaagcatttcccaatcctcgcttgctggccctgccctgccctcatcagtcctgcccatcccggagtcccactgaaatctaacctgaatcctcctgttccatcctgctgagcagcagtccgcagtccctgatagattccaggcaagtttgtggacacacaatagatgcatgtcacccacagccttgtttcctttcatccctgtcaggcaaggaggctgtcgttggcatggtaactttccctgtaaaagttgcagccctcaaggatgtttttcaattccagcagggacacagctccttcccgacattgtagactacggggtgacatgtagatgtgtcattctggcctcccccggaatggggacatggagctggcagcacaaaaggatgggttcgtggagggcagcaaaaggcttaagggagatgtcgattggatctctgaggaacaggttccttctgccctgtgttctgatactctgccacccagagaaaccagttctgaggcccagaatatttcgggagactcttgggatctcatagtgaaagataaacacatatcttcgctagaaccaggcccctgacaaatagcatgatgcccagggcttaattccatagaataagctgataaatcataaagcctccaaaatccagcgatttcctttctcttcgattcctctgtggaataaatgaatatttattagccatctcccgtgt

SEQ ID NO: 117691 - DNA, 3751 bp, Homo sapiens
cctctcctgcactgtgaaacctgtgctgctttcttcacttgatcagctcttccactgcagtggcttctctggtttgctctaagtgcatcacaacagttgaaagtatgaccctcccgtatgagataggtttaaatgatagcttcctcaaattctggtttggagagctttgttctctacgaggccactcccaaaagcagtcctggaatgtctcttctgagccattgaatgggtgctgcttagagacactacaacagcctgacttctagagtcaacagtaggaatcataagctgaatacccactgagtttttgtgttggtatttcatagctgagggtagagcctgaggagaagtgttgtttgaaataatccgaatttctctgctgatatccattaggttatcaaaaccagagatgacttacagagctttacacacagacatgcctataaatgggaggatgagagtgataggtgggcaaggggctgtgagagggactaattagccttcatatatcctaatcccccatttttgtatctcatggtcatccctgtagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtgagtagcaaatcagcaaaccaaacttaaaaccagggtctcaggtcaaggtccctcctggctagccctagccctgcttccggtgaggtgcttattatctgctgggataggtgattgacgcagcaggtgcaggttcctaatttggacccatgtttattattacctctttgctttctgcaattctgcaagagaatagggcttcccttattcccttaccagccacctacacacatgcccatcccatgaacacaggtaatttaccttttggtttgtttccccaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagcttatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaatatactttgtgtgcttgagattttttaggactggtctagaaaggcctgaactgtggagacagttctccaaggcatacctcagattagtcacggccaatagcatttcagccttgggtttgagttgtgtttactacatttgtctatggaaaggtatatgcaaagtttttctgaggtcatgatcccagagttatgctagaagaagaaggttcaggttgctggggccaaactaatttgtattctcccccattctatatgcatgccaaagggaatcttgcttttttttttttttaaggtatgttaagtatattatcccataacccagcatcccatggaggtagatggtgtacccaattttacaggtgatgaaacagaacaaaagaaggttaagtagcagctctttagtgataacaccaaaattttatcccaggccttattccaaagttctctctgtatctgtctttgagtcctataatagaatggt

SEQ ID NO: 117692 - DNA, 1892 bp, Homo sapiens
caaagtgctgggattataggtgtgagccaccctccccagcccgtcttaacctctactaccttatttggcaggagccagtggtcccccctttcctccacaataacttatttttgtttgcacttaatgagttgtcctatagtaggtctaataaaatgtgtgatataattggcagtgctgttcactttaagagcagcttttgattaaattgggctccttccccatatttagacttcagtgatcataatgctgagctttgcataccattaagagttagtgggtttgagtaaaggtgttttaataatattttaaataagtaccagtaagtactaataatattttttttgtgtgttagaggttacaatcaaaagttttaaaattagttgatatatcctatggtggtgaaaatggattcaaccaagctattgagttatctactgaagtcctctccaacgtgaaattcattcaagagaagaaattaataggtatcggtgaaatgcaactacttattctgtgaaatgttttcgtgtgtgtgtgtgtgtgtgtgtgtgtgtgtatgtgtgtgtgtgtatgtacgtgattgtatgtatgagacaaggtaccaaaaatgtaaaaaggaatatttagtatttttattaactcttttgcctcagtaaaagcattattttttatcttctttagtcattaggtcgaataggtgtgtttgtatctactagggaaactttaatatatatcctgttgactgatccctaatcgtaggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaaggtatgagaattagaaaataaggttgctatttgttactgagccaggaagcctggggtggagatttgggagggatggctgatttcaggagcaatcagaaggtagatctacccattgttccccagtccttcagtctgtagcacattcctgcatagatttttctgcttgaactgtttaacgtctgcttaagattgttacatctgctgaggaccaggactatatcttgaacatctctgatgttccttatggttgaagcattgtacctagtagacactcagtgtatgctaacatgtttatggaaaaaatgttgagagattgagtccctgagcccttttctcatctaacctcatcttatggagcttacacagattagtatatgagagccaggttaacacattttttcctcctaatactacagaggagaaaattctctatctaactccagagcaagaaaaggataaatctcatttcacagacaaagaggtatgtgattattttcttggtttgatgatacgtgcaagcgtaaatccgtgtgttagagtactggctgtgtagagggtgagctttgggaaaccaaaccttatactaattgggggtgctgtgggaggtggtcatctatctgccacatacgaatctgatttcagggaaggagctgcagctttttttttttttttttttttttttttttttgagacaaggtcttgctctgttgcccaagctggagtgcagtggcatgatctcggctcgctgcaacctccacctcctgggctcaagtgatcctcttgcctcagcctctctggtagctgggactacaggcatacaccaccacgcccaactaatttttgaattttttgtagagaggcgttttcaccatgttgccctgggctggtctcaaactcctgagctcaagcaatccacttacctcggcctcccaagtggtgggattacaggtgtgagccaccatgaccggtcttttttttttt

SEQ ID NO: 117693 - DNA, 1082 bp, Homo sapiens
aatgtgacgggcgcctgtaatcccagctacttgtgaggctgaggcaggagaattgcttgaacccgggagacggaggttgcattgagccaagattgcgccactgcactccagtctgggcgacagagtgagactctgtctcaaaaaagagagagagagaaaacagtatgatgtgaggggagtgaatccagatgatggggagagaagcctcctgtaatgactggtgcctcattggtacttacagctcctctcttgacatagacttagtagtcgctctctgaaaacaagtagcagtttatgctgaacgtttagttaagggaatggtgatttttctttgtccttttcttagatgatgacatgattattttatttttaatttgaagacatcttgtagttcttaataattgcctttttctcttgctacttttgtgtcaaaggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcaggtaagtaagaagtagatgctttattatgtaagaccctaggtaggagtaggtgagtcctctgtgtgagcactggaacagacacatctttttaaaattccttgggttaaaaacttgcctctgagttaaacagcaggtttacagatgtttatcaggaaacattcccctgtgcttttctgaaccccttctcttctgaaatcaaccatttttaggtgggcttcttatggatcctgtggaggttccttgtttagttgggttgtcagaattggctgtagaatggagtttgatttcaaagaaactaaaacctgttccttattttctttttctgatttattcttggagatacatagcagcaaagctctcagcagtatgacagctgattcagcctaaagcatttaaagcacattttataacatgggctcagccataatacactttcaagatctggaggaagtagcct

SEQ ID NO: 117694 - DNA, 3003 bp, Homo sapiens
atgagacagagtcttgctctgtcacccagagactgaagtgcagtaatccgatctcagctcaccacaagcctcccaggttgaagtgattcttccgtctcagcctctcgagtagctgggactacaggtgcccatcaccacgcctggctactttttgtatttttcgtagagatggggtttcaccatgttggccaggttggtcttgaattcctgacgtcaggtgatccgcctacctcggcctcccagagtgctgggattacaggcgtgagccaccaccacgtccagcctgtttactttaaagaataaatcgtactgaaacgtctcagaagaagttttaaaattagggagagagttctgcctgagagatttcaagctttttctgctttatttaaattatgacttaaaggatcaggcagggaaaataggctatgggaacattttctattaattgacgaaaaactagatatggggtaaagtagaaaaattgtttgtgttctttgcagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggtaagaagtcaaacccagaacattttcatcgctccagaattctttccccgtacccattagcagtcagtcccccatccctcccacttacctgtctcattctaggcaaccactatattttctttccatagatatgcttgtgctgtacttcttttatttttatttttttatttttatttttttattttttttttagacggagtctcgctctgtctcccaggctggagtgcagtggtatgatctcggctcactgcaagctccgcctcccagattcaagggattctcctgtctcagcctcctgagtagctgggattgcaggcacatgccaccacacccagctaatttttttgtatttttagtagagatggtgtttaaacacattggtcaggctggtctcagactcctgacctcgtgatccacccaccttagcctcccaaagtactaggattacaggcatgagcaaccccgcccagcctggacattttatataatggaatcatatagtttgtggccttttgtgactggcttcttttactttatacttttaaggttccatgtggtagcattcatcagtacatttcatcccttttgattaccaagtagtattccattgtatacctatatgccatatttcatattttatatagcttctcgtttcatcagttttacatttgagtggtttgcactgtttggctgttctgaataatgctgctgtgaacattcatggacaagtttctatgtgaccatacattttcatgtttcttagatttgtggaatcgtgtaggttatatagtaattatgtttaactttttaagaagttgctagactgttttccaaaccgttgtaccattttacaaagctgtctgttttcaaaaagtaaggcaatttacatttattatgacactagtcattcagcatgttttgagacagagtctcacactgtcgcccaggctagagtgcagtggtgcaatcttggcccactgcaacctccatctccatggttcaagcgattcttgtgcctcaagcctcctgaataactgggattacaggtgtgcaccaccatgcctggctaattttttgtgtttttttagtagagacagagttttgccatgttggccaggcctgtcccaaactcctggcctcaagtgatctgctcgcttcagcctcccaaagtgtgtgtgtgtgtgtgtgttttgatttttgtgggtacatagtaggtgtatatggggtacatgagatgttttgatacaggcatgcaatgtgagctatcacactatggaaaatagggtacccatttcctcaagcgtatatccattgtgttacaagcagtccagttatactctttgagttattgcactcagttttcacataacaattgtaaaatttttagtagcagaactgtaagaactcattttcccccctttcccctgaaacttttgagtgacaaagctgccataggatgaacttgaacagtggaaaggaaacctcattagagtgacctaaatcagtcaacagtagaacaatcaagaattcacagctggctccttagttcattctcttgcctttcatcaacctagggaaaaacctctacagtggaattagaactgacatttgtcgacagtttacagtggatgatttttgctaacttgatgggaagtccatttatagttggatcttggtcgactgcatagacaatccagactgtttttctcttcactaccacactctacttacagcagagggtttttcagggagcctctcagccactgaaaccacttacctgtatctggttggatgaaagccgattttgaatcttgttgatttaaacagtgccaggtacccatgttgtctggcttttgctcacttactgagttagccttgttggcttttttccaaaccttaactccttttctaagatactgtttaatcttgctaactttgtacattttagctttaactgagagggttatatcctgtttatcagggtaattatatattctaataagggatatgcctattccctgataagcagatttattaaaaacttcaatctacctaacgggtcattttgataaggctatattattaacgtgcaatattcatattcatgtcttttttctttttctttttcttttttctgagattgagttttgctctgttgcccaggctggagtgcaatggcacgatctcggctccttgcaacttccacctcccgaattcaagtgattgtcctgcctcagcctcctgagtagctgggattacaagtgtgcaccaccacgcccaactaatttttgtatttttagtagatgagatttcaccatgttggctaggctggtctgaaactcctgacctcgagtgatccaccc

SEQ ID NO: 117695 - DNA, 1420 bp, Homo sapiens
tttttttttctcgagactaagtctagctctgtcgcccaggctggagtgcagtgacatgatctcggctcactgcaacctccgcctcccggattcaagtgattctcgtgcctcagccacctgaatagctgggattacaggcacttgccaccatgcccagcgaattttttttttttttaattgagacgaggtttcactctgttggccaggcttgcctcgaactcctgaccttgtgatccgcccgcctcggcctcccaaagtgctgggattataagcgtgagccatcgtgcccggccgagagagagagatttcataactgggacatttctgtgacttccacagttctcctttcccatcattagaatactaaattcttgattacaaatatgcctagactttggaaagactcattgcatcatcctgtcatggcgtctcccactcaaccaccacatttgaaggctctcccacggacagattcactaccaaattccagcctgttgacactccttatttatcatagatagcttctttctttaggaaatgaggtgtttctcaagtatctctccaagtgtattctttacataacttacctcactattcaatcaaattgagcactagattctgaacactgttcctaactctgtgtatacgttcataaacaagactaatatagtccctacattactcctttgagagtgacctgtttccataactttggggcatctccctgtagcttgcttttaccagagagaaacatgagtttacttacatgatatttaaatccctaatgagttattctttcttccacagcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaaggtaatctggagtttgctccttttccttctctacacattttggttatgttttatactgtgatgctgctatggtgctttgttcactaatgttcccttaagtcggctgtcatcagtgtctctttggccttggtggttagcttttttgttttgttttgttttttgtttattgaaagttaagtaggccaggcacagtggctcatgcctgtaatcccagcactttgggaagctgaggcaggtggatcacttgaggtcaggagttcgagaccagcctggacaacatggtgtgaaaccctgtctctacaaaaaatacaaaagttagccaggcctggtggcacacacctgtagtcccatctactctggaggctgaggcgagagaatcaactggacccgggaggtgggagttgcagtgagccacgatctcgctgctgcacactagcc

SEQ ID NO: 117696 - DNA, 1477 bp, Homo sapiens
taatctcagctactagggaggctgaggcaggagaatcgcttgaacctgggaggtggaggttgcggtgagccgagattgcgccattgcactccagcctgggcaacaagagcaaaactcagtctcagaaaaaaaaaaaataataataataataggggcctggtgcggtggctcacgcctgtaatcccagcactttgggaggccaaggtgggcaggtcacaaggtcaggagatcgagaccatcctggctaacacagtgaaaccctgtctctactaaaaatactagccaggcatggtggcgggcacctgtagtcccagctactcgggaggctgaggcaggagaatggcttgaacccgggaggcggagcttgcagtgagccgagattgcgccactgcactccagcctgggcgacagagcaagattccatctcaaaaaaaataataataacaataataataaataaagaccacatgagaaaaaagtcaagaactagactattttaagttttgtgagaagagatgaatatagaacaaacaactacagacttctcactctttccaaattttggtttccacatgtgtaactatggacattaatcttggattaggtggtaacagttgagataatatgggttaaaatacttaacaccacatttgccacatagagagtgctctgtaatgttagctctttccttttgtatatacaaacattgattctgtagagataccctaatggagaactgtattattaaaagatcaggatacagatgccacaggtctgaactatgagaaagaggagaaatagatgagagagaaaagaggtagtaaagggaagaggacagagtatatatgttagaaaggatgtggtggtggtccttagtttcctccaagtatgtaggctgcctgcttcaactcagaactagtcctaacagccgttgtatctggcatggtgttctatgcactgtgaacctaatgaacaattactccctttgaatttcaagtcttgacagacctcctattgtaatagcagatatacttatgcttccagggaaggaaggcttactctggacatattgcaaggtaagcaagagtacataattagagtatcatttaaggcagagtgctgtgtaggttataggtctctcccatcctccacaccagttggaccctttcttcacagggctcgttttctttgaacttgagattgaggatcggcccagtacagcaccaccccctgtcctgggatggtacttcattgttaaaaaagttagtgtcagctttgcagcagggctataaatggtcttcgatcctatttgaagagtaggaaggagaaatttgccttcccactgctggatctgttcaactaagaggctggacagtagaaattacttctcagtccagcctattctctagggctctcagaatagaaccttctcctaggatacattctgtaggtgtcttttaattcttcagcagcctac

SEQ ID NO: 117697 - DNA, 3553 bp, Homo sapiens
cccccagccttacctcacaaggcggcgcggacccagctgcagccaatcggcgggctcattgtaggctgcggggcagagagccaatgagaagtcgcggcggacgcccagcttctcctcactcgcaccggccccctcccttccgcctgccgccttccactccgcccctggcggaggaagtgatgtcacaggccccatgtgagcggattgcaacacatgcagctgcctggagagagggagccggtgtcctacgtcagagccgccgccgccgcggagccgccgccggggaggagcagccgctgccgcccaggactgggcccttaggtaaggcacagggagggaaaggccggtgacctttgtggcgagctgcaccggacgggaggagagggcctctgggggatggcgaggaagggggccgctctgccccagcggcggcgctaactctgtggtcttggtgtctccgggccccgccgggccgctctagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctgggtagtagcccctgacccaggggcgagggtcggcgcggttggcccgagaaggggtcctttccccgcatgggggtaaggggcccgcgctccccggtttagatcactcggcccccctcgtggtaggccaccgctacttttgcacctctcccgggcccttaagtccaggtcctccctcttcgggctccaggtgctgccacccgactcgggtgctattgtggcaaagtgttcggccttcctttcccagggcccttccctgatttcctcttctcccttcatttctcagccaggcctcattaaaatggcctctcccttctgggcttctgagacccgggtgggtgaagtttggatgggacgggaagcagaggtggccagggacagcttctttctgattcctgatttctctgggtcttccacctgtcccaagatgacttctcccaagtcctctaattaccccggagcttcctggttttagctgttccaggacccacctataaactgaaaatgccaacgtacgcgcgatgtgaggggtgctgggtaggttttggttaatgaatctgcatgtgtatgtccaggagaaatacgggttagggggccgtttgataggaatcataactacagagtccctgctggcatttctctgaaacttgtggggatatcgctgtagagaggcgcctgatgtgcttgatgcttgttgagtgagattcataattgaattaaatgggctttgagtcttgtacattttgataagaaactgtaggtgtgtccattggggggagagtaggctagattaaaattagctgtgtgtgtgtgttttcttttttttttaacgttgttcgtttgaggaaggtgtgccaggggtattcctgtttcttttattactttattttgttcctttcccagtcatagaaactttttacttacaggaagtgcccccccccccaaaaaaaagtgtttggaacattattacatacttgtatgtctgagcattcttagaatagtagaatggcctgcctcaggccatgtgaaaagttgatttcagcacaagaatttgacattctggtttccagcccaggattgtcatttatgggtagatttgcaattttagaatgacagcccctccaagctcttcattattactgttatatgaaacaggatgtgcttaattgtactgaaggcccaattcacaggttggttttactagtgttttgttcttaataaattagggacagttctgtttggaatgaggcttctaaaagtttggccccattcagtgacgggcttgtgctcactccttcggtttactggagaaacgttagtttaatatgaatcgaagacagcggcttgttagtccttaggtttttctttgaattcaatagaatatccagaccttcttaatgatcttacaggaacttgtgccgtatgatagagtgaccagttattcccaaaatgtgagaatactgtacagaaagggtaacataggtcacgacccattatgttgcactaccaagaattagccaggttcttttgtttcagtaggatcttgttttgttacttgaagccttcaatccagtattgcattttatagattgctgttgttgcagtattgtatataggtggatgtgacctctggatttgttcttactgctttcagtagcaggcaggtttacacattttaatttgcatacgttatattctctgaaacagtccaaaaaattaaatcatgactataatttgcctgtttgaatgaagtaacattgaagatgacattgcttaataagtaacagcattcctttctactgcttaatgaaggaaactcattcttaaatttgttctacccatgttacctagccactagaaacttttaagcgcctctttaaggcttttgaaggctttacctctttgtttagcaaagttcagtaaagtttaaagcatgctaaaaatgaagttataagacacaacttgtatttcaagttgttgagtttggatatttcagacatgattaagctgtctaaaatagctggaggaccttccgctacacattgtggttaataatcatgtcctactttgcttttaatcaggatttggttgcatcttgatcccatggaaatttaaaatcttggccatctctgagtattggtaagggagtcagaagattccccagtatataccagtttttggaggtgggaatattttcattgccaacttgtgttaaagtcagactctagattttcatagatagggtacagtggaaaatgttattcctactttacctagtgataaaatatctttagaagaattgtaatgggctttaaagacttaagtggatggcaaaatgaatctgtatttgctgatgttttggggatactctggttttcaggaggaaactgaggttttcaggcatggttattaggacaaggtagtgagacttagtggttgagtaacagtattgttttggaaatgaaaaagccctttcctccccttagcagtgtagaattctaggcataggaatcatggatttgtttttaacagtagttattaaaatatgctagaataagagtgattttgaaattaagataatcctatgtggttatctcttgatatatgacccaaatttaatgtagcttgaaaaaggaaccacctgcaaaatgggctcactaactacatctgaataaagggaagtatgttggcaaaataatttattaagcacatactatattatagactgtgctacagtacattattaagtcatttaatcctcacaagtattgccaccatttggtagacaaggcacctgaggctaagagataatttgtccaagatgtcacagcaaaaatgtagcag

SEQ ID NO: 117698 - DNA, 2948 bp, Homo sapiens
ccctcgtggagttcctcagattgaagttacatttgacattgatgccaatgggatagtacatgtttctgctaaagataaaggcacaggacgtgagcagcagagtaagtcaccttgtttatcagaccctaagagtgaggtgagggaggtcttgggaatagaccctcttagaatgatgagtcctctttgcccctcagttatcagatttacttgtacaagtgtaatgtttattccccacaaacaggcactgagcctgtggattgctgaagttttgatgggcaaacaggccagttggtgtttgtgtatatattgggtccttggtttcattttgctttataggactatagggtatttctcctcttcataatttgtatcaagattggctgctatgagcaggagtactcttaatgcaatggaggaagaagaggcatataactttacctgggaattaatgaaatgccttctgtttactacagttgtaatccagtcttctggtggattaagcaaagatgatattgaaaatatggttaaaaatgcagagaaatatgctgaagaagaccggcgaaagaaggtgattacttcttgtcttctgaactttaatcttagtaaagctcagtcttgacagtgggagtttggggctgggcgcagtgtctcactcctgtaatcccagcactgtaagcccactgccaaggtgggcagatcgtttgaagccgggcgtggtggtgcacgcctgcagtcccagctacttgggaggctcaggcaggagaatcgcttgaacaagaaagtgggagagtttggacatgtcataggttgtgggtaagagaaaacctaagataatctattcttccttccccgttgtttataccttatgtttgcagtgcctttattatttcttctgttttccctgtcacaattctgatgttacaaaatctagcccaaatctctctcaaagccatcccagactctttcatgccactctgatttctccctcttactctatttttatctgtaactgtatgtaacacatagcttattgtctgagtatagacattcagcaaactttggttgattggaaagtcttcgtttaaacttctaatttctctaaggaacgagttgaagcagttaatatggctgaaggaatcattcacgacacagaaaccaagatggaagaattcaaggaccaattacctgctgatgaggtgagttctattttaaagtaactcaagaggttgaacacatttttaccaatgccagtgaagtttatttttctgtgggttttgataggggtttaattattttaaaatgtttctaaatagtacttctacttgtaatggtacaggagacctggaaaagtaaggatttttgttttctttttttaagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaaggtacaagggctgaagtggattttgattctaacttgatctggatggaactgttcttgatgactgtcactggtggctccctccatagccatttgtggaatttagagtgagattagagttgggagatagtctcctgccgtcttgactctactttggcattggagttagtgtcaaagggaaggaatccagaaaccaccagtagggtagaaagtggggagggggagtggaatagaaatgaatgatgaggacatatgtgggtccctcatcttggagtgcaacaaagagcaaatggttagctctaacgttaaatctgagtggctctcaaatgttttcttaacagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaag

SEQ ID NO: 117699 - DNA, 4273 bp, Homo sapiens
tcgtgatccacccgcctcgccctcccaaagtgctgggattacaggcgtgagccactgcacccggcaaaacattgcatcttaaagagtaactattcttggccgggtggggtggctcacgcctgtaatcccagcactttgggaggctgaggcaggcggatcacgaggtcaagagatcgagaccatcctggccaacatgctgaaaccctgtctctactaaaaatacaaaaattagctgggcatggtggcacatgcctgtagtcccagctacttgggaggctgaggcaggagaatcgcttgaacctgggaggcggaggttgcagtgagccaagatcatgccactgcactccagcctggcgatagaatgagactctgtctcaaaaaaaaaaaaagtattcttggtgactattcatttaaattagatctcaccctccctttggttttgcaagtcttctgtcctagggcatggtcatattttagttgaaataataaatgtaaccgtcatttggcctgctcgctgacatgcaattaaacatttcctttgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggtatggaccagtggaattctgtcgtggagagagagggctggcgcatagtgtattcttgggacaggtggcacaaatatatggcccattctgctggggtgacctaaaagggagatgagattatatactcactaaagaattcttttctgtttgttttgttaaaattgaaaaataggctgggcatggtggttcacgcctataatcccaacacttcgggaggctgaggcgggcagatcacatgagtctaatttatatatatatatgtatgtatgtatgtatgaaaaattagggaggggcagaatttctttaggggcagtagcagggaggatcccgaactcagtcatagaatttttaggattgaaacaaagtttgaggtcagaggggaacataaaaccttggtaataccccgcccccggccaccatctttgtacatgtgtctttgcagcttagtgcatctctttgacaaagatttgtgcaatgatgtattttattcaacacatcattctgaaagaacgtgtggaaaactaatgactgagcacaaacctgttgaagatgcagttcttcttggtagcctaaataggattatcttggacctaagatagtgaccttgttttttttcttaatttttccattgaaatacatggccttaaggaaatatgcaaaaaaaaaaaaaatgaacctggaaaaaaaaggtcctggaccaggtggatgcctcatatattaagaaatccccgaggccgggtacagtggcttacgcctgtaatcccagcactttgggaggccaaggcgggcggatcacgaggtcaagagatcgagaccatcctggctaacacggtgaaaccctgtctctactaaaaatataaaaaatttggtgggcgcctgtagtcccagctacttgggaggctgaggtaggagaatggcgtgaacgcaggaggtggagcttgcggtgagtggagattgcgccaccgcactccagcctgagcgacacagcgagactccgtctcaaaaaaaaaaaaaagaagaagaaaaagtatccccgatactattcaaatggaactttatcactaataaacacaagggaagaccatgccccatgttagcaatgcaaattattgctacagctgcctatgataatttggtctttagttgataatatacaagagaatgtggacttctaagtccccttgccttgcatcctctgtttcaaatgatttaatgtgttgtgtaggaaagcagataataaaacttaggagaatccttcccagatttacaagggtcatgaaggagatacttctataggtataaagtgtatgagtgttagaagatcattagcaggaacccaagtacgaaatggttatttgaataaacattctcagatttgagttagcctgtcttgagatctggctgggagcgtaggacacgtgctcccttttgttctgctcaggtagttcccaagtgtgggccgacaggttctttttccttgatgttcaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtaagagccatcacttcctaccttgtcacatgggttttaggttctatgacggatgtaattgcagccactttcatgagttttttctagaaaacttcatttttatctgttttacagtttagaatattaaacagttaactgtgggtggtgagaatcctgtgttttgttttttgtttttttgttaccagaaaagttcttacatgttagctggtagtgatgattataagaaggacatcagtagtctcctccacaggattaacataatttgctaaaagggatctcagtcatttgagactgaatttcctgtagtcttctgttctcaaagacagtaaaaagggtagtctggaccagacttaggggagtgttcttatcttatggatgaatgaagggggtggtatgagggtgccgagataccaagcagggctacttggacatggcttgttcttgaagtaggaattatttctggctgggcaccgtggctcatgcctgtaatcccagcactttgggaggctgtggcgagaggattacttgagctgaggagtttgagaccagcctgggtaacatggtgaagctccctctctccaaaaagttaaattagccaggcatggtgctgtgtacctgtagtcccagctactcaggaggctgaggtgggtggatcacttgagcatgggaggcagaggttgcaatgagctgaggtcatgccactgcactccagcctgggcgacagtatgaagtgaggtcttgtctcaaaaaaaaaaaaaaaattatttcctgacttacccaatcttgtgatgtttttccataaaactatggttgttggtatatttgtgccgtgatgtatttgtcaacacatcactctgaagaaaagtatgtggtgactttctgtgactgagcatgatacatcttctttctctgatcccgtttccccagatgagcatgtttcaacattttagttccttttgaggacttctgtcctaatgctgcgtctttgtacaatgcatttgcttagctgaaacagttgctattgtatgcccatttgctgtactaatcctacttctattccctataaagacatcagcctttgttctgaacataccgtaaattaggagtcttccagtcttggaatgtaaacctttggctttcattttttctatagaaatggagtaggttaatcacattgacaacccaggagggtttcttcttccctaggtattctctactgccgctgatggtcaaacgcaagtggaaattaaagtgtgtcagggtgaaagagagatggctggagacaacaaactccttggacagtttactttggtaggttattgtgaatcctgaatactatgcctccttcactgtaaagtgagataatattctaagccataaaaatattagtataaactgctggcatacacatacatactgagtagtcttgagaagaagggatgcaactagatacccatggcatcagtttttacctgaaagccttgctttttccttgtgccttaggaatttcctcagaaataaactcctgattactcatttaaaagacatttgatattgttactggtttctgatcagcattgcttattggttattggtgaggtgaataataggagatttgctatctgtcatttagtgtgtccacaggtacatacagccattatggttacttgctatagctaaacttcactggtataaaaccagttgatttcaggcagcgaactactactgttgcttataaactttgtgttttgtacattaaatcacttgtttctcccaggaaccaagtgacttgtttactagaaa

SEQ ID NO: 117700 - DNA, 2129 bp, Homo sapiens
ttcaaacaattctcccgcctcagcctcctgagtagctgaaatgacaggcatgcgccaccatgcctgaataattttgtatttttagtagagatggggtttctccatattggttaggctggtctcaaaactctcaaccttaggtgatctgcccgcctcagcctcccaaagtgctgggattacgagtgtgagccaccgtgcccggcctgatcttgggtttttaaccagtgtatttacttggagtgtttcctgcaaggacatattaggtcacttaccaaaagactgaagaatgttgtctgtggctgcaaaaggatgacacaggttgttgggctatattaataattctgttctgacagaattccatgattgaatttcattcttttccagaaaattacttggggcacacagcaaaaaatgctgtgatcacagtcccagcttatttcaatgactcgcagagacaggtgaggtcaattagcattcttattcacaaaaagtaaggtgcctgggatggaagggtacaaaaatgtttttctctttgttttctctaggccactaaagatgctggccagatatctggactgaatgtgcttcgggtgattaatgagcccacagctgctgctcttgcctatggtctagacaaatcagaagacaaagtgtaagtttgtgcagtaaatttctcacctggatgtgtgaaactaaagtgtcacttaattttttagtaattgagccttttacagtgcttttactgattttaagtctgtattgtctttgttttttcatttcaaaaccattcttttcttttcttttgggccatggtaatttaactagtacatatctcagggaaatagcttagattatctgtatttggttattgaaatttatatcctggtgataggttttgttcttaaggatttcttttcttttttttttcacaaatcatttacagcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagaggtgagttaccaatgtggttaatatgtagacgttgggatattgagaaattctttgttcagattgctctttgctttgtttacgagttcagttcaacccccttattctagacacagatactcttttcagaatattttttttccctacacattaagggtaataaaaagtaattcatgcttatatataaaggtatgactccattttgtgttgttccaccttattactgcagtttatttatcacctcactaatgctggtgtttggtgttcaatgtcttcactttatagacaggggttgatttgactaaagacaacatggcacttcagagggtacgggaagctgctgaaaaggctaaatgtgaactctcctcatctgtgcaggtgagacacggaaaattcgagcagtcttgatggatattttcagccggagcttatttaaaataaatagtattttctaattggcctaatgtcagttgagttttttttgtttgtttgttttttcagttttctggtttctagagacctttgccatgagcacagggacagtaaggtctttagtttctttatgagctgaaatttttttagccactcaaatcagttacatatactggagctaaataatgtgtgaatgatgtgctgggtgtacttgtttgcctttcagttaaagacatttattttaaaacctgctctggcagtgtttaaaactagaattactagcttggaaaaactgctgtcttaactgacaatattaaataacctctctccttgtgaattggagagtctctgagtgtcttttttttttttttttttttttttttgagacagagttttgctcctgttgcccaggctacagtgcaatggcgtgatcttggctcaccgcaacctctgcctcctgggttcaagtgatttctcctgcctcgacctcccaagtagctgggattacaggtgtgcaccaccatgcctggctaatttttgtatttatagtacagacagggttctgccatgttggccaggttggtccttggactc

SEQ ID NO: 117701 - DNA, 1282 bp, Homo sapiens
ctgtttctgctttttggctattagaaataatgctgccataaacatttgtgtacaagtttttgtgtggacataaatatttccatttgtcttagagagtagaattgctggatcatacagtaacggtttcatcaaattattctaaagtggctgcaaaaatcttctgcctggggcgctaaataaagaatgttgaggtttcatcataatgtttttatatgttagtgattgctttctttttatttatttatttcattttgccttgtaattctcataaaccatgttagtgattgctttctaaagaatttcacaaactgtcatttgttggccatgaatgagtctcttggggtggaagatggatgttcatggtatgtggtaattttgtcatggtaagttgttcaggtagttttctctaatagaatttttgtgtcttacagtaaaaatgttccctttaaaattgtccgtgcctccaatggtgatgcctgggttgaggctcatgggaaattgtattctccgagtcagattggagcatttgtgttgatgaagatgaaagagactgcaggtgagtgggtttagttcacatctgggaaagttctaagaacaatgattcctgtgagatcactagctccctgtgctccagctcctgtagatgaatctgtggtcccttttgtatagaaaaactaggaatggcaaaactgtgttatacttcatgctttccctgcagattgaattaatcttcaaatctcactaatggtggctggcttgtttctttttttccagtagggggtaatgttctatattgaaagccacaagactacacattaagcttttgtccctgttaggtataaattagaacttcctatttgaagtggctgttgtaagtctaaaggtcattgtagtttagtgaaccttcactaaaatgttgaaagagtgatcttaggggtttctgttttttggggtttttttgttgttgttttttgagacagagtttcactcttgttgcccaggctggagtgcagtggcacaatctcggctcaccaaagcctccgcctcccgggttcaagcgattatcctgccctctccctcccccccaacgtagctgggattacaggcatgcgccatcatgcctagccacttttgtgtttttagtaaagagatgggggtttcttcatgttggtcaggctggtctccaactcccgacaaatcaggtgattcatccgcctcagcctctcagagtgctgggattacaggcatgagccaccgtgcctggccggccgatcttgggttt

SEQ ID NO: 117702 - DNA, 1277 bp, Homo sapiens
aaaaaaatagtagtttgaaagtaaagggctaaagataccttaactaaatatctactgttcattaactatcagcagtaaagcatgcccggtagtattgttgatgtgcatttgtttcgcaatttgggagctgtttctgtgtcttaaatgattgctgcaaacataccagtaataggctgggcgtattggctcatgcctgtatcgcaacacttcgggaggctgaggcgggcagatcacctgaggtcaggagttcgagaccagcctggccaaaatggtgaaacccccgtctctactaaaaaatgccgaaaaattagcttggtgtggtggtgcacgcctatagtaccagctactagggaggctgagacagaagaatcgcttgaacccaggatgcggaggttgcagtgagccaagattgtgccattgtactccagccttagcgacagagtgagactccatctcaaaaaacataccagtgataactacaaacttactctctatcacattttgggagtttaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacatgtgagtaacagcaaaagttttttgcaaaaagcagttatttgcaagggccacacagaagagcctcagcatgttgatgaggatccctggagcaccttactttagtaattttacttattgtccctaggggaaatctgtaccactgccaaaagggtaatccctttaaaaaattcatttttggccagtgcagtggctcacacctgtaatcctagcactttgggaggccgaggtgggtggatcacctgaagtcaggagttcaagaccagcctggccaacatggtgaaaccctgtctctactaaaatacaaaaattagctgtgcatgatggtgggtgcctgtaatcccggctactcaggaggctgagacgggagaatcacttgaacccgggagacggtggttgcggtgagccgagatcactgccactgcactccagcctgggctgctgagactctgtctcaaaagaaaaaaattcatttttgtctttacagattaggtctttgctatgtattgacatgatacatgaaaatttgcaaagcattcctaaaccacatagttcagtgttgaatacataaggcagaaatggcat

SEQ ID NO: 117703 - DNA, 1050 bp, Homo sapiens
gccagggatgctgctgtatatcctacaatgcacagaacagcccccaccacaaaaatttcgcccaaaattaatagcgccacggttgagaaatcctactgtaatgtgattctaaggccatcttttatttaccttttttcgtcttacttatttgggaaactttaatatttactgttttagtagcttaatgtattttatatactaagtgagcccaagttttctctttttcctcccaggatacacactggttggtgactgagtcagttttttcttttttaggatagctggaatggccttagtcatgaggcttttagacttgtttcaaggcgggattatgcgtaagtataatatcatttcctttgagagggaatacatattaaacttcaaagcagtgttttctacatttgtgattattcttctctgtaattatttatctgtatttatttagagattatgtagtataccactgttaattttccaattaaatattatcttccagtgactttggtctatcaagataacaatagctgtgacactgttctaaatgtcttacagatcagaagcaatcaagggagcagttgttggtattgatttgggtactaccaactcctgcgtggcagttatggaaggtaaacaagcaaaggtgagcatgattgataactagtaccttatccagaatctgtccagaattctgtgctcttttccttagttaaggaatttgagaacctgatttgcgctttttttttttttttttttttttttttggagacagtctctatagcccatggtggagtgcagtggcacggtctccgctcactgcaacctctgcctcctgggttcaaacagttctcctgccttggccacatagctgggattacaggcatgaaccaccattcctggctaattttttgtattttcagtagagacagttccactgtgttggccaggctggtcttgagctcaagtgatccgcccacgttggcctccaaagtgctgggattacagatgtgaaccactaagcctggcctcgaagtacttccaactaaaacagca

SEQ ID NO: 117704 - DNA, 1056 bp, Homo sapiens
gtcccttttactaacatctgtagactgcttaggaaatttgctttggggctagtagaatttaagtttccccgatattactttttcctattctctaagcacccccccacacagcttgatagatagtagctcttaataaatcacacaggcgtgaacggtgctcccactgagaactcttctctgcccctctccagcctacaggaggtcttctgtgaaaggagccctccccacctcctctcatagcttcagaatggaggtggggcagtgggtggattcctactctctgtgactatcctctctgacctcctctatttaaatagcccaaattcagaagtaggagtggacctgaggacccagcaggatagtccctctagcccacggcctaacccctgcagatgcccaggaaaccagggggcaagtgggcccccctggctggtcctttgctcaatcctgaaggcatctgtgaagggagcgggggtgcttgggttcttagctgcaaagcaggtggcatggtctcctcttcattgggaacccagaagtgtctggcaagtctctctgccacaggcctccctggggaccagagctctttgaagagaagaaaaggttctaggaacaagaaagctgctgctcttgatgaaaaagtcaggagggaagaaaatgagaccaacaagggctgaagagaactatctgtgggctgaagagaatgttaatggctctgctcccgagcttcaaagcctgagctgggtaggagtgcatgcacatgcctcagctgtcacctccagaatacttaccaaggactgaggcttgcaagcattcccagcctgattttcccagatcaagcagagcatctgctaaggcagaagaaagagaagccattgggagatcctaggcctgtttctgctagctggggtttaaacttaactcttccatatcagtcaacaaatggggttcccagaggaatttaggtggcagggaaatgactggtggggaaatggctctcatggaacaaagctggctttcctgtttagaaaatggtagctgctatggactgaactgtgt

SEQ ID NO: 117705 - DNA, 1033 bp, Homo sapiens
agtgagctgagattgtgccgttgcactccagcctgggcaatagagtgagactgtctcaaaaaacaaaaaacaagcaaacaaacaaaaagatcctctcaccttggcctctcaaagcactgggattacaggtgtgagccactgcacccggccatgcccctctcacctgttttttataatcccagaaggctgtttgtgtaagtgtggtttttgtttttttctgtgaatgtaaaggattattatcacatggatttggttattgcctctgaaggactggggcaatttgcaggtcgtctcttgttctcttgtctttcttcttctccctgtttccttctccctctgcctctgtaatcttagttggccgtcatgtaaaaccgaagagagttttatgcttcctagtcctactatttagagtggataagtggaatgtttttaatttctgtctcttagaaaaacaacagctaaattaaattctttgttacttgtgtaactctcaactgcttttcctctcactgtgcgtcagcacccccactttctaagactgagaagtcgatactgcttcccagggaaaaggaaaacacacccaacatgggcctttggatttcccaccacttcaaacttctcttctatttaacttgcatggtaatttgcatatatctacatatgttatgcaatcagcctgttctccttttacatttaagcctaaaataattttgcgtttctgatgttttccttctctactgccttctttatttctttctggacctgcaaaaggaattgatgaaaggccagtggtatggacacactacacacagcatgggggaaaggaagattggggaacaggatgatgagattgtctctggggcttattcattcgttcatcaaatatttattgagcacctactatgtgctaggccctgtgtcagttgctgggagtacagcgatgagcaaatcgatcacagttcttactcacatggagcttacactctagtgagtaaaatagtaagcataaataaaaagataacttctgatatta

SEQ ID NO: 117706 - DNA, 1011 bp, Homo sapiens
tgccgctgaggcatacagtatttaaaaacagttcaaggctgctgtgaactatgatcatgcccctgcactccagcctgggcaacacagtgagaccctgactcagaaaaaaagaaaatggactggatgttgggggcctagggtaaagttgcttcctcagtgattcccttctactctcccaacataacctttcatgatgagcttttagtcatatcttaagactcagcactttcgtttctggtagcaaattttttagcactgggtggtgcattacattatgctgtacgttattattgatgtacctgtttgcctttactgctaggaagggagccttgtaagctccttgaaggcaggaactgagagtcttagttcttgtcttggtgcttagtacctggcatggagggcaaattagatgcttgttgagtgaaggaggaaaaagtcttttctgcctggagtctagcttgtggatggaatgataacagatgaggcaacagtcagattatggagggcctccaataacaaatttgggcaaactgagaaccatctacagcccattcttcttccttgccacccagatctaatcactgatgaaatcctctccatgcagtcctcagcttatgtgtaatatattctttttttctcctatttcttttttttttgagatggagttttgctcttgttgcccaggctggagtgcaatggcgtgatgtcggctcactgcaacctctgtctcctgggttcaagtgattcttctgcctcagcctcccaagtagctgggattacaggcatgtgccaccacacctggctaatctggtattttaattttatttattttatttatttttatttttttttgagatggagtcttgctctgtcacccaggctggagtgcagtggtgcgatcttggctccctgcaacctccgcctcccgggttcatgccgttctcctgcctcagcctccctagtagctgggactgcaggcgcctgccaccacacccggctaactttttttgt

SEQ ID NO: 117707 - DNA, 1024 bp, Homo sapiens
cctccaatgtcttctgaatttcataacttttctttctttcttttttttgagacaagagtctcgctctgtcgtccaggctggagtgcagtggcgtgatcttggctcactgcaagctcctcctcccgggttcacgccattctcctgctcagcctcccgagtagctaggactacaggcgcccgccatcacgcctggctaattttttgtattttttagtagagacagggtttcactgtgttagccaggatggtctcgatctcctgaccttgtgatctgcccaccttggactcccaaagtgctgggattacaggcatgagccaccgcgccaggctgaatttcttagcttttctttcagcttattatctgccacttcactgtgcatcctctatttttcactcactgtggttgccggaaggtgctggtgttctttggcgccattgtccttcacaacctgaaacagcctccctgccctcaaacagtacgtcagatactcagtgagtccttcctgactatttggggaccgtcttttgggtgcccctggagcacttagaacattataccttctatcgtattataactcttttcctgtatagactgttgtaagcattttccccctactttttttggggaagatcttcaaacctacagaaaagttgaagtacagtgagtgcttgatttaccagctgaccattgttaacatttttcaaattttctcaattactcgatagaaactatttcagagtcatttgaaagtaaactgcagacctcatgggacttcactctttagcatgttattctgaagaataacataacaggccctgcataaccctgacactactgtcacactcaagaccttttacattgatacagtaacatgtaataccttttaaagagcagtctgagggttagcattggctctccctgggagctcttgagaaatgcagaatcttaggccttaccctagatatattgaatcagaatctgtgttttaacaagatccgcagaagtactgatttttttgtgcag

SEQ ID NO: 117708 - DNA, 1048 bp, Homo sapiens
accatcctaacatttcattaagttaactttgctgttaaaaaaaaaattggcattgagtagcatggttaaggtagtctaaatctgccacaatataataatgaaaattcaggagcagacacattttaagcatgatttggccattcttttataagtgaatgctgaacatctttggagaaggtacgtagttctttgcacaaatgaggcagtttgccagttatcagcccccttggttctgatagaactatgcttttattttctcctcattgcttctcaatttctctttctgttgtagattgctagctaaatgattgcatctctgcccctttctgaatttatagcaaacttttgctttatagccaggattaccatttataaggtaatgaagaccagataagtacagtttaactgtttatttagttccattaagcatgatccctcctggaaaaacctaaggttgctgtaattcattaaggttggctagctctagtaggttttgtgatagatcttgcgaaggagtgctctgtaagttaattggaaaagtagaaactgtcaagagtttaaaagttatttgtttagttactctgaacaataccattaattgtagagaaccagaagatacgactaagattaaggcaggagctttgtcttgggaggcttgtaaatatttgcaaattatgttgcataaattcagctcaactaatactatctgccctgcataaagctcccagccagcaacttacgggatataaagaaacataggcatggttatcatccttacacttaaaatatagctctgaagaccatatgctaaacctgagaaaattaagtttaataaaacaattcaatggctgttgagtgacaacataaatgaaaagagcaccagaatttcaggactagagggatttggagtatagaattcaacttctttcattttatagatagatgaaaagagcaccagaatttcaggactagaaggatttggagtatagaattcaacttctttcattttatagatagatgaaaagagcaccagaatttcaggactaga

SEQ ID NO: 117709 - DNA, 1012 bp, Homo sapiens
gtggtcttgatctcctgacctcgtgatccgcccacctcggcctcccaaagtgctgggattacaggcatgagccaccgcgcccgtcctgtgccaccttttttaagttaagaagtaagtgaaattatttgtactccaaagtatcaaaattaggaaaacaaaagaccaagaatgttttttgttcaagaaaaaaatgaaagtctttttttgagaaagtgaaatagttatgtgttgtacctgtttaataattaaacacaaatgtgaccacatatacctaaatgtctgcttgcagctagcttcacttaactttcctcttggctctctccctttgcaaccctggaaggttctgtgttttgtttgtgttaatgcagtatctctggaatgctaggatatgtaggatccatagggcaaatagttcttctgaaatgtcttatctgtgacatttgatgacatttggttgagctgttgtcaaacctttagcaatctagagcattccatttcctaaggttcactgacttgggttgatcagttgagtggacaaataacctttaaaaaccaaagtgtaggcctgacgtcacatgaatgtagacagcaaattcatctaccttcaatgaaacagatgactgggacacaggcattctgtgttaccagattaggcaaatgcaggttccttttggcacccctatctctagtgattctagatttgatgacagtataatgacagtataatgatgaaaattcagaaatttaacattgatacaatgctactgtttaattcagtacccatagtcaaattttgtcaattgtctcaatgtttttccctttctcaacacaatttcagtccagaatcactgtgtttaagtctctttagcctcctttaatctggaaatatttctttttttttttttttttttttttttgagtcggagtcttgctctgtccgcccaggctggagtgcagtggcgcgatctcggttcactgcaacctccgcctcccaggttcatgccattctctt

SEQ ID NO: 117710 - DNA, 2423 bp, Homo sapiens
gggaggctgaggccagagaatggcgtgaacccaggaggcggagcttgcagtgagctgagatccaccactgccctccagcctgggcgaaagagcaagactctgtctcaaaaaaaaaaaaaaaaagaaagtagctttcattcactttagcttttcatcttgtttctaaaggtggggcagataaagtgagtaggaactgaggtaggaagtcttggtgctagagaagcccaaagggaaacattctgtgtgtttgggaatgccctcttgtagtacccctcctatttgtaagcctgaaatcattaaatattaagaggttgtaaggtttactgggtcttcatgtgtaggctagttagaattttttcatctatagtgaatatagctttcctgatgcaaaagtcccaaagtaggagaagatttgttacatatttcatgtttgtgtttgatgtttgcctgactgactttttgtttcttatttagaaatgactgctgtccatgcaggcaacataaacttcaagtgggatcctaaaagtctagagatcaggactctggcagttgagagactgttggagcctcttgttacacaggtaagaatctgaaaacacaaatacattgtaacatggttctatagcacaggcctgggtaacaaccataagagcaaggttatttagttcaaagccttaattccagtacttgagtttaggtgacagttcttagatgatttgaatattgatgcatgggtttagttaacccttgagaacgctgctgctgtcgttttcttcagtcttattgctagtaacgggtccatggtatgtagtgcaactttgcaaatgtttgtgctttgcagatacttcacctttcttcagaggggaaacccaagaaaggtggagtctggatccttgattgttaaggtctctcactctgcttaacacacctttcattgtgtgggattaattagcaggtaattcaacttgagggtttaggtttggtatgctacaaatgtcacaatgttagggtagttcataaactgttagcaactagctgtgtacttttagtgttttacaatagtatgtctattgtttgtatgtgagagattcagagagagagagagaaaatgagtcttgtttggcaaatttacactataacatatattcatcatctttaacctagagataatctggtattatgtgtattaatgatggtaatgttctaagacataaagcgtcatcactgtaggcttctttgggcaatcattcgtttattgggacctttactaattgctgagatttgtgtgaataaactgtcaaaagacttcagaagcaaattatcttaaaatgttttgcaaagtttgaaaacagtggcagtgtgatctccagataaagctaagttcattgttaacctctttctggaacatcttggtgacatatagtagagacatctaacttgtctctaatcattttttaatttgtaaaatcaaactaaaaacctaatgatcatatttgagaaattaaaatatgtgttaaataattctctgtacacattaagaaagctgaattattttggaaattaaatatagcatcattgctgtatatcttaaatatggggaattgtatgttaatgttcagtggaatctcatgtgattttttaaaagaataacttaatcttgctgtctttaaagatattagtttgtcattttaattgactccagtttaatgttaaaaatgaaacttttaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtaggtcattactgctttttaggtaaagagaggcaggcctttctagaaaatcagtgtttgaagattttttttgtggtcagtattctcattcttatgcttgccaattgctcagtaacttacttagttattggagatgtattaagttggactggctcatattttaattctcattcttatgcttgccagttgctcagtaacttagttattggagatgtattaagttggactggctcattttaatcatgagagatgcttgcagagggacatctggagaatctgaatccacttctcttgggtatttcaagtaatagttaagtcttagaaatgttgtaacacaaattgataggaaagaaatgggaccgaagtttacttttcatcctgtgtaatacttctttttagttcatgctgaagagatgggtgtgataaaatggaaaaatatctacctactctgaaaatactctagaaattgtcctattgtgtcagaatagtatgttaaatc

SEQ ID NO: 117711 - DNA, 1126 bp, Homo sapiens
tcttggcttacttttttctttggagaatcttaacaaatggtgataagatctcttttctatcataaatagaacaaaatacatattacaaaaatatgaagcacagattgcttaatcaactgagacttgttggctatgtcgttgaagccatttactcatcgtttgaaaccctgtagtggtgttaataggtctgcagattctttggacacccctcccttaaaaaaaaatagagcctaacccttgaacatgggttgaacttagtgattcctacaatgactagaatgtggtagaagtggtgctatttactttgggagcaaagttataaaaatggggccgtatccactccactttttctcatggattattctgtctgggggaagctggctgctatgtcttgagtgcactcaggaggtcctgtggagaagaactgaagtctccaaccatcagtcagcacacatttgtcaagcatgtgagtgaaccacctaggaagcagatcctccacctccagtcaagtttcagacaacatcagtcctgaccaaccccaaatccctgacccatagaaaactctgggagttaataattgttttaagctgccacctcttggaatttcttaggcagcaaaagaaaatttatacaaacacttttccctgccctggcttcagtggtcctgagcatttacgtaaaaccctgacctaacttttctgaatttttctgataaataaaaatatgccatccactgaaacacttaatttttaaaggatttttaagatgtctttgttctgaatcactgttgacgttgtttaggatgggggttggtaaatttcttctagaaggccaggtaataagtatttttggcttttctgatcataagggctctgggctgggtgcgatggctcacgcctgtaatcccagcactttgggaggcccagttgggcggatcacgaggtcaggagatgaaaactatcctggctaacacggtgaaaccccgtctctactaaaaatacaaaaaattagccgggcgtgttggtgggcacctgtatacccagctgaggcaggagaatggcgtgaacctgggaggcggagctggcagtgagccgagaccgtgccactgcactccagcctgggtgac

SEQ ID NO: 117712 - DNA, 1100 bp, Homo sapiens
cataataaccaaaagttggaatgtacacagtttttgatgtgtaactttctttttgtgttagaccctgattacataaataatgaatatgcacatttgtgagtatactaaaatttcaccataatgctgtaagtgatgttaaaaaaattcacgtacataaaaacaggatcatttgacttcaaggctaatgaaatggtcaggtgagccacatgtggtggataggagccagtcaccaattgcatggcttccaaatctctgtgatctaagagtttaattgtactactaatctgcttcgtttttgagtagctaccttatataggcagaggtgtacatatgcctcttagatgtgctcttttcttattttaggatcctgtttacctcccgtatccccccatccttatcagatcaatcttacctttgttcttttttgtcttagcgcttatcacagtggtaatttaagttggttgccttttcctctctacgctccagcagtgcaggttctgtgctggtctggtgaccattctgtttgtatctatgatagtacctggtccgtgataggcacttaaatgtttgagtaagataattgattattctccgagaagtacagtaagagaaaatgcttttttctcgaaatttaaagtgtgttttcctttccagtgccaaatgtaaatgcatgggtaggggtggagaatcttatgttttttttaaaaaattgagatataatttcacataccataaaaatcacccatttaaagtatacaatgcagtgttttttagggtattcagagttgtacagctatcaccatgatctaattccaggacatttttatcatcccccaaaagaaacctcatactcattagcagacattccccatacatgtacattttaacagtagataaagagtagcagctgccttgtggtacataaatgtattttatgaatccttgaatagggctctgaccagaaaaagaagcctcttaagccggataggggactttcaggggacagagatgagaagacctaaatgaagcttttttgaaaaaggagagatattatgaacagaggcccattaatgttaaatttgaagtggagtgatgaggaa

SEQ ID NO: 117713 - DNA, 1640 bp, Homo sapiens
gagaggtttaatatagtttggagcatatttagagggtggcttggaatgccatgtggcattacatggttcaggtcccatatgcttgaatgtatcaagtgacacaggactcactcactacctcaagggggagctctttccagtattggtttgtgtttattttaaaagcttttttttccccttagaaactgaaatttgtctcttgaattttcttcctgttttaagaagttccaccatctgggcaatacagaatatgaggaaaagtggagtttttgcagggagattagtgttagctgtgtgcaggaagggttaaagtgactggtagacagcccagaggtaggacctagagtctggagatgaccatagtagtggggagtgaaatggagctgtgcaggaagggactgctataacagaattgatggaaagagagaattggccagttgtcatgcatgttaactgccagcagggcctgtgcaagtagctgatcttttcagtaggtaaaactaagggacctggtatgtgaaaagttgtagtaatttattttcctgtgacttgaggcatttagggtggtgttgaggcagcatgtgctgctaagaacctgtgttcttacaggtgtaaaatgctgccttttaaaatgtttgcattatttgcttgtaatggatgtcaaaccttattttgtgttcattaatcacacgtattaatgtttattaatacatctgaaacatgttatttgtgtgagttcctatggcaatgataagtattggtaaacattagtgctcctttctctgttgatttgttgaagccctgttatttttctttttaattggaattccaccaagttttcaaaaattgagacatggctcattgggctggagatgctgatcttttagatttctctttactaatctaatggcatagcagaggttaaattaccttggagtagaaaatcaagaaatgattgtgtgtgtctgcaattttggttttaatggtaggacaagattatggtagtctgggaaaaggtgattgagtgctgctgaacagagcaaggattgattgtagctaagtctagtgacttactgcctgccatttggtttgaccttcattttgtgactatcgtaccactaaccacagccagtcacctctcatgtatgtgttgttattctcatggcaaacactgtgaaaacctctgggtaattcactgcagcctcttcttcagtgctgaaaaaacattttatagtgacaactatacatcctttgtcccccagatggccagaaggtgaagatagagtaagttcttttactaaatattcctgtccataaataaaaagcagacatcttaatgtttggcttacagttttttcccctttcatatctatttatgtttagacagatttgtcttaagatttctttgaaacgtttctttttaggttttggctttcaggtcattccatttcaggcaaactttgatactgcgaatgcattttccttgagtagaagatctcaacttactgaaagcagtcagtgttgttaagtactaaatctcaatcattacataaatcatcttttatgtaaaaaatgtcggccgggtgcggtggctcatgtctgtaatcccagcactttgggaggccgaggcgggcagatca

SEQ ID NO: 117714 - DNA, 1734 bp, Homo sapiens
atctcagtaattgtgtataactgtgtagtgaagctaaggacatagatgccatcttccttggtacagcttgaataatttgtatatagggagaaaaaatgtgtacacacatgtatgtgtatgtgtatatatacatagttcactgtgaatcttggcaaggcaattttcagaaaaataatgtatttcatccctgacaaaaggttattgagcacaagctgtcaggctcttgaggcatgattttctccctggcaactgactagagtcaagattgaaggaggcgaaaattggtctcctgtccagtgcagatgttgacagcttcagactgatgtacccacatctactataggcagcctggaagatagatgttaaaagacagctgtgattaggacaaagcacgtatcagtgactgttttaagtagagtttgagacgtagacaggaggcagaatggaatctgggtttgctgggttcatgatgtgaagacttaaaacatagctttgaagagcattgtgtgggtgtgtgtgagagagattgcattttaatttgtctgatctggttagtgtggttttaatcgggttgagatcatgagcttgatctcacatatgggctctttaatttttcacaagagaaaaatgacaagtgttcctactttggaatgttgagtatggatttcaaaaagtgttaatgatgctctggaagagcagtagctgggaaacattcaacattttgaaaaagattaaagttaagttaattagcttttcagattagtacaataactttattaaaactagcaagaaatcagctgatttttttctcatagtcttcctttgagttctggcttctcatttgttatcttaccttttccccttgttgtcttagaattttcatcctgttttctcctcttatttttgtggatgtctcttttcatgtgatcccattgtggcttggtcttttgttagaagtgctcccactccaattcatacctttcagatgttcctgaagactgtaattaatttaaaaattgttattgaccccattccttcagtctcaccatttaatccattttttcttgttcttcatttaacttgagcaggaaaagcaaaatataaattctgaaaaatcattagctggttgtcatctgggaattttatgtcttaaagttgtctgcctgacttaaactataagtctttagggcagaggctatattttctttgacttgggatgtttcaaggatgctgtctgcttctggatcactacccttgtgtgagcatatgctgctttgcagagacttgtgttctgctgtagccagcttggaattgaggaaagaagagtgaagttattacattctaatgtcattttgaagtggttcattttttccccttttattaaaaagtctgtcctgttaagctcacaaaaataaataacactaaccaggataataatatttatgagttacagtgggtaatattactgccttaatatatttgtacagtcagtgtagctgaggaagttattttaggtattaaaattttagttttggcatgacttcaaccatgatgttgcagtaacatgatttctactagttaatttcttaagaaagtgattccaagttgaaatgcatgttatgcatttatttgaatgtgtaatcaggaagtaagtgcctctctttggagtgtttctgaatagcagcagggcacacttgaattagtaaggaaaatgagaacatgaatatgtgtgtt

SEQ ID NO: 117715 - DNA, 2636 bp, Homo sapiens
gttaaaatcattttgagataaagagaacaaagttacttgagcaaggttatctgggaaatcagtgggagaagggagagttggaattccaagtatgctcatgaaactgatcctgaaatgagtaatttgaacatgtttaagatagttgatggtgtctaactcttctcctggaagcttttgtcattttagcgcagggctgtttttgctggtttgcagaagcatattcaggtggatgtctttaaaatctcttttctcttttggatttggcagttgataacaaacaatatgctcctgtaaaatgttctgtttaagaaatgcctacctaaggtctgtgtaaccattgaatcttcttccctgcagcaactctacagaaaattttaaaaatgagattggggctacagatacccatttattttaccacttggcttactcttattttggataaaacccctctagttagctgactttataagcttttacagaaagattttgtaatatgtgcaagttttactttttcatttttgcatgaactagcagccatgggatttttatacttcagaaaaaagaaaatttgaagcctgagttttattatcatacacacaaactaaagatattggcatttttatcatttaaaaactttttttatataaaagtatattcactatagaaagtaaaaataaacaataaacaatcacccatcaggctgtaccaccttatgattaagctctgtcgatattttggtatgtgttggttgtagtgtttaccatcccatccctttcccaggacataaacacattgtgatctccattctcactgtgcagtacagattgttatatatctgctatttaaagtggaaatgaaaatcatttccattaatgaagatacctgggtgggggcagattgtataatttatcgaagataagctgtgtttctctactgggctggcaaaaatattttttctggaccttaaaggtagaaaggttctggtgaagaagctatttaaaagtatccttagtattattttggggaaggagatataactttgccctatttattgaggtttttggaggacttttacaggcagtagagatgtttccatagctggatttctgagccattacgttgtggttgggaacctttcttttgtagtatactgtagaattttgggatgtgacactgtaaatgggatagatgaggaagatgaccagttcctgagaactggaaggaatcccagcttgacttgagaacttctttaaaacaaaatgaaacaaaacaaaacaaaaaaactgctaaaaaaaaaatttaaaaaaagcagttggaaaaacgtaaggcacagcaagctttggttgtagctattagcacaaaaggaacaattattactactttctgcactatagacagtggagtgaaggaagctcccctcatcctttacagcttcagcatttaaaattaaaagctaacatttcctctgtcctttaggaaacttggtatcatgactttatttctaaaaaggtaagaaacagctggtgtgtggataatgacatgttctaaataggtttaaaaactggaaaaagtagatggaaaaatagaagggggcacagaagtatttgttgagctttgcatatattatttcatttaattttcaaaacaactgagtaaggtatgggagatgtgtactcattttacagaaaagaaaacagctagagataaaacaacccaaagtaacacagctgccaaatatcgaagctggatttagacccagttccaataccttatttcatctacaccaagtagtgttctgggagagaagtagttatattcattaacattacttcatagcattctttgttttaaaggagcaatgtaacaggttcaggttaaaacaaacaagccttttgttttttttatccatcacccaaatattttccaagcctatcctttccccgtaactttataaagtttggttgctttcaggggaatttactcatgatatttgatgcttcaaaaacttcttgattttgtcttctcctaataaagaattgtgggtttttttgtttgtttgtttactttataattgcccattgtctttgttttaaactccagaggaacttattttattcccagctcaggagagaacatcaggggatgacagattttatttcatggcagatggtacagtagtattgagctctcttaagtttcatctcctttgttagtagatgtagtgtagttgactggaaacagctgggacaaagtcaggttttacaaccgtgcgatcttggatatagttcctgtctacctcagtttccccagtttgcccttttgtgtgcagagagcacttttgatatcttataaatttaaactaacaggtatctttttaaatttttaattttttttattaaaaaaaattttttttgagatggagtcttactctgtcacccaggccactgtgcctggctaatttttgtattattattttttagtagttctggtcttgaacctctgatctcaagtaatcccctaccctcagcctcccaaagtgctgagccatcgtgcccagccttctgccacattttgtttttttagacagagtttcgctcttgttgcccaggctggagtgcaatggcgtgacctcggtt

SEQ ID NO: 117716 - DNA, 1077 bp, Homo sapiens
tagttgggatgattaatgaagtgtggtggttctgcataattgtggccctgtttctgtattctatggatgtgagagtagattttattagatatgttttttctcctgttcaaatcttgaatttttcttttttttggatacatataatgcccttttttttttaaaggaacattattagatcaaagggaaatatttttaagcctcttgatatatagtgccaagtcactttccagatattttgctttcaccagcaatatatgaaggtgctttttttagtgatagctataaaacaaacaaaggaacagcaaacaacaacaaaaatgaaaactcttaaactaaatttgtgcatgaaatatacaaagtttggattatttttatatttttaaaaatgtagatcagttatttgagttcattcttgctgagtttgtttttcattctgtaaaacaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtaagtatacaggcctatgtctgtaatttgttctatcacaggaagattgctactggccttccttagttcagtattccttaggatttagtttggttttgaatttggtttatctcaatggaccagagatgtttttgtttaatttccacttactcctctattccaagtatatatcatcctggctctgttctgagccagtgttgtcttggctgtaatgaagaacttgtagcaaagatactgttttgactccttccctttttccagtaatgattaaatattttccttgtagagttctggagttgagaaaccaagatacattaaattttgtacttttatttatttatttattttttccatttaaccctgagtggacacagcacatgtttcagagagcacagggttgggggtaaggtcacagatcaacaggatcccaaggccgaagaatttttcttagtacagaacaaaatga

SEQ ID NO: 117717 - DNA, 1056 bp, Homo sapiens
cagcccggccaacacagcgaaaccccgtctccaccaaaaaaatacgaaaaccagtcaggcgtggcagcgcacgcctgcaaatcgcaggcactcggcaggctgaggcaggaaaatcaggcagggaggttgcagtgagccgagatggcagcagtacagtccagcttcagctcggcatcagagggagaccgtggaaagagagggagagggagaccgtggggagagggagagggaggggaagggggagggaattttgtacttttagaggccaatattagtgtttttcccactatgaagctcctgtgtaattgctgtttaaatgttagaagaccatgcgcaaactcgagagctaagtttgggttgctttttgagtagttgttaacaggaatgaaaattcctaggatgccatcttctttacagacctacattcagaatttttgggttttggggtctttcttattttataggtggaagatggtatcttgaagttgaggaatgctggcaatgaacaagacttaggaatccagtataaagccctaaaacctgaagtggataagctgaacattatggcagccaaaagacaacaggtacagtcatgatttggggatatattaaagttgttcattttactatctagagggaaaaactcattctgtgtgttttctgaaagtaccattacttaccttcgccaatatagttccattaaaacatttaaactaaggtgtcttttcagtattgtgctgttaataaagttgtaattacattgcattcatgttatgctcctattttaattcttgtgaacattttatcttaagtagcttgacaacttgtgatgaaggtagtgtctggagaggtaataggtctttgtgtatttaaggattaacctgaattagtggtgcagttttgttcagatttttaataaaatcttaatccatttaaatatactggaattatctctgtatcagaaagtatctccataccttgccccaccagccccgtgtcttgttactttttaactgtttcttattgttattagtattttccattgtgtggcatgag

SEQ ID NO: 117718 - DNA, 1019 bp, Homo sapiens
cgagtagctgggactataagcgcctgtcaccacacccagccaatttttgtatttttagtagagacggggtttcaccatcttggccaggctactcttgaactcctgaccttgtgatccacctgcctcggtctcccaaagtgctgggattacaggcatgagccaccacactctgtctggaattttgtatgctattcaagaaacttactagaaagtaatgctacctgagttgttttttttcttttttccaaagccaaatacttctcaatgcctaagttttaataccatgttccatggatctgtgaagagttccttgaacataatcccttatgtatttttttcatgtgtttttttttgaaagtagtagcaaatgccaaagttttctgaaataagatgtcacagaaatattggaattattatatacatgctggataatcttctgtttgcccttccatattgtttcccacccttgtttaccctattctctgccccaggaacctaacctgcctggatttcatttgtgggctcctgcttgggcttggtgagtgggagcaccagcaggaggtcaaaggagatagagtgatgctagggtgttactcttaggcctctttcctgctgggtgccctgggttgctaaaagtgatggcattctctacacatcttgctccctggttttggtaactgctgcctcctcttgtcccttcattcctaagtgtcctaccagctttgtagtttttctgtattttgtccatacctatgtatgatagtatagtctctaaactgcctttgagtcacccgatttgattttattctatttttttctgccagaattttgaatgatacgtattcgcattttcttgggtttatagtaagtcatgagtcatttgtagttttccttgggcctaagtttttagccttagcctcctgaaagagaattcactgagtagactggttgtgggctcctgtgtacccccgttcacaaaatggtcttttataggcttgggccttggtgtatattccagt

SEQ ID NO: 117719 - DNA, 1026 bp, Homo sapiens
attattcttattacagtaaatagtgctgtactgtgatagtgtccgttttctttatgtaacaaaatctaatttctttgtgctaaggcaagagcagttctaaagagagaaaaaagaacactttagcagtcaggacaaatgatggtatttcgttattattttcatcatagattaaaatatatccctcatactttgtaaataggagtctatcagagatacactgtgataagggcaagacaattagaaaatggcacacagaacatatgcaccagctgtttaagcataatggttaaccctagctccttgtcataactcgagtcttgaaatgatcaccaattctctaaatccacaggatcttgtttctgaatatttagcctaatgtagtctttggaaaagtagaagttggtaataccataccaggcagtggcttaggaaagtcatgtgttgaatagtaattatggcacctgctaacttgagatgaccgtaagtgtctttggtaactaacctttataagaagctatgctgatctaggtcatagatacttaggaggaatgccaaagctgattgcaaagcatttttataaaacggtagacaatttaagtacttaaaggcaaatgccttcccggaaaacttttagagcccctcagattgtggtgaaggcaagacatttagaaaatgccacacaaaacatgtgcaccagctgtttaagtgtaatgtttagtcatagccccttgttgcttgagtctttaaatgataactgattctttaaatctacagggtcctgtttttgaatatttagcctaatgtactgtgttacagggcatttggagtgctgtgagctattacttgcaaatttagattccaaatgagaaaagaattctaggaggaaaagtaagctgtcatgttatacaaggtttgaataaagatgcaaacctaaatatatactgagatgaagtttcagaaaaaggaagccagtttggtgtctctaatgcctaattaggaactcatctagaaagatgaaccactaaa

SEQ ID NO: 117720 - DNA, 1588 bp, Homo sapiens
tgactgtatctcttcatgatctttctatcgttggttggtataggtacatatatctatatagagttgtaatcaagatgctaggcagtttgttttgtcttttatttaatgccttatttagtgctgtgctaagtactttacatacattatccgatttaatcctcaaaacaatgataagaaaggtactgttactgctcttctttgacagaaggggaaccttagccctgagggtttaaaataaggtcataaaatagccaggagaaagtagaagtgggtgtggggtggattcagatctaggtctgtgtgattccaaagctcagaatcttacctaccaaaccatactgccttctttgtgattgactctcaactagattgttaatgaaaataatgtgtctaattaatagaaattctaacttttcagcatttaccagcaaatttttatatgagtaaagcccatataaagagtgctccaatttcttgttttatttactcttgtaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacgtaagttatgcttgggtggaaatttccagctcttgaccatcccccaaaagataacagatttctggggaaaagtgatcaaggcttctgatgatagctcaatttccacttagatctttaatctaagtcaaaagaaattatgaatcatcagtctacttgattttaacttggcctaaaacatttatttttatttttgtttttagtttgaattaaacttctggattcttttatgtagcttgtgtttcctatgaggtcattctttactgaggatatgggtttggttcatttcaaccaagattttgaccttctggcagatgtgaagctatggtagatacagaaactaagtacacgtagggtcagccccctagaggctcgtggtctattgggagatagagaaacatcataagtgactgcagcaaaagtaccatcattctaatctttcttgtctgcctagatatacttcttttcagtgactaaattggaataatgaacagaaatttaatcaagtggaagcaaatttgggattaaaatactttcttagcataatgccataattacttttcataaatgatgcgctaggtctgtcctgtgtacacaactcttaaggttaactttttggtgggttatgtgttcttaattcctacccacagtgcctcttggcttccagtagatggcagcagtataagttttttttttttttttagggctttaaaagtaactgttggggctaattaaaaaaaaaaaaaacaaaccaaaaaacagaaattgtgttccaggtgaccagcatcctttcataaagtagggatgctatgaaatatagaataaa

SEQ ID NO: 117721 - DNA, 1102 bp, Homo sapiens
taatttttttgtggtgcaacagttctaaatatcacatggcagttttatattctgcaagtaagaggtaacttttattttccttgtaattctcatctgatgatttgaattgctagtcttatacgggtttacctttagatgttcagaataagttgtgtgagcatgatatgtttgtatttgtggtatcataccttatcatgccttgtttggctacatagcattacttccactgctttctttgaggagtgatcaacagtaggccatcttctgtgggacagccccttacctgctaagaagtataactttctttcagatgttggaatttttgtgttaaatcttgatattactaataacacttttctcaccttgaataaagaagggaacagagatgagtactaacattcggtaatactttctctgcagaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgtgagtttgacagcttttctttgaagtaagatatttatggatgaggagttttctataacatgttggatctgagatgttttcactataaataccaaatatgtccttgactccttgatttttgggagtaggtcagatttttaaagaaatggataaatggctaagtggctctttcctctctccagcttattgagaaattttcaacttataaaaatcatacagtgaatacctaggaaatttatctgtattcatcaattaacatgtagatacatgtgtaggtgtgtgtatatataaatgtatatgtatgtatggtatatacacaaacatccttttttcccccgaagcctttggaagaaagttgtagacattgtgatgcttcacctctaatattttagcatgcctctccaaagaataatgaccttctataccactaaagtttcattatcccaagtaggtggctaattttgggcaaaagggaatg

SEQ ID NO: 117722 - DNA, 1049 bp, Homo sapiens
tttttaaagccattgccccctgggcatgatggttcaagcctgtagtcccagcgttttgggaggctgaggtgggtggattgcgtgagcccaagagtttgagaccatcttgggcaacatggtgaaatcccatctctacaaaaaatacaaaagttaactgggcatggtggcgcacgcctggtctcagctactcgggaggctgaggcggaagaatcgcttaagcctgggaggttgtggctacagtgaaccatggtcgcgccactgtgctccagcctgggcgacagagcgagagtgtctcaaaaaaaaaagccatgttttgattataggcagtctacttaagaaaaatgagattagaggttttgttaaatcaaatggaaaaagtggtttttaagtcacagtgaaaatgtgggacacatttaaaaatccatagctaagattgaacattagaaaatattttaaaagatggatatgttgcagaatggctcacaatgttgcagtcttaaacaggggaacaaaaactcatggtaagtggatcagtcatctgctatcatgggtagtgctggaaatggtgtaaaagtgtcttatgtagttatgatgaggaaatcacttcaaaaacagactttggtgggaaggaggatgtgataaatctgttccgattgctccgttttagagcctcctaatcagtctataagatatcccttgagtcttgaggttggtcacattcttgggccaatcacccctggtcatgagtaaccttgaggtttcgaaacctagagtgccatacaaacagtactgtctattcatgccatcagtgtaagaaaaggtgggaagcactcatttatactgaagacatggagactgcagtagcattcttaaatgaaaactggaacaatgtgtgatgtgaggctgaaatttgagtattatggtagggatcttgaaagaaatcttggccgggcacggtggctcacgcctgtaatcccagcactttgggaggccaaggcagacggatcacaaggtcaggagattgagaccatcctggctaacatggtgaa

SEQ ID NO: 117723 - DNA, 1070 bp, Homo sapiens
attagccggacatggaggcgggcgcctgtagtcccagctgctctggaggctgatgcaggagaatggtgtgaacccaggaggcggagctttcagtgagccaagatcacgccactgcactccagcctggggaacagagggagactccatctcaaaaaaaaaaaaacccaaaaaataaacaaacaaaaaacagaaaaattagccaggcgtggtgtgggggcccctgtagtcccagctactcgggaggctgaggcaggagaatggtgtgaatccagcaggcggagcttgcagtgagccaagatcgcaccactgcactccagcctgggcgacagagcgagattctgtctcaaaaacaaaaaagcacaaaagaaagaaatcttcttgagatttagaaatgtattttaggagatggtctctgggtatgtttctcctaaaggtaaaaatctttagtttccttttattgattcacgtaacagtgaacaggcttggtcctgtcaaaaagcactggagtgaggataaacggtgagggcagtggagcacacttgaagaaagcttagaatgataaaagggtctggaagaagcagaagcaactggggatagatttttgcttatttatgaagcattcaaaaacatttagaacctctagtgagtgtcagaatataaccagcaatgtctgcctgtcagtcagttcattctgagtatgtgacacatgcaaagcagtgtgttgggcacaatgtaagaggaggaatgaggctctgatccctcccttctggaacagacaaagtttctatagggggtttaatgggagtgtcatcataggtacagccaaaatgctgtggaaattgcaaggaggttgaggttatttctatctgggaaatccaggaggctttctcttctagaagatttattttgtaatcttttggttaacttctatcttgattttaaaaaaatggttcattttatttctgttgaaaaatattagacaaattatgttatgtggagaattgaaatcacctacattaattaatacttgtttactacgtggaactttgtataaacattgttgtaaagtc

SEQ ID NO: 117724 - DNA, 1027 bp, Homo sapiens
tgtatatatgtatgtatgtatttatttattttttgagatggagtttccctctgtcacctgggctggagtgcaatggtgtgatctcggctgactgcaacttctgcctcctggattcaagtgattctcctgcctcagcctcctgagtagctgggattacaggcgcccgctaccacgcccggctaatttttgtatttttagtagagatggggtttcaccatgttgaccaggctggtcttgaactcctgacctcaggtgatcaacctgccttggcctcccaaaatgctggtattacagacatgagccactgcaccaggcctgttttgaagaggaatattggatatatagaaccaaagactgttgggcaccaattccatttggtcattctctcaaaactgccattagggctttttgtaatgtcataatttggaaacataaggaagatatttcctttgagttactttatgctgaaataacatctggtcagtaaatatcctacaagtattactttcagatgttttgaaatgattggcctcctgctctggttttaaccccagttgaagacactttaatgtttgcagtttataataatctaccaagttgaatacagtgtgacatcgtatttcaaggcttccttaagggctaaccgtcctttaaatttaacactggaacatattagcctgaattacttctccttgctttgagagagaattactggttttatagattcaaacatgaaagtcatcttctaggagtgaaaagattaatgttttggcttgcccttgctcttgtgtctgtaagaatattgcttactatttcctggtataaaatgacctgagatattttattagaaaaattataccggccggggcaacatggcaaaactctatctctataaaaatattaagaattagccgagcatggtggcacacacctgtagttccagctactcgggaggctgaggtaagaggagagcctgagcccgggaagttgaggctgcagtgagccatgatggcaccactgcactcca

SEQ ID NO: 117725 - DNA, 1019 bp, Homo sapiens
agatttgaacagatatgaaagttggtttaggaggaatggttacatacaagataattccttacagagtgagatgtatgatttgtttaaaaacattccagcagaaaaaccaatggaaaggtgataaatgaaacaagaaagcagaaagttgatgatttttaaagtttggtaatggttaagtgagggagttcatttagtattctcaatccttttggtggttatgttagaaaaaactcataataatttttttttttaaaggacatgtcatcaccatgatggttagttgagtaggtgttagcatgttagatgtctgagagcacagtccttgccatatgtacacccttcggagggcatttgcatgctttgcaacccctggaaggccttgttttatcccactcagtcctcttctcactctccattttataggctggctggtgcctatgctgattcttaagccaattagattctcttggggatttgtatgggtaaataatgggaaaatgatgcaattagtaatggaaactgaaaaaggaaatgatgccattatgtagagccagggtcataggggtcttgacaaagtgaacttatggctgagtagcagctatgaattagataggcagcaaagagggtgagaatgggtcaggcatttgagattggagaatgggatagccagctaagaggagtgtcctgggcttcctgtatggccgcttctaggggcagtggcccagctgtacttgggttcttctgtatatgtgtccttgaagtaaaaccctttgtcactgtattcaatttgggtttctggattcccccaaaaggagtctactgtagttactgaacagtgcagaattttcttggctaaattaaaagtaagcactttttttagaaggtcaaaagtgatcattgcctattcatctaggcattccattgtgcaattcttaaggctttttttggagacttggcccttccccaagtaatttaatttttctttttaaaccaaagtggaagcaagtttgtggaaagca

SEQ ID NO: 117726 - DNA, 1039 bp, Homo sapiens
agtacgaaaccttttgtctcttagctgcttgacttttatataatttagtagtgatgtttacattgttcactagactttgattgaattgaatttaataaatggcagtaatcaggtgttttttggtggaggggttagcttgctgtcttcaggtttcctatgcttgagaatttgcctcaacacaattttaggtggctgtaacactattttgttggccagtataattttagattcctcactttggttgttggttgttaaaagacatagggagctttgtttgactctaaatctaccattgtctgtctctttccttttctttggtgttcttttttaggggacgaaagtaagaattgagaagatctggcttagataatgctagtaatggagattttaaaaaattacctattattttattattataaagcactagagcaagtatagaattatgtatagtaagtaggatatacaaagaaagaaaagattggcattcattggctctggggagtgggctaaggttaaaacaaagatttagagtcaaaaattaattagtgtgcaggagacagcaaacctcttggcttggtgggaatgaaaaactatttaataagcataactggctagaagcagtcttctttccccattagtaggtggctcactgacattgtcctaggtgtttgaaatgtttgtttttctccctttaatttgctcctgtgtataaagttactgccgaaggagccaggactgaatcagacttgagcaatacggggcttgtggaaagagatgttttgatcatattgttatttttgtgtcataaaatcttagattggcaactttcttctagggtggatttagcctttgatacattttcttaggcccacgaaaatgagctgctaaagtagaaatgaataaaactattcggtttagcctctagacagtgacacattaaggactaatgactgccaaaaggaaatgtcaaacactaagctagtctactttctttggcagctgagaatccggtgaatcaacagttttagggggtgtatat

SEQ ID NO: 117727 - DNA, 1021 bp, Homo sapiens
gcatattttgggggaggggcatttctctctaaattgatgtactaggagatagagcatatttttgctgccccaagtaaacttttgatgcattacaaaaaggaaacatttgggcaactcccatttctgttgctttggagcttaatagtcattaagtttgtgtttctttatgtggtactgagtaaaagctgaaagtagcagagattgtataggccagtatatcttttgttagttttgaacttgttgggagcacttataattacctgtgtttctagagataaatcaagtggcacctctgtttctttaagttcttctttacctagctgagattcaggggtcttgcttcttgggtaataaattctacctaatttgaagctttgctttccttccagagatgtttgaactacatttactaatgcatatatgctgttggcataaagataaatttgttattgaagggattttctatggagagactgttctagtcttgacagctgcactgagcatgaaaagttacctaagctttcccaagtctatgtttcctcaactgggaactggggatgataatggtgcctatgcacccatcatggttgcaagtgtatagaaaagagtcatgtaaggcacaaccactgctgttaatactagtgttactattaacattgctataactaataatttatatttgaattgttcacactttaagtcctcttttttttgtttgtttgtttttttagctcttctgatttccagtagtttcatagagccattgcatttatcattctcctccaagagcttagttctctctctgctcccccttttcttctctcttcttttacagtcatggtcaaatacatttggagaattttcccttttacatgtgtattctgataataatgtctaaagactgtgtccctgttgactgtgctgcatagcttattttattgctctccatttgtcttaactgtcttgcctgaagttggtagctttattcctagattcataatatgctctctttactattaaa

SEQ ID NO: 117728 - DNA, 2755 bp, Homo sapiens
gattgggcctggcatacttttttttgagatagagtctctctctgtcgcccaggctggagtgcagtggcgtgagcttggttcactgcaacctccacttcctgggttcaagtgatttcctgcctcagcctcctgagtagctgggattacaggtatgcaccatcatacccagctaatttttgtatttttagtagagacaaggtttcaccatgttggtcagactggtctcgaactcctgacctcatgatatgcctgcctcggcctcccaaattgctgggattacaggcgtgagccaccttgccctgcctggcatacttctttattgttaattctgagttatctggcatggggaagcatggctctgatcgtcagtgttcattctctgaattgagttttgtataggcatctctgtataaaatttcttgattattctttcctactggttttggctttatttggtgattgcatttgaagtagactgtttatttgaatactgtaactattcatgtagtttcatgttcattttttataagttgtatttcctctctatttttttttaaaattagcactagaggaaaaagctattatgaatagggttttgttgtttttgttttaacaaacccactatctcattgtttaagagaatttacacaccctagaactggttgaataattaaccaaaaacagtaaacctaggcatagcctatgtatttaaaaaacaaaaacaaaaacaaagacggtaggacaggcagtgtgaggtctagaagttctctttccctttcatgttataacattctctgtctttagagctcttaaacctctgaagagaaaaatcttattaggaaaatctttatagttaagcagggctgactttgaagtgaggcacgtgcgctggctggtatcatcactccacttcaggagatgtgaacagttgccatcagatgttatctatgaacttactcattggattaatggttatttgcttcagaaaactaaagagtaataggagagcaattcatttgctggctttcatagggttcttgttttgaaaaaggtctgttgttgaactgagatccttacagttgcatttccttatacctgataaaaagtttttttttttaattcttaaaataggcagtgcatttacatggcttaaaggggtctaaaagagtatctaatgagcattgcctctcatccctgttacctagccattcagtttctcttcttacagtttcttgtgtatcttccagaaatattttttgtagatacaataaaacacacacacacacacactctctctcttaagatttttgtgtcttttgacttatatggaaagttattatacttgattgtgaaataggttttactatgataatttgctgacctacacttattttgtttttttcctctaaaacaatgttttcctaatgtttatttactttgctcttatggctacccagtctgattccacatgccctcttttggccaaaccatccgcaatttgtgctctccctgtcttctatctttgccttccttcttctttcttagatatttaatcctggatgcctctatttctattcactgtactatggcatcagcttatagtcccttaattgcaatgaactctatgaagctcacatgtctagaatataatcactttggcttctttcatgtttgaattgtttttcaaccaagtcagatcgagtggccttagtctaggtgctctgttattgactgttctgtataatgttgaggatacttctatttaacaaataattaatactaataatagtacatcttactgtattatctatgtagccattaggcatttaccatcttctttcaaatgtttatcttacggtgttagatctctttatacttcattaatttatttttcacatcacagatggtttaaagtcttcatttactataacaactttgaaggttttactatttcactgtagtctctttcagtttgtgtatccaacgactcctgtggtctttagctctggatccagggtcttatccagaaaatcttcattttgttctttcttaatttttactgaggctctctggttttagagcccaaagatggatgcttctacagatttaagttttacctattatcactacaaaacaaacagaaaccctgtctaataagtcttttggtgattgatattagtttctgctttctaatattagatctttaactttagccatgcacaaacgttctgttaggggaatattgagcattaccttaagcagtggtaaaaactggcatgctgtgttatgtgaagaaagaagatgattcagtaaacaaacaaaaggcatttattgccttgtgccagctggcatcagtatagaaaacatgcagtgtaatgtcacccatgatatattcctgggaagttgaggttcaggataattccacaaaatggtttctgtgtagaacatatcatggatgacagggggcagagaatgcacactgcctttgtcgttttcattgttgggctcttatctcaactgagcctcatttcctatcctgatgggcattcttgtgcctgatctctgtctgcagggcttctggggcccttgacttcacatcctccagaggttgttcagttgatcatggcagctagtcatcatagaaggtgatgctactttgcctgtgggtgaaggtggactctgacagcatctttgaagaataggtgattttagtctctaagcaggagaggtgtacacgtggttaacatgggtgcta

SEQ ID NO: 117729 - DNA, 1425 bp, Homo sapiens
ggtttgaaataaattgacatatttcaaatacagattcctttgcaaaaatgtcatgggtgataataaattgcctgactttgagcttttgggtttaaagaaaattcttttcacatagaccattttaattgtttaagatcaaaattcatttgacctgggtgaatggaagaagaagcccaatcatagagctgggttagtgaaggtttttggagcctttcctgctatagcattctatgataaaccttcctttcacaattatcattgatattacatctgcaagactttcgtacttgtaagtagttttaagaatatttgtttttatttttttacccacatctgcaaaaatgtgtgtggatatctgcgaattatttatggatatacaagtttctgaatgcaagcactgaatgtgactctacacacattcaactgagtggttctttttctaatcaagtaagagcagtcagtacaagactcaaaatcacagggggagccaaacttaaaaaaaatctttgacaagaaatgagctaaataatggctttctctttgaaataaataggggctattttgtcttgatctggggccatttgcctccatttccccccaactgaacacatgtacttgtgtctgtacacacactctcttacataggcttaagtgaaaagtgtaaatgctagaggaacttaagtgggagaaggaaaggaggacagaacagttcaacagactcctcagactgcaatagcgtaaaatatagaaattatgtggtacagtgaaaatagaataaaggatttaaaatgcagaattgatttgacccactaagcctctctattagaaaaacatttcccagtaagcctctctgtagacatttttcagttccttctttggataattttttctcatgttacattgtttccccttattctctgtagacactgttcattaaaaagggtaatgatggcttatgtaataatgtcatcctgtggatgcacatccagtgtacttcatactccacgggacatacactttgagtgattctcctcccagcattggtaatgtattttcactgaactcacatcttttgagtacccattataaccattgacagatactttccatttcagagagaaaaaaatattgggatttagagtgtgaagagcaaaattggtccactcaaacaccaaacccatgattggctttttaactgtcattttgtttgtttgtttttgttttgagacggagtctcactctgtcacccaggctggcgtgcagtagcgcgatctcggctcactgcaacctccgcctcccgggttcaagctattcttctgcctcagcctcccgagtagctgggactgcaggtgcctgccagcacgcccagctaatttttgtatttttagtagagacagggattcaccatattggccaggctggtct

SEQ ID NO: 117730 - DNA, 1041 bp, Homo sapiens
ttataggcgtgagccaccgcgcccagcctcaactgtcatgttttaaaccaaacaagctaaccagccagcacttgttttttctatgtatagatattaatataattgtggatgcaggaaactgcaaagttaccagcagatgccctttactttcagtgagagaaaattcagttcatactgggttaaactggtttttgttttttcctgtttcctaaaaatttgcatctaggtgagttttcatcttccttttaaaaagcttagaatgctgttttaccagtggtttttagttgctggcacttgccaggaggtgtttggggagtctacaattttgtacggtgtttggtgggtgagacaaggtctttactttgtcactgtaagcgtgtgtctttccttcttataaaaagagctggaaaagcagtaagagttgatttttggtaggtactttccatttgggttggctaagtaaaaatggcagtagaattttactgtctgggatttgacagtttttgtagtttgcctaggtagagaaatttgagttgttagctagtcttgattgtaatgaaaatgtgaaaagaaatgtatgttattacttgagactttgaagagctcttattattacaatttttgaaagaatctttctaaagaaggagaaagtatgtgaccctggagaggaaactagggacattatagagttaattttgggtagagaatgaagggattccaaaatcctgaaacttgttgatacatattttttgaagtataaccctcaagatgtcatttcttagctttaatttctgttaagatgggaagtagataatggcttggggcttttattaaaattatattgatagccatgccacatacttcttaacaaaaccagcagttctgctgagatttccaacagtgaagccattaatgaacctcttgtatatgaacgtaacaaattaaaccttataataagatactcttttgtagtgtgtgagggagtaaaattaacattgtcactacactgtgatggtgcatttctttcttttcctttttttt

SEQ ID NO: 117731 - DNA, 1098 bp, Homo sapiens
aatacatctctctaagtcactgctttggtcatcatatcctagccgtcttcagaaatctggagtgactgctcttgtcaaccatgttaaatctaagctcccttcctagccccagaggcttcttgttatttggtcctactttggccaagcccagagtaacttcactattaatgggcatcatgtctcagattactggctctggccttctctgtacccagccatattgaaatcctgctgttccttttgtaccaagctcaaagctcatttatccactgcattcgttaaaaaaaaaaatttttttaaatagagatggggtcttgctatgctgcccagggtggtctccaactcctggcctcaagcagtcctcccacctcggcctcccaaagtactggcattacagatgtgagcctaccactgcattcttaagtgccttcctattttctaaatatcagtaatattagtggcactgtccatttgtatttaaccatcaaagcatgaagcatggtactgttaatgcataaaggttaaatgatttatacaaggtcccatagctagtaagtagaggtgctatactttgaacccagcctggctccagaatttgagcccttaaccactgtgcaacactgtaaggactagttgaaattaatagtatattagattgacagtaccataacttacaattgtaattccctttcagacattttattttgaaaattacgcatgtagggaagctgaaagaattatacagtgaaccacccacatatgaatccacttcttagattctattaaatgtttaaatatttcctttgagacatatttagccatccctgtatccatcttactgttttgatgcatttcaaattcagttgcagacacttgtacattcacctctaaacactgtcccatatgtgtcattaattagagttaaaaaaaattttttttttttttttgagacaggttcttgctctgttgcccaggctgaaatgcagtgatgttaacactgctcactatagccttgaactcgtgggctccagcagtcctcccacctcagcctcctgagtagctagcagcacgggtatgcaccaccatacctggttaatt

SEQ ID NO: 117732 - DNA, 1071 bp, Homo sapiens
tcattcctgatgtagtggaagatgtgttttttgtttttgtttttgtttttgtttttgtttttggagagggagtcttgctctgttgcccaggctggagtgcagtggcgcgatctcggctcactacaacctccgccttccaggttcaagcagttctctgcctcagcctcccgagaagctgggattacaggtgctcgccaccacacccggctaatttttgtatttttagtagagacggggtttcaccatcttggccaggctggtcttgaactcctgacctcgtgatccacccgcctctgcctcccaaagtgctgggattacaggcgtgagccaccgctcccggccggaagatgtttttaattttaaattgtactcctcgtgtagaagatgtgtaatataatgtagtaggtgtttactgggtgtcccttgtgtgttggagccctgttgtctggtcccagggatgtgataaagaggaaacaccagctgctgaaagtgcttggttcattcttgcagaacttctaggctccacccacccttgggtcacggcaaagtttaggtcatcacagagtgcgcagcatgcttgtgtaggctccttacccttagcctttatcaagggtcctgatgaagaacaactctgcctgttctctagaacctccttagagggacagtccaacgttgttcctacagctggctccattttataaataattcacaggttttttcacttaagtgtctctttttccagcgaaaccaatgtgctgctttatccgatgaaagctgttggttttattctttgttttggccaccaggaagatcagggccaaattggtgtatagtgtatactagaaataatgatttcattgctgtactaggcctttctaacccctttttgtaatttatcaaaacccattagatctggtaaaatatgtggactcacatacaatattgtattataattttaagacgttcttgcatcctgaaacgtattctggacccttggggttaagagtcctgcttttgatctttttatatctttatttcactattctgtacatagttttattctaagtttcc

SEQ ID NO: 117733 - DNA, 1033 bp, Homo sapiens
aagagtattcccaaaacaagtattgaggataaaggtcaaattcatgctaaggagaaatgtttttgcagtagctatgactttcacctctttttccccttccctctttgtaaaagacaatttgtagtacattttgtctctctaagggagacatgactaccccaaatttttaaacagaccaggaagaatctattgtatatttgagtgggaacctgagaatgctgtggcatatagacaaaattaattaaaataactgataaatcagatgtagctttaaatgggattttcaaaattaaaatgtaggagaattatgttaataagctctgcttttaactctatcaagtataggaatgtgttcctttgtgcaatttaaaaccaccatcacctatgccctctagtgcttatgggatgagtttgacaatagaattgtgttctctgtttcctgcttctgccctggttactgctgatattcctggtgtgagagttctcttagtctctctgatcccagcttccctggcattgggaaaagggtggctttgcctattcctccatgtggtcctgctatggggctgtggtgctggagaaacaataagtgcatctgggcaaacacggcagactactggcagtcagctcctggaagccagggcagtttatgccctagcactgcccaggtgtagaatcctgtcctgaggatgtttatctgtagcaagccaaggacattatagttgacccttgagcaacatgggtatgaattgttaaggtctacttatatgtggatttcctcccacctgtgatacttatatgtggatttcctcccacctgtgataaccctgagacagtaagactgactccttttctttctcttccttctcggcctactcaatgtgaagacaacaagaaggatgaaggcctttatggtgatccagttccacttaatgataaatgtattttctcttatgattttctttctttctttttttttttttctttttttttaagatggagtctcactctgtcacccagactggagtgcagt

SEQ ID NO: 117734 - DNA, 1012 bp, Homo sapiens
aactagttcttggtttctagatgggtatggtatcatagtcttctttagctttcctttttccagagagattaattatttttctggttcttaatggtcattttcctctaatcttaaaaatagaaaaaaaatggagtgggtagtggtggtgaagaggataaaaccccatcaaaaaacaaaagctctgacactgtgtaaccaagatccgcagcgttgctgtgatgctgttccgttctagccagttggtaaagaaagcacagatgactaacagtctaatcttcaaacctgtgctgattctgaaacacaaatggacaaaaatgaaagaaaatcttgccttctacaggcaattaaaaagggaggtttttgcttttaaatgagaaaggaaaatacctttttggtactactgtcattcacttttcttaaaggacattacccagaaaaatggaaggcaaaaaattttgatttttttcaactggaaagtatgcctcgctagccttggctatgctgttcctctgaattagtaaatggctggcttttccaatttgcttttgtccgtacactaaggattttgccagttatggtcctttaaggattaaggtggagattcccagccaaagaaggggatttcttacccatcccacagtttaaatcttaattttgtttgtggtttgaaatgatggaaaatactcctctgctgtccttcagggctgatggaatcttgtgtgctcaggacacagttgtgttgtgaccaagctgtctgtcacctgacaaatggcaatggtcatcctgataaatgggttggtaaattttagctcgtggtgctcttatttgtaataggggcttctaattcagcctgtctgtggggaagtagggcgctgtgctctatgctgttaaatcagcttctgtctctgcccagacaagcccagggtctggtttaacaagagacaaaatactcaccactcgagatcaactgaattgaactgggctgagactttgacaaactaatctgcccacc

SEQ ID NO: 117735 - DNA, 4196 bp, Homo sapiens
tagaaaaaaatagtatatggagaccttagtgtaaaggtttacacacgattgtatataattacatacatttcttattttgaagtaagcattttagactttccaacaggagtgcaaattaatgtgagcattgattcatttaacacttaaaatatggtttcatttaaaaaattaaaaatacttcaacacttcaaaaactaagtctccacttagtttggaaaattaggcttaatgtcaccattggtaaaaattagatatgtatttagcctctactatgtaaaataggttacttatctgatgtgatttttgatgatgggtagatattatacttcacattctttgtatggcagctgctgacacttgcactgtccataaccattaatgatgatgaagggtccttcatgggtgggttcatattcattatacggtccttggtctgacatgtttgacatatggagtcgtgtttgggatcggagctgcctgtggttctgaaccattgagcactgcctaattcttcttaaagtgggagggcagcacttcctggagatgaacactataaaaataataaaaaagaaagaaaacaataaagccattgttcccgtaattacccgctgagtgaagatggcattgtctggttcaggaaagtgttcctcggtagtaactgctatgcctgcagtagttgggatttctttgtctcccacatggtaacttgatgagcttattctttttgtatattcagtggttggatctctataagttgtagccatgacagtgacagtggttgacaaattccagcagagctgaaatccatggactgcatctagaatatcctctccttgggtgtggtcaggactgtggcataggatggagtgttcccaccgaccttggaaactgcccagccaggaggccagagcacatattcgggcgctgcattcccacagattgccagagagaccaacggttgtgagggatctcagggagtttaagatcttggaatcaaggctgtttaacttgttgttatccatgaggagtattttaagattgggcatcgtttcaaacactgtcaagtcgatggctttgatttcatttccagtcaggtctagcttttctaaagtgccccaggtccactccatcccacatgtcaagttgctgattttgttccattgtaagaagagcgtgtgcagactgcttagccgtaggaaatgagcaaaattaatcttcgtcagctggttgtgctctaggtgaagctctctcagtttaattaatcctgcaaatccattgcgagccaaacttcgcaaacgatttgtgctcaaatccagaaactccagactacgacagtcccagaacaggcgtactgggatagtccgcagggagttggaacgtaaatgcaaggtctgcagcttccgaaggccatagaagagctctgggtgcagagatgacagctgattaaaagacaggtccaaattttgcaggttaatcagttgggtaaaagttgtgtttggcaagtaaaatattttgttggaacttaagattaattccttaagtttatatagtccttgaaaagcatcttcttttactgttgaaatttgattgtgatctaagtggagccaagtaagttgactgaagctggcaaattgatctctttcgagctctgtgatgtgattgtgcctcagggacaggcccagagagcccttgtctgtggcgtttggcactgagtggaagccctgagagtcgcagtagaagagcagcttctcgcagcggcatttgggtggacacgccatacccagggcaggcagcatttttaaaaccatactcattgcatatattgctgccagcataggggcccctaatggccacttgaaatgtaagcctgcagaatataatttaaggaaaacaagaagataggatatttttcagcagaacatatgggctatttaaaaaaaacaaccaccaccaacattatagcaaaagatttcactgcatataacttatttttcatttactgcagaaaaattaaccttattggtatgactggaccaaaacttaagccatttaaaaagaagataaaacatgtctctgtcatcatcgatatatgcttttacctaaacctcaaaatccaaaatatgatggtgatttccctcataaaatgtgaattcggtagcttattttaaaagcgtgattccttgttgaatgtacaagacatataaatgcacagacttacccattcttctgagcacattggaggctgcattcagtcgcggttgttagactcaacgcagtgagtctgtaaaaggctctaacatgtaggagcctttgaccagtttcctgttttctgtgtcccaggctttccaagtaaaattgaatccaccaggacgagttgttttttccttaggatatccctctggaaagcattggtttcattttctgtgattgctctgatccctaaatcagttttgaatataagttattaaatttctccacctctaactgctcagctggttaatcaaagcttcagtctcctttccgcagccgttagttctcttggtcttaacttgttgatggcagatgggtggcttgttgcagagaagagctcctggagcagcatgagtgcatttactgaaaagcttttccgagaaacggcacaagaatggatttgcttatgtgctgcgaccacacagaactgtatataggctgacgtcaccggatgacgtgtcttttgtttgggttttccagaagctttactgttataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttgggttagcagagtgatgatttttaatgcttgtgagagccagtgttagactgccgattctgcatagagagatcatctaaatgggcagaagcctgcacaatttatgaagtgctgatttaacaccagcctatgcaaggtagtgtcgctgcactggtagtttggaaagctattcagttgccttgttgtcatgcttggttaaaatcaaagtatgactatgatttgctttagatgtgttgataaactagctaagtgggcttggcttgtttgtcatcaagagcttaacattataaacgaagaataaagggggaggggaagcttgcaaaacaaagcatgtggttatttttttctttgagaatttcaggggaactctaaaaagatttctctttctcctattttataacaatgttttgtcgccatactgattgaaaaaataatgctgagttgatctttaaatgtcctcctgggaggacaaggcaggttgatacagtcattttaatgcacatgccctaacagcaaagcagagatgatttaggacaagtgataccgtgtagctggattctgacatggccccttgtattttacctcagaatctcacctactccataactaaaagcctccgctggtactgaggttggtggttgtgacactgaaataatagagcatttgcaccctagttcccagccaccaagtggctgacttaactgagcctactgctgttgttagaacctgtcttgtgaatacaaaaggtcactcatgctttggactgggatttttgttttgacttgattttgcttgccctaactccagtttctccctgttgaatggtgtcttcacttttcagacctcagttgtggatgtatagctccatgtttagtgttatataaatgcaaaagatgtttctagatgttatattttcaggcctgacaaaggtaagcccttttctacatcttgccttattgatttgacccaacatacctatttctcccatatcattggcacttaccctttgtgggtcttgtctcagacctaaggacagacatctttaaaactactgatggtgtctgtgaaacaagaacatcgttggcctttttggttctgagggattcatcccactgggcagatctaagaagtaattgtcttgggtaaaatttttctgttgtagtgttgtgctggagtgagagctgtgagactccaaggtcccttccttagggctctgtgtaaaggtgctatgaaaactgcagcagtgcaggtgtgtggtttgagtcctcctagaagtgatccca

SEQ ID NO: 117736 - DNA, 1310 bp, Homo sapiens
tgggcattaggttatggaaggtcttccatagaagtttggacagatgaacgtttatactattaagatgttttatttctcctattatagacatcaaaacaaaaataacagactctatcttgaagtttttgtgtttgttcgtttgtttttgagacaaggtctcactgtgttgcccaggttggagtgcagtggcgtaacctcccaggctccattgatctccctccttagcctcccagatagctgggactacaggtgcgtaccaccatgcctggctaattttttgtggagacggggtttcatcatgttgcgctaggctggtcttgaactcctgggctcaagctgtcctcccacctcagcctccctaatcgttgggattacaggcataagccaccatgcccagaccatcttgaagtattgattaaagcacaggctgaaatgtttatggcaacctccccgccgccccttttaaaactcttcttctgctagtggcttcattgtgttcatgttttccctttcccctctgtgtagcatgcttcatcttttattctgaaatacatagccaagtttggggttgtccttcctttctcctctctacatttctgagtagcttttgatgtagatgttatttcctcttacctacatagatggcccaaggggctatacaaagaaagctgtttgcacaggatagaattaagaggtaagatacccgttcatacttacttgaagaatcgttcaattttagtggactctctgacccagttgtctaaatttaaggggttagtttgcatgtttgttggctatatgctagcacttaaggttgatgaagcttggaaaccatcatctgagaaccctcttaataggttctgggctggaggggcagtgacaagtgatatggcaaggaaaaaaaaaaacacattgaatatgtgatgttgttaatgcaaagaaaattcataaaaatttggcccaaagagaacaagatcatttcttactctgtacggtttatagcagcatgtcagcattccgtctgcagttgagatgttgattcctccttgtattgcacattgctgaaaggggcttcctgaggctggagagagcagtgaggtaagactgtcctccttgagagctcgtcttgatgcttgttgcgtttgtctgtgtatgtctgcagtgtctgttctgctctttgtaatttaagaagagggcattctttgaaaagaatttgggaatacaggactatataatcattgtattctaagattgatctactgttgagctttgcttaaagcactcccagcaactcttgttacatgttcagc

SEQ ID NO: 117737 - DNA, 1031 bp, Homo sapiens
ctctgacctatcaggtacatcttagtttttaaatttgttgtttcacattgtttcagtgccaggtcccatttttcacatcttgacattcttcagatctcagagttcatcaaaatcaggtgtaccctgttcttgctgcagttcaaggagagctgcttcattaataaaattggtgtatgctgaaccttgagttaaaatataaatttaatttttaaaagccaaactttaagcaaagctctttgtctcttggcttctcttattttggcaaaactccctcaattccagtcatcagataatgtggagcccaagaattgtaaggttgggtttttatgaataaagccacataacacccctctgctccccagtattttccaactttgagtttaagaagttgtactgctttttcagtgttgacatgagcacaaatggctataggctatcattaggtttctttgtaaatgaataaaatgctcatctcttttccttttatccaggctggacgtaaagaaagaagtgatgcactcaattctgcaatagataaaatgaccaagaagaccagggacttgcgtagacaggtaatctggatgaaagtgctgattgtttttctaagttctcaattttgtagttttgattaaaatcctaataagcactggccttatatttttttattgagagaaaggatggattttcacaagaaagtgcctatctttgttttgttgctaatatgcttcttaatggctaatcaaatttcatgaagacatgggataatacagtctcactgtgttggactgaataagttagctctagtgtgaaaggcatgtacaggtaggaaaataaatttaaaatgacttggagacctgtgaaaataatcctgaaggatcttgttgtattgactatgtacaatagagacagaaatttcagttgtttatctgacttgccctatactcattacacacttgcagttcccttagatccatggtgaaatgtttccagttccaaatatggtaggtatagagatatttgaggtgctgaat

SEQ ID NO: 117738 - DNA, 1014 bp, Homo sapiens
acagctcagttctgacccctttctaacctctcttctctccacacccccacacgttaactatgcattaaatgacacatggcttttcattgcttgaggcataaccataggctttgtagtcccattctgcaaacagttaaattacatttacggtaatagagacactaggatgtataattgcatatgtccatgaaaaggaaataaatttttaaagtgttgtagaagcctcaaattcctgacttatggcagaattttattcttcagtgacaaggcttctcctcccctaccacttttgtattataatgaaacactttgaactagtcagtgacttgttttaagcaaaggtaaaatatttcattgtgagtgttaatttcttgactgcttcatttcttcttgttctaactggattaaatgtctacaggccaactttggttttaagggccatttgccattttccctggggtgtaagggaagtgagagtgctatatgaaagttgggcagggttgatggtgataagcctctggcaagagaggagaggttcagacattgcagccactgagaagtctgccagatgtgtttgggttgagtgctcctcctaaaatactgcaatacagttctgatgctaatcaccagaagttagtgcagaccccacaggtttagggcatggtccccaataagatttgccttcacttcacatgtcagctgcaagttctggggtccccaggccacctgtacttctgaccagccaggtacaaatctgaggggttcctatgacccacctcaggtttcagtaatccactagaacaactcatagaatattttattataaaggatactaatcaggaccagccaaatgaggagacacataggatggagtctgggaaggtctcaaatacagagattctatgcctcttccaatgaaatcaaggttcatcatcctcttgtcacattgatgtttcaccaaccagaagctccactgagtttcagtgttcagagtttttattggggtttcattat

SEQ ID NO: 117739 - DNA, 1062 bp, Homo sapiens
cctgcctacaactgcctttcgtcctgtgtctcccttgctgaatgacttctgccatagttgactagttttcatctttgaccatacctaaacatgtcaccacctgtgccctctacccacatgtcacttctgtagagaaactttcctggaacgcttatcccctccattgcatcctctagcagtcattttttcattcaccagttttacatcctttgtagtgcttcttactatctgaaactattgaatttattttcttatttgtctggcccccaccccatactccaaaagaatataagttatctgaggacatgggccaagaatagtacctagaatatagtaggtgctcagcaactactagatgagggaacctattggttctcaaagttaataaacattagagttgcccaggtgctcaacattcagattcctgggctaccacccagccccctccccaagattctgatttagtgggctgaagactatactttagaaatgcagagctctacattatgactgatcgtccttgttagtggactttgtcttattctgaagtatgtgtaacatttgcacaaaagagcgttgtaatgcatcttgcatatatacccagtgtgcacaaggggaatgaactgggaaaacttgtgggatgtggagatggtgggaaaaatttggagattttttttgaaaaggttaactgacattgatttgagcagttttttggggggggggatgggagtggctagaatgaagctttcaaaaacctgtagcaaacttcctgtatttgagggagaagaaaattgtaacaaaattcttaaaataagtatttatagatttcttagtatgtcctggtcacagttctggacattaggaatatagtagtgaatacaacaataatctctactcacataaagattatcttgtactaaatacgtattttatataatgtatatattttttacaatgtagtagaaattgtactgaggtgatacgtgcaagttgtccattttatcagagtttgaaatgaaagttgaacaaaagctgttatttcagtagcattttaatacatga

SEQ ID NO: 117740 - DNA, 1051 bp, Homo sapiens
acatcatctgatagacattttcccagtgttagtccagtcctgaaatctgccagtcattgacagctgcatagatatttgcaatggatccaatcaccacatccagaaggatcttggatggccaagttgtatgagacagatttgaatttggattctttcttcaagtttgtttgccatttaccctatcagcactttgtttttaatgtctttggttttccatttggtcttgaaatgcttgaaaagcgacaatgctttcacaaatctgtggaaacagatggtagcatacactgatcacacctaccaagagtatttatataaatgatcttaaaacccaggaaaaaaatcacacggagagtctagtagatcctaatgaaaatgatggtgtgcataacctgtgtggccaagccatgtcacatgggtttgagttagccatcagaaagcaatgtgtcttcctctcccttgcagtttcatttttcctactaaaacagatttcaagaggaataggctttaggcagacagtgcccagaccacacttggtactgggtatgtgtcctgaaaaaaaccatgttttttcaagtgtgattattcttcagattctcacctgggctcattgctactcttgctcacaaactgctatgcacacaggactgggcaggttcagtaatggcaaataaagtaggtgtttacagacatggtcacagcaaactgggcatcatgtgcttgattttcagtaaggcagctttgacttcaccccagccccgttattgccagatcccttcctcctcctccttctttcttgtttcttcttcttttttctttttttgagatggagtctgactctgtcacccaggctggagtgcagtagcatgatctctgctcactgcagcctctgcctcccaggttcaagtgattctcctgctgcagcctcccaaatagctggaattacaggcatgtgccaccatgcccagctaatttttgtatttctggtagagacggggtttcaccatgttgcccatgctggtcttgaactcctggcctcaagtgatgcctgctt

SEQ ID NO: 117741 - DNA, 1229 bp, Homo sapiens
gtttttatttgttttatcattgtctatagtttgcaaataaaatatgtattaattcaacttcaccatataaaacttactgttttacactcttccccttcatctttgtgatagttaggatagagcatgtggtgtgatgtctcctagtgaaatgcatgtaagacaaagccatgactctgaaaaagagtaaacagtgaagtttaatatcttttgcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcaggtaatgagctggttccccagagaagtatgtgaagatgttcataattacttttgtctaagttgtattaatgggcaaacactgctatgtcttggcaggtaaattattctaacaataatattgtgctggttttcattttaatgttaaaaaagctatcagctacagggttttcaagtgacagcttctcagctactaggaagtagctggggttggagatgtttcccttgatagggctggtctgaatcctaggagcatgaattagaaacctggctggcaaaggcttatccctgcttgtatagagtgaggtctttcaactgggaccggtagaacaccaggaccatccatccctcttgctgccattgtgtttagaaaaaacattgatctgtgtcttggtggagactgtggttatttgttatcagcctatgaaacttaggagaagaagggattctcaacaccatcacctttagtttcttttttaaaataatttcttcccttcttggaaagcctctcttctgtctctcagaaatgatcatagtcatagtttatctgcctacttttccaaagactttctgtctgcatgatgcacagatagaaaacagagaggaaatatttaagtgccatttaattatgaacttgaaaaaataaatctgggtaattcacctcacaaaaacagttgatttcattatataaacataaactggtaatgacttagtaaattgcattcatatagaaaatatctgtcaaatgcaattcagtgtttatcacacagagataaatttcaatcccatcttcttagagttgagtaactataaatgcattctccatttaacgggacctctgttgcccttggctgcatggcttg

SEQ ID NO: 117742 - DNA, 1047 bp, Homo sapiens
tttgaacctcactgcaagtccttgggctgggcttggactatgtcctggtacacagacgagagactcgcctcactgccctcctgtcacaggccagccggctgggctgagcgccaaccccagctgttctgcctgctgcccccttactgataactgccagaggacaacattatgtttcaagtcagtagctaatcatgagaggctggtagttggtacaaaataagaattttatttcataattaaagcaaagagctaggaccagtaatcagtcccttgggtatttactcagccctcacctgccatattctcccctcttttcttttgatgaaagtcaaaagaatactttaaaatacattgcctatttttactcctccaagcagccttggtaccctaacagaaggcccagttatttaattttctttttgtcataaagtaggaaagttatacaaatccgcttaatactatacaaaacacctctatttttaagtcagtaccttttctacccaggacagttctcatctttgtcttaaaatgccggtgttggggaagtaaattaggaagtaaaaaccttatgtcactgggcacaagtggctcacgcctgtaatctcagcactttgggaggccagggcaggcagatcacctgaggtcaggagttcaagaccagcctgaccaacatggtgaaaccccgtctctactaaaaatacaaaaattagccgggcatggtggcatgttgcctctaatcccagccacttgggaggctgaggcaggtgaatctcttgaacccgggaggcggaggttgcattgattccaagatcacgccactgcactccagcctgggtgacagagcgagactctgtctcaaaggaaaaaaaaaaacaatcatgtcttacaaagaaatagtgaattgactcagtgatagcaattgagccccacacacagtgaaaccagcccaggcctgctgtgggccaggcagcccagcgtgtgcaccagtgaagcagaggctcgagacaaatgctgagtgattttgactttattcaccatactgttcag

SEQ ID NO: 117743 - DNA, 2019 bp, Homo sapiens
atggcctgagtgccagcggtatctctcagccctctttcttcaggtgtacattctaaagccactttcagttcatcttgaatagttggaaatgtccatcagggcccaccagggaaagggctccacactttcatcaaccccttctctcatttcttgtcttatattaataagaattaagcaggttctgtccctgcacaggtgtgattccaaagcttccacattagccttccacccctcgctgtttccttccacactaaaacttgtgctcaaaagtgggtcggaaattcaggctgccataagtttctgcaaaaaatgagagaaatagcccttcaggcgaaatgaaacctattaaagcattatcctacctatgccacagattgcctgttggaaatattcttggctaatgcactctgagaacttcatattctttttatgtaagagctctttgtgcttctgatcacaggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccggtgagcagcaccccggccccaccaggctgcacaggggctactttcttccccacaggtcacctgcgcagcggctcagacagcccaggccatggggctttgtggacaatcttctttttctactccaactgtgaggggcttcacatacaataatccttgttctcttccctcttctcagaggtaaaggaccactcaaaaatacatcggatgtcatcagtgctgccaagaaaattgctgaggcaggatccaggatggacaagcttggccgcaccattgcagaccatgtaagtgacagacttgccaggtgggtctccaagctcctcctggggctcaggcagcccagcctggtccattcagggtaagtttcatgggccacagcacttttgccactcatctctaaaaatggttcttattaatcccagcatagatttgtaaggattctctagagcggatgtgtatgtcctggaatcttccatcgcttggtagccaaaattaacctctgctattgtctcttatgtctcagttccctctctccccctctgggcaggggccgagagcagccagaagccatgtggccagtgctgtggaaggctggtgtgcctagatgggcccaggtttcttcatcctcagcactgtgtttctcagccaccccgtcttcatccccctattccctcacactgataggtacaaaaatacggttcctaccgcctggaaattgtacaatacatttcatttggtgttttaagcctgatcaagagaagctctttctcagttacagtttttctctgtagttaacaagcctccccaccattttccctgaaatagccaaactctcagcctcatctaggccacaggatgtgtgagacacaagcctccttacacaagccaaagattgtaaaggcatccttgactcccacacaatcggtaatagggcctattgcttccattggccaaatgtatcttgacacaaaccagtcttgtcctttctgcagatctccatagccacttggactactgtggccgctcccgatttcctgttctttcctctctccacttccttctgcatccagctgtcaatactgtcatctgaaaatgcagatcacatggctctgccctgcttccatgactacttagaatacagctcatctccagtatggtctgcggggtctcagttcataccactctctgtggtgtactttgctccagcctcactggaagaaaatgtttgcttgctataaacacttgagaggtgctctgtgtttctccctttgggtaaagctttctaggctggtcctaatctgggagcctctaaaactctgagatgtggagcgagacaggaactgggcaggggccacccttttctctttgaccatccccaac

SEQ ID NO: 117744 - DNA, 1775 bp, Homo sapiens
tcctgcttctcctcccccacgtgcttacagctctgggatcacttacagtgacttccagttggtttgagtgaataaacacttgctgaggggtgggggtgagcaaggcgaggttgcctcatgtcttctccaaagggtctgagggcaggcgcttccaggctatttagataagagcagccgttgagggtgttcttcaggaacaggctgctgcccaatcctctgcgacctgcccaggccctggtcttgcagaggagtagggggctccccttcaagcacagcccacctgtgtccacgaggctggaggtcaggccggtgcttcttaccacccctgtctgcctcgtaggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgacatccaagagcccaaagtcgtcttctctgccttcaagtcatagatttgcccgcagtatctgtggtgctctgggccctcccggtgtccgtctcttccaggatggggatgcccgggagggaaactgtctgtggctctaggctgcacggctcgtgccaacccatcagggagggccatgcccgttgtcctattgagtgccccaccctg

SEQ ID NO: 117745 - DNA, 1589 bp, Homo sapiens
tccggtctggtgagtcaggtcaaagggccttgagcaaggtcaggcctcccagtgttgttcctgcttccgggaagctctgtatttttctcagcctccagtgagacctggtgaaccccgcgcctagctgaggagtcagcggatctgcccagttttcttctctgttacaatgtgagccaagtggccaggcctaggaaacccatgctaggggggcctgagactccctgtgaaatgcagctagctgaggaggccatgttgatccgcccccacggaaaaccgggagcctgggtgctgcacttgcctctctgaactagaactaattgttcttaaagatctttccaaataccaatgatgcaaaatatttggatggttcaccatattgttcaccatatttaaactgtcagaaccttaaatatctgagcaaaacctcagcaaacaaaggatattttggggacttgttatgtgtgttgcacagcagagagatttgtagtctatacgacttccaaatcctgtaaacgaagtatttcagtgttgtcattttcagctatagaccgtcctacgatcattgccttttcttttgctattaagagatggctcattcataaacattcctacagttgtgtggcaaacgcaaaataggccctgcgtgattccactggctctgattgaggagatgatttttcacacagtgagatttatcatgtttatcaagtttatgacagaacacaaggagggtgaggggatgtggaggttggagggagtgcagatctgagtgaggaaggaagctctttcctgagcctcaaagggcgggttgacaaggtgtgttgcctataagcttggagcaaggattgtgtgggccatttccttggatcccctcttgccctgcagggtctggcctcctccgctctcccccagccaccagacatggggatagttataccaccaactgagtatagaagacctaaaataacatcctctgtgttctctaataaagttgataaatctcagtgtgtgaaaaatctcccgtatgttttagcttaaattttcttctgcttaaccttgttactcctgccttgcctccctcagactgcctgagacaattactcagggacattctttgaataattagaggctgcagataattctctttagcccgctttcttccatgttccctaccctgtggtctccctttagccagttctaattagctgctttgatccttcctcccaatctctccctctagcttgttaattacatttctcccccatgaattccttctgtactggctttgtctatccagtcagaggagctgagaatgggaatctaaggccactcagtgggaggtcttctttgtcccccaacacagatagctcctctcccttctgagaagcctgaaaaccctggcattctgtcttagcagaaaagtaaaaataataatttttgttaaatggtatattatgataaaacagctgttatcctaatgcttggcatttgccaggaactctgggtatgtttatgtatataaaatcacatttcatccccgcaacaatcccatgagataaatattattgttattaatccctgttttacaa

SEQ ID NO: 117746 - DNA, 1340 bp, Homo sapiens
ttctctgggattaacaaaaattagtttgtggctcaagaaaaattgtgtgagctcagtttgtggggtggggtcatagtttctgaggttctctccaggtttggctggtgcttggttccagcctgtgctgaagaagggcagggaacaagtgggaaggaggagctttcttgtctctggggctcttaacagctgtagtaaattgtggcatgtgtggagcagcagcagagccagcctgaggagctctgagccagagggttcacccatgggaaagctgctttttagcccagcttgaggttcttacatctggacccagcatggctgcgttgaaccagaccttcaaatgtggctgtgagtaccaggcatggctagagcatttaagtactccacatgggagctgagctttgtctttctgcatttctagggacaggctcagtggacaagtaatggtggcagaaagaacttggtgaccagatgttggctagcaccactgctttcggcgggccccaggttgttggtgaagtcaacggaatcacttaagaatgtgcagagctcaggaactgaagcctcatgattctcctgctggatctggcttccaaaggtccccataacccttatccccagctggccttggaacaacgaggcctcctatgtctcagctctccccagggaccctacagagctcattctgggcttttggagggtgtcatctgtgtggcctgaaggagacctgagttttggacacgcttgagaagggaagctgctttgatatttagccagagagatgactgagcctgttggttggagcccagtgaggatgttagaagagtgtgccgtgggccctggaggtgaggaaaggccaaggacctctcttccttcaagccaggttgtggggagagccccactgtgagccctttgtgctaggcattgagcaaagtggcagcttttgtggtgctggggatgtgggaagttttctacttttgcagctattatgctgagtttccctccctctccaggatgtaggggtatattggaatagagagctatcctgtgaaaccattggtgtgaatggggagcaactctgggctgagcctcatccccgctcttgacccccgtcaaaggtgctgaggtttccaggttcaggggagttaatctttatggtctgtgctctgagaagaagattcaagttagttggtgagaaaaccctgcaaagagttggctgctgggggaactcctcactatgcttttagtgctgtgtagatttcctaagtggagctgtttgaagtagaaaaagtcctgtgcatggtctcaggggcaggtctacaaggatgggctgcttttagaag

SEQ ID NO: 117747 - DNA, 1037 bp, Homo sapiens
gccaccacttatctctagccatggccatggggtgggaggtgatgcaaatatgtacaggggcccctgactcagtgtgactctgacctagtcctgaactcaggagtctggacacatgggatacagtcttgggtcgacagtcagagaactgacttttaagccatcattttacttctgtgagactttaagtctctgtgaaaacaagagcactagatatgaggttctttctggcttgagaagtgtgccctgagttccttccttcctgaattgtatacccatgccaagtccctggcagcgtgctgggttaggcccatagaagcttcacgtgataggcaagtctcacccttacctttgaactacactggtttgtttctcttcatttttccattttgagctgccgtgagtcaggctgcaggcagctcatttacacaggagtcagcctgaaggaaggtggcttgaagtctactttcattttgtcatgggaggtgttttcctgtggaatcgctaatcaggcaggtcaaagggaaccataagggatctcactcatccctagatggaaacaagtacagcaaagccatctcagaaggagaccaaaaacacacaaaaacaactcccctgacagcatttcttaactctggcactctcaaaattgaacatacttaaaatatccccaagggatggaggtgaggtttcttggtcccacatcagagctggtgaaccagggcccatgccacacccttaggatgctatagagataagagctgagccctgcttctcttctccccatgtgcccactgccatgtcctgccattacctcggcccctctagctgctctggctgtagcttccactgctgccgttgtgccaggcacaaatgagtttaatttgcctattttgctggtgtcccctttgtgaagaatagcgcctgagaagcatctcatcccctgtgtctgatacagcctttgttcttatcagaggcatcgccctgctttccagcttagactcagctggaccctttgcccacaccctagcttgggccct

SEQ ID NO: 117748 - DNA, 1083 bp, Homo sapiens
tatgaactgtgacttaaatgagctgcagtttccccttttgcaaaggagagaaactgttgggggcttatcaagctagatgatgccttagagggcaaaaggtgtcctacataaaggagtgcggcccttgtttccagccttcttcccctccctccttccgtatctctctcctttccttcctgtcttccttcctctctttcttccctccctcctgtgctgctgccatctgccctcagatatgtgtagtgaccactgggggccccatttttctcttgccatggctaatcttgatggtgttcgtgaagtctgtacacagaggttcattcaaaccatatgactaagataatttctgtaatttttggtagagatggggtttcactgtgttggccaggctggtctagaactcctggcctcaagtgatctgcccgccttggcctcccaaagtgctgggattacaggtgtgagccaccatgcctggctgggatatataagattcttgttttccctgtggaacatggtctgacttctctgtagtattttggtaagtgtccagattactgtctatgagatgacttacttaaacttcatgttttcaactctgatttggtaatacagtcacatggctcaaaattcaaacggcaccagaggatatgaaaagtatcctccactgtgtccttccaccgtgtccctttgctaccctgcttccctgcctcaaggcaaccagtgttgtcagtttcttctagagatatttttccatgttaaagtaaatatttccatatattgtttttacatgaaaggcagtttactgtagattcatcattctgtaatttactttttctgtttaactatataagtattttgtttgcttatttggtagagatacggtctcgctctcacccaagctagagtgcaggggtgcaatcatagcttagtgcagcttcaacctcctgggctcaagcgatcctcctgcctcagcctcccaagtagctgggaccacaggtacgtaccaccatgcctggccaatttaaaaattttttgtagagatggggtttcactgggttggtcaggctggtagcactgtatctt

SEQ ID NO: 117749 - DNA, 2188 bp, Homo sapiens
tgttgagtgttgtcatataccaggcactgcttcaagtgctctgtatgcattaattcattgacttccgtggctgccctatgagtaggtaccactattaatcccattttataaccgaggaaaatgaggcacagagagattatgtaattgctcaagatcatccagcctagtgagtggtagagctggaatttgcagcaaggtctgtctgaccctaaactctgtgctctaaaacttttggccactctgtttctcaaaggcaactggtaccttttgaattaagctcaaaaggtggagctaacaaggagccaataaaagccattgatttattcaataaataaatcaagtgtctactaactcccaggcactgttccaggcacttgagatacgtctatgaacaaaattagggcttaaccttctagcagaagcagatagacaagcataagaaagaagtaattatatgtaatatgtttgtaggtaataaatactgtagaaaaatagaaactatggcgagataggaactggcagcattgagaaggggcatctctggctggaggaagagcaagtgtggaagcccggtggtgggaacatgcctagtgtgtttgaatcagctggagctgagagcaggcagagaagaagtacatacagctcagagagataatgggaggaagaatatagagggcctgtaggccatggaaaagagtgaacttgcatattattgaaggatattgagcagaagaatgatgtgatctgacttacttttaaaaggattcctccagctactgtgttgagaattagactgcaggtggggggcttggtagaagcagagaccagataggaggctattgcagtaatccagactaggggcaacagtggcccaggaggctgtgtaatcataatcaaaggcttgtttgagatccttgtcaagacacagatcctcaatgtcctcccatgcaccatgcacgacagtgcccttgttctctgtaaactgggctaaaagacatgctttcttcctttaggattttgccagcatctgtggtgaaagaggatgagtatgcactgtatccataggaattatggggcagcctcttcatcttctttctctgctcataactctttctcaggcctcaaatagcaggactctgatcctcttagagaaaaaaaatgaacctcggttctctttcccctttccagtcttactctccagggtaaaaaccaagaactccaacagcttttccattagagatatttaaaggattaaggatataaggggttatttgccaactcagtcctcctttgatgttgacagcttctattttttctcatcttaacatatttggatgaatctttaggtatcaggtcaccatgggctcttgcacatgaaacaccaaaatgactggagagcttatcatacctggaagggtgtgagtccacaggaggcttgggctagcattgccccaacaaagttctttgttttcccttgtaggctctttgtcacttggcagtgtcttccctaaggtgacatccccattctgctttcacaggccacctcaccagacccatcctgaggtcatcccaaaatcagtccctggcagaagccaaatttgtctgttggcagagaaatgttctggatcattggtgttttgactggaagggctggtgcatcaggctgccatgcagcaatgttaagctgtgatttcactgggggattaagtaagacacaactcggcccgagtcccagttgtgatgggggcttggggtgatgtagtactagttttaaggaagatggcactttcctagccaggaacttccccagtcctttctcattccagactcactgaatggtggtttgaggagctgtaggctccaaggacccaaaccaggtctgccaggcttcctcacagccatatttgaattattaaacaggatatgtgaaaagcaaaaccttgtgtgtggaaacagatggtgagttatttatgaggagcggcctccgtccgccccatctacctcgggcagtacatttgccttctcccacgtgtctcctcagctgtgtgccaccatttttccccttcgctgtttcccattctctcattgtcttatcagtgccctgcttctttcctttcctccagggtgttggcatagttccctcctgcactccctcctcctcttcctctctgcctgtcccaccccaccc

SEQ ID NO: 117750 - DNA, 1041 bp, Homo sapiens
taattaaagtcttttattcacctctaatgtaacttcatttttaaagtttttatatgtgagtggagtggggaaggattcagagaaaattgttcgagatttgagtatagtacatatagtaatttagccatttcaaacagttgaacaaattgtacacctgtggttagattgacagtaatgacagtgatttaattttcatcagcaaattgctcctgctgtgacagctcttacccatagttttctatgtccaagtttccctaaaatgttgttggattgggtagggcaaggccaagatagtctatgattgtgagaagtggagaagtagggtgtgggttattctaccttaggtctcagctgtttcatatgtggtttgaggttgaagatgaacttgcattacttccccttaactcagtggttgtgacaaaaagcctttctattcttcctgaatattggaaatcggacttgaataagcgaatcttggaacatcttgagtgtgtttttagagctgaggcctatataggcagactttgagggctgtcttctctgggcatcttagaaagtattagtatttttgatagcatagatgagagaagactgtgagtcttggagcagcagttttttgaggatgggcatccatggtagaccacagacatcttgggcagatgtctccaaccaatttaatcacctctttgctgctctccttaggcaaggcaggctgaggtaaagcggctcttccgccccattgaggaactgaagaaagactttgatgagctgaatgttgtcattgagactgacatgcagatcatggtacggctgatcaacaagttcaatagttccagctccagtttggaagagaagattgctgcgctctttgatcttgaatattatgtccatcaggtactgtatttcttcgtccataagtcagacttttaacagctccaaaaataaatcccccttccctaagccctaagaaaatagcatcaacatctttacttctctcccagagcacagactatttttaatctagtcttgttatcttttgta

SEQ ID NO: 117751 - DNA, 1073 bp, Homo sapiens
tagagtattttgcttatatccttattctgttttagaggacaaaatccatagctttccatgaaattgtccaagaagttagtgatcccacagagttaagaaccattggcctagagggagatggggacagcccattaatccaaaattcatggcagtctttctactatttttactggttgtgtggctggccacattgctacctagagctgcaatgcttgtgggctctaaagcctgggacagaagaccctgactctggcttgtctcagagagttcctttagcactgccttatttcattgcatgtagttggcccttagcaacaggtttccacttgctatttatgctttaggctttgccatctctagtggttttagtccatatccctgtcaacgtagtacatctctctttttgccctggaataaccagcttcttggactcttcctcctaggtttggaggactgagggtaaaaccacgttcaagttgtgccatcttgggttgaacatttaccaaggtccaatatggtatagtggttaaaaggttgggctaaggacagggccatttacttcctccatttatttatttcacaaaaacctattgagtgcccacgtgccaggcattgggatacagtaataaacaaaacagcctccacaaggctggcagacagaaaaccaggtacataagcacagaagtaagatattatctggtcattactgatagtttgctgaccctgttctaaaacatgaaagtattgggaattaatcatagattaattaactggccccaaagggaggaaggaaaggaaccaatgtggctgatcccaggaacctgtcaaagactggattggtatcctcactgagatccctggagctgatccaaaccacagccatgtagcttgactagagagaagacatccattggggagcaaggttttaccactagtccttatttcaattcagggaacagaggtaagaacaaggatgatatggacaaaaagaataattaactctttatgtaaagggttaggtttataggtttaggagttagggcatttcagacagatggaacaacaggaagtcc

SEQ ID NO: 117752 - DNA, 1116 bp, Homo sapiens
cctgaagtcccataactaccaaagctcttaatgccaaggcagacccaagagcaccatgcattcattccagttggcctgtcttcgttgaagcagggcagccaggctccacagcaacctcactgtgggcaccacctgagcaggccctgtcactgggagtccaggagggacaagtttctaagcactggacactgggatgagttggggcaaagacagagccaggtataatttgttaataggtaaaactatcatttcagcagttacaaactggccatatgttttgtttgccttttctgtatttaaggtggaatacttttagaaggggcatttttcacagccctcaccattcatgttttcttacagatgaacctcctcactctcttgcctcctgcctcctgtgggcatttgacatggctcctacctcctgatcactatttcttacctgtccttctgccagggttcctcttgtcctggtgcttcatggcctcaggcttcctaggctaattttccccttcctaacgttccaagaacttcattcctgggtctgtgtctaggccctgagccttagttctctttcctggcccctagaaatatttactgtcacattgaactgtgtctgatagactaattgctgttcaaggatttaaaaagagatggtggaggaatatatttctacaaccactttatcgagatataatttatatactatccaattcacctatttaaagtgtacaatgggaataattctcaaatgtcctagggaagattggtagaatggagaggtggtttctaggctatggtgttttatggaccagaaaaacttaaaaaaaaaaaaaaaattggaggactaaggccaactttttattttgctgagttaagggccttaacatggaaacaacacactatctactatcattatctcatcttttaaaaggacattttaacacaaaaaagcaactatataatttcagaaaaaactgttatttatattgggcacttttaatttcttgtttcgggaccattggaatgaatgccacaataaacacctcaaatcctggtggcttaaaaaaacagtaactatacaaaaaaaaagtatgtaagagaacagaacactgttct

SEQ ID NO: 117753 - DNA, 1087 bp, Homo sapiens
tacccagagatgtgaatgtgagattttgcatggaaaaatacatccatattgcacaagtggctcaggacccaaactaaatatctcatctctcagttcccctctggatgggtgccttcttgctctgtgctatagtttgtctggagtgtgatagagagaatgaggatgatgaggaagcacaatcatgtataccactcccccgcaacactataatctcctcctcctagggtgcactaaagcatatgatttggcctagcataatctgaagatttggatcaaagagctgactctgtaacaatgagatttgattagtaggattttgggtgtgttggggttatcaagtgtctttttgatacctctcaactcccatcactccagtgactgttttggtgcctctgtgtggaactgtgccctctactctgccctttcaggttgaggttttctcaaagaggaggcttttgggaaagttcttgctgtatggtgagatctctgtttctgagcttaagaggtaaggtagtagctgttgggaaaagctaagggggttaaacagtcagttcctgagagaattaaaaaggttgctagactggaatcacagtccgtaaaacaacagtttagggagatggagttttgttgtagattgggtcactgtaaagtgtctaaaaatgtaaaataacaagaaaatcttggcttgggtttggatagtagaaatgtaggggaaattgagatatatatcacggttttattctttttgtagtttggaagtgatttatttattttgtatccaaaaaaggaattgtattttgttcataaaggtattatgtattaagccacatgaaatcccagaaaaatttgggaaacaacttgtttttagattgaatgtgggggagggaatagttaaagaataagaattagccctggggcagggtcagaggtggtggggaagaattgctttttcttttttgagatggagtcttactgtgtcgccaaggttggagtgcagtggtatggtctcggctcactgcaacctccacatcctgggttcaagcaattctcctgcctcagcctcccaaatagctgggtttacaggtgt

SEQ ID NO: 117754 - DNA, 1043 bp, Homo sapiens
gactgactttccatggctggagctatatgactgatggggctgatctgatgggcttaatccatgatcagcttcctgactaggatctcactgattatgattgataagaacgtgattggaagtttcacgtgtgttcctactgatctctagaggaatccattcccacatagcaaccttggccctaacctggcattagataaattcagttcagcagttcatcaagacaccaagtaattgaagtgtggattgctgccttccaagaatgacaggaagaatgatagaagggctttggaccaaaggggctgagctgttcagcccttagggaatccattattataccagtctccaccaatttctcttttgagctttaataatgtctgctttgcgggggcttccaggccctatcttggaacatagattctggtctttgtatcaaatgacttgtagcacatggggagagactttcctattttgtttcaatcagctttcttggggtgggcagggaaggtgttgacagctagtcaggatttggttgttcctgaggtgctgtcagactcagcataccctcacactggctcagacacagagaagaggcagtgttgggcaatggaagagctgcttttgaagccatacaaacctggttagagactcagttctatcatcagcctgaaggctgctctaggcagggaccactgtgagttgcaggatacaaaatgcctggtaatttctgtttggtaaacatttgtcgaattgtactagttgtgtaaccaaagaattctcatctgtaaaatgggaatacctgccccatatgattgttgtgaaaattaaacaagatgatgtgtgtatagcagctattctgatgcccagtaccaagtggtaatttgtaatgctagatttcttttagaattctgccctcttcccccttatgctgttaaagattagaagtcttctcacttcctctgtacatatttactaggctgcaatgagaatggcttgggctggtctcagtgtgtttttgttttttttgttttttttttttaagacag

SEQ ID NO: 117755 - DNA, 1334 bp, Homo sapiens
gttacaatcccggccctttgggaggctgaggtgggcagatggattgaagccaggtatttgagaccagtctgggcaacagagagagatcctgtctctacaaaaaagaaaaaaaattagccaggtgtagtggtgcgtgcctgtagtcctagctactccagaagctgaggtgggagaatcgcttgggcccaagagtttgaggttgcagtgatcatactactgcactccagcctggccgacagagcgagaccctgtctaaaaaagaaagtgctttccctatagatttgagatgctgctcttactgtatattaaatttctgtgtgcagttgggtctgtttttgaatgttcttttctgcttcattggtaattctgtctattcatgcaccagtatcaaaccattttaattgtagaggttttgcaatatgttttattatccagtaggtcattctagttttatttctgtgcgctcctgtttgtgtgtatgtgtatctagatggcagttggagacatgagaactgatgagccccagaagagaatcaagagcatcctgagaagtttcaactcttaacagtcaggtagaagagggtgagctggcaaaggagaggctgtagtggcaggaactcatcaggtattcagtctcaaggaagtcagggcagaatacttactttaggactgaggaactggcctcctgtgtcatgtgctgccaagaaatctcaggaggggaggagtgagaagcatcagtggttgtcactgggtgagagtggagtggtgtggagtgggctttggagtgaatggcgggtaaggaggtctagacattccttgagaagttatcagtataagaaaaatgaaaggagatgagaaaagatgctacccagaagaggtctagggaagtttttctttattctttttcttacattgaggttaaatttatataatataaaattaatcattttaaagtgagaagctcagtggtatttagtacattcattatgttgtgcaatcaccgcttctatttaatccgaaaacattttcatcacctcaaaaggaaatcccatacccgctgagcagtttatccacatttccctatcctctaacatctgacaaccacaaagctcctttctgtctttatggatctactcattttggatatttcatgtaaatggagtcatacatacatgagtttttgtgtctgtcttctttcactgagcataataatttttgaagttcacccatgatgtagcatgtatcaatacttcatgcctttttatggctgaataatgtatcattgtatggagataccattgtatggacaaatttgtttattcatctgctgatgg

SEQ ID NO: 117756 - DNA, 1064 bp, Homo sapiens
ctgtggtgttctctgaacaaaggcctgttcctgctgggcacaaaaattgggctgggcttggggctatagatttcttttggagataaataagcagggtatcttgcatccccttccatttcgcctgtctcaaggaagaggccaagggtcccctctttttgcaagtaaaacagaatgtactttcttaaaacgatttaaatatcacagttgggttcaatttatctacagaaatagacttatataaaaggaaaacttacaaaggagaaatttctaccaaataatgggctccctttttgttaaaatttttttcctacctttttcaaggtcatccagtttaaagtctgagtgtccaagaaagaagggaggggaggcctagagggagaagggaaagtagaagaaacagaagtacttatagattctttagggtaaatctgaagtcttagtgatcatatgctttttatcagtaccagcgatgcagcctgccaggggtttcccctccttgacctttttcttcacctcctgctcccatactcccgttggatggtcaggcaaggagggctggcctcaagaacctcagctattctaagtccttagctctgcctgtctgctgtttcagccaaactagatggcctaagatctcacacagtccacttactcccatttccagccttggtgtgaaccctttcccccatctgcagggctgtattgcaaattacagctgtgaaacaaattgccaccaacttagtggcttcaaacaccgtctcatttattatttcatagttgatgtaggtcagaaatctaggtcctggttagccgagtcttctgttcagggtctcacagcctgaaaccagggtgttggccagcctgtgtccctttctggtggctctggaaaagaatctacttccaggctcatccaggttattgccaacatatctttgcagtcacttcctagaagtcagacttctgggtcagagggtaaatgcagttataattttattagatgttgtcaaattcccctttataggggctgtatatgcaaatttcatttccctagtctcgcctgcaaa

SEQ ID NO: 117757 - DNA, 1065 bp, Homo sapiens
tagcttcatttactactttcctggcagaaattgtttccgctgcaggtgagggctggtttatgatgataccctccccatttcatgtttaaacctgaaacatgatccaggactggcttcctgagaggaggaacacttatttctgattctagttcagcccatgacagatgtggagtatgtgtggatttgaagacagtgggggaaagcatgggactttttgatgtggagtaaagccagagaaggaaaattcatctactcacagtatgtattgagcttctctttgccatgcactgaaaatttatagggtaaagatagtgggaatgtggactggttcaacaaatcctgttcagtagagcctgacatcatgtgatcccaagggaattaaatttgggacaaatgaaagaaaatttacctcacacagtgtgttgtagatacagagttgaaaggatttaaaagtaccttagaaaaatgtaatgggtaagggattgaaagagttttgaagacctccattaaccatcacggagaagaaccaatctcttctatcctcagcgcaatggccagggtatggagattgtgtcaggttattaccttttcacacacacggactgggttagtgtgggaagagagatggagctaactgcgctctgaaggattgtggacggcacctgttcaataacacctgtctccctgtgttagaacttgatttatctctgtcttagtacattttatgctgctgtaacagaataattgagactgggtaatttctaaagagcatagatttatttcttacaattctagagactgggatatccaagtttgaggagctgcatctgttgtgggcctagttgctgtggcatacgtggccaaaggcatcatgtggtgacagagcaggtgctggagagagagcagaatggggctgaacttgccttttgtgggggggaacaaaagagacggagtgttgctatgttgcctgggctggactcctgggctcaagcaagtcctcgcgtttcagccttccatgtagttgggaagctaggactataggggcacaccactgcacccagctgg

SEQ ID NO: 117758 - DNA, 1051 bp, Homo sapiens
aacccagaatcaaatggaggagatacaaaacaggtctctactctcagggagcatggtgactgattgaataacagaattaacatgaaagaattcacacacaatttattgagcacttgctatgtggtaggtatttgttctaggctattttggggggaagagaaaaggtagatgtgcttttcttcttaaaggaagctacagcatttatacacagtttatatacagttagccacacaggtcaataactgataaatatctgattgtacagacattaagttcaacgttggtagtcattgaagtgttagggttgctttggtggagaagctcattcactatgagagtaattaggtaaatttcagagaaaagataggagattaattggggcttggaaaagctggtatttgatgaggtggagtataaagggttttccaggtgggaggagcagcttgcaaagaggtagtggcagtaatgactgtcttatgatggtgaccaggtgtacggcagcacagaacagaggatggagaattacagagaggtgagggagagttaaggttatattctgagagttagggaatccagagcagtactaggtacacagtggatgagaaaaaaaacttgctacatttgtatctgattaaagggaaggtaagaaagtcttgatttttctcagtgccagaacgccccaggctcagtccttggacctctgctcttctctgtctacacttaaggcgttggtgactcatctagtctgatggcttcatgtttcatctgtatgctgatgactgctaggttttttttttatctccaacctaggcttctctgaacttcagatccatctgcctactagacacctttacttggataggcatcttaaatttaacatgtctaaaactgagctcctgcagctttccccacttcagttaatggctattctatccctttaatttttcaggtcaaaatcctcacagtcattctcgacccctttctttctctaagaccccacattctgtctgacagccgatcccaacagctctgtcttcaaaaaatatatcca

SEQ ID NO: 117759 - DNA, 1039 bp, Homo sapiens
ggatctaggattcctgccatccagtaaattttggcaggcaggctgtgtgtacggagagcgagtcctgccgccctatccctgccctgctcccctcattgcgtgtgcttcttgggtggagtctgggttgcctagcctctcatttcttccgcttttcctctaagcagcccttccttcttctctaggattggccttcagtatctgtcaggaaaagaggacagtctctcacgttcctgggacttcacagagagacccttaggaagagttcaagtcctgaggtgtttgggtacttgccatgtgcctactgctgcattaaatacagtgaggtcatagcagagtgcctgggccttaagtcttaatccttaaccacagcctacctgggaatcaattcaaacaaaaagattggcagtcttactaacccactcaaggatctggatatacaggtgtccttgtgtctgtcattatgttgatatgtcagggtcgttgaggcctccaggctagtgctggtgatgctgtgatactgttgaaagtgagttactggtaacgttgggttttcctttgccctctgctaggggagaggagaggaaaaggggcattaggttctagaaaatccttgtctgtgaagactttggttaaactttgtcttccttttacccatctctggacaagacaaaaggaccctgaataacagagtagggagcagagtgggactttggggaatcagaggcagtgagagaccagcaggaacagagagaggacttctggcctaccagcctgttagaacaagagaaaggagtcccttcttcagcctggctagccagggacacccatgctcgacccattgttggcgtggtctaggaggagccaggaggcccctgcccagtctgttacctacaattattgttgctacctctgagccacgtgctgccgtctttaaaggctcacagctacagcagagtgaaaggtcctgagctgcttggctcctgcagcatggaggctgacacacagggagagacttaggacaaatctggaccagaccagg

SEQ ID NO: 117760 - DNA, 2174 bp, Homo sapiens
gggaatggccaagagctgagcccagattgtattttggcatttgattgttgctgccgtgccttgaatatagcatgtagtatagtgttttagagtcagtctacctgggttcacacctctgctctgtcttttatagctagtagctgggcaagttacttaattacagtaaagattaatgaactatccctctctgtaaaataggggtagtaataatgcctacttcagagggttattttaaatagtaaataaggtaaacatgaaatgtttactgtgatgccaggtgcatagtaatagctcagtaaatgttagctgttgttttttctgttgtattaaaaatcagtggacatcagatgaacccaaattgaggtacagtctgcagaataactaccagcacttttcaagtatgtccaggtgatgaaagacaaagactgaggaactgtcacagattggaggagacaaaggagacctgacgaccaaatacagtgtgatatcctggattagactgtgcaagagagaaaaacattagtggaaaaactggtgaaatccaagtagagtctatagtttagttactactgttgtataatttcttagttttgataattgtcctatagttttgtaagacgttaatagcaggaaaatctggatgaagagtatatgggaaactctgtatttttttttcttttttttgcaacttttctgtaagtctaaaattgtttcaaaataaaaagctaaaatagaataatgtctaagtgatctttttaagtaaaggagaaactcaccagggtatagctgtgcccccagcataacaggtaacacctgagtcagtcttgcctcccatgtcagaaggagggctcttactcagggatcccaacacctgcctcttaagcacctgcacacctgctgcatcctcaggcaaggtctgttctaggcagataattggtcagatagcaatgcagacacacaccccagatcagatcctgcagcggggccatacagcaactggggaggaggccactcatgtggcattaggactctctgcagggctgagtgatcagggcacttgtctctgttctttggaatataaatgaaattctgcctgttttatcctacctaagcaccaatcactatggcagtatgtttgtggattgtgatgcctacccctacgctcattgtttgatcatccagagaaagaaaaataatttcaagcctttgcagtaatttattattttctttcctgccaagtggcttgcttttgcacaaagcaggtattttgcttgcttttcttaagtgtaaaaggtacatgtgcttttcttatgactgatgtggccatccctgtcatgctaatagcagggtttgtagaagaaagccattatcatcattggaagaatgtgagtcttggagtttttatttttgctttgaagtcaggtatcgggggttctggaaagtatagagtctttcattctagcacacaactcccttacaagcatttaccctcagaagcccatattttctaagttaaaaaaaatcaatgctaaaaaacattctttgtattttaactcaatggctaagctatgctgctttttgctgttgatttacacatcttattgtcagacccttgggatgtatgtggattactcaatgctgtgacaaatggctaggctccgaattgtgtattatattacaggatagttcataaaccatatttttctgtaggttattttaggcataagactagtgaactgccatttctcttttagtcacacgtgactttaaaaaggtggaggatgccagtgggaaggagaagtggctggctcaagattgaatagccagtggccccaaaaccttgtgaatgcagaggcttgaagtggacagaccttgagtatggattgggaggattgagagagcagagagaatctgctggaaatcaagccttttgctatacctttgctcaggctagagcactagcagaaaaataactggcttctcctctcctggggcttctgagtcctgagaatcctgcaccatgagtgggccttccccactcctgcgtccccctcccctacacagccacttatgctgatggatgtgcaaatcctttacagacagtttggcacggcttcgcttgcagagatcatctgtctcttttgactgagcaactttatgtttgcggctccttt

SEQ ID NO: 117761 - DNA, 1945 bp, Homo sapiens
ccaagagtataatctcttctgtcccatcctttatacatagacatgcacacacatgtgaggcccaagaaattgggtgggagcaaggttgttggttcaggacacttcatgcctaagcccctgcggctcatcaaagtgtgacagtgggacttcttagctgctgttaaggaagtaatgacttaagggagggggatagccaggggtctttgttggatgatgtttcaccctggctcaagcacagtgctggaaatgtggggcaggggctaaatagaagaaacagcctgattctgttggggtggtctgtcttcttggacataagttgctatctctggcaacttttcaggatgaagtattcaacagagcttacttttggtgctacttctttctgcacagtgccacccttcttactttgagggctttctagtcttctggggatttccttagaacttcatttgttcctcttctacctatacttctggtccctccctctataacttccaccttcccagcctttgctaagcattctcgactctgagcatctcctttgctccttggtaatacaagcttgttagggagaaccacttgggggatggaaggatgccaggtctcttgaggcctataggagcagtttctgaggcttcaaattatcctgtactgggagagaaaaaaagatggtgggctggaatacaggaaggccccaggaggctccatgaggatcatttagatctcttcattgcagagagacctcatttctcatgtagggaggtctcttcactagcctctcaggatggctgatcactgcccctcagcagctaaatcccacagccccctgggagagcaggtggaggccaggccaggaaggactgcaacctccatggcagccactgccaagactgaggccactttgcagccggctggctgagttctgctctgacaccaaagcatgtctgccctggctttggccttcattacccggatgggacaggccagggtccagtttgcaatctgtgcatttgggtggtgatggagagcagctgttggccatcctctttctaacaagcatttgtatgcttaacatgcaccctgaagcccttatcctccccttcctctgcttctatccacctgttctctctgaggtttaatcaggagtgctgagcagagtggcatagcctcaactctcaaaggttgggacacccaaatgtctgagatggaaaacttagaccaagtagggatgatggaaaactagctgccaaaatagtcccagccctcatgccacagactttgttttagttcagagaacctttgtagctctgactttgcttccttttctaatattggcctcaccccactggccaagacagcccagggcatctccacggttaagactaaccagggctaggagtagttctcaagggctggcctagagcttgaatgagaggccctttcccagaacctgttgcattcttagttttgtcagagccttggaggtaggaattgatctataacttagagacagtacttcactagatagagaagagaacaaagtatgagtagtggtgttggtggggataatatgaacagagacctgaagtgagagtatatctgcttgtctggagtggcaggtgtgtgtaagggaaaaatgaggtggtgggggtgggcagcatccactctgtcagaggtgggggccagtgagggagagggaggagatcaggaggagaactgacaagccagtagatttaaaggtgtgaaacttttttttttaaatttatttatttatttattttttattttattttttattgatcattcttgggtgtttctcgcagagggggatttggcagggtcataggacaatagtggagggaaggtcagcagataaacaagtgaacaaaggtttctggttttcctaggcagaggaccctgcggccttccgcagtgtttgtgtccc

SEQ ID NO: 117762 - DNA, 1090 bp, Homo sapiens
gccttggcaacatagtctttttaaaaatatatatctatgtatatacacctttgctacctccctttccttggggacctgaaggggaagtggaggtaaggaggcagccctggcagagggccccttgttctgctcattacccagtgctgcatgttggccccatgtgggctcagggaagcgtagccagccaggagcagacctggggctccttattgacctgatctgactccaggcggctgtgagagtctctgaaatattggcattagcacaaagagcccactcaatgtgagcacgcaggaagcctgtgcaggaacacgttcatgtgagggggaaaaaaaagaaaaagaaaaaaattccaaatcatcaacaactgatgagagcaatccaagaattatagagcaccagccatctggtcagatcatttcagatctgcacgagcaataagagggaattgaattttaaaaacctcatttatagtagaccaactactctggtttcaagtatttaagagaggagtctgatttcctgcaggccctggacatctgtctgaaggagcacctgactctggtctgggtgactctgtgacactgtttctgttgggcctctggctctttgcagctttggaggggcggcgtggttctccactcctctgacaccaagtgggtgtgcaacaattcaattcaaatctgccaatgtctatgtggaattagtctcagatccctcaagttaaagggctaagtccataagactgcttccatttcatatggcagttgcaagtcctgggccacctgtatttctgactgaccaggtataagttggggattctcacaatctccttctcaggtttgacattaataatttgctagaatggctctcaggaaaacactttatgtttattggtttgttatgaaaatgcaactcagtgacagccaaacggaagagtttagatgcggcaagatattggagtgggggtagggagtggtgtgcagagccttctagcacttcagtgtgtccgccaaccctcatgctcaagtggagttcaggaagctctctgaatcctgttgtttcagggcttttatggaggttttattat

SEQ ID NO: 117763 - DNA, 1044 bp, Homo sapiens
tgctgcctggaacaccaggggacaaactcatgacttcgtgggccttccctgcagtccaggtaggaattgggccccagtcactcagtcctggaacagctgcaggtgaatctcctgaagtctatctgcccctgttattactgtcagcatcctcactgggagctgcttgttcctagaagtgattttcctgtctctttcttctggtttattttgggatctgcctcaccttacggaggcacagcaagcatttgagggtggatacagcattagctgttcacaagcaagcagaggaaagctgtttgctggcaggtcctgggggttctgggcagggaactcaggaatttgtcctgaggctgaggacctgaggctgaacactaggactttggacctgtgcagttggtattacagaatgctggtcacagccacttcaatgggctcctgcaccctgggcatcatctatagccagagatataggtaacagctcacatttactgagcactgactctgccaggcatcctttgagggcaggtgctataactatcctcatttttacagatacaactgagtctcagaaggaaggactcagccaaacaaccaaaaagtggtagagttgggactcaaacctagatttgtctggctctaagccccagctcctaaccactgtgccatactatcttcttgtgtagcaaaaaggacgtgacccctgccctctatccagctcataatcttacaaaggatacagagaacaaagacaaaaacagccaccaaagtgttttggatgtcttggtggaagtattttgtgctcagtgagggcataaagatggtatggcaaggccagggccttttctctttaaccctgagatctgtgtggggcagttcatcaaattttatgatgctgaatctccaactccatctgcagctctctctttgagctgtgtggccttgctcaggttgcttagaatctcagaaccttagtttcctcatctgatgatagggatgaaaatataatacctacttcgcagagatgatgtaagaatgaaacaaggt

SEQ ID NO: 117764 - DNA, 1069 bp, Homo sapiens
tatgtcatccagctaacttgccctatgccattgaccccagagcctgggcctactctcttcccacttcttcccagtcctagctgtccttggctggagcctactactctgacacttgggactgttctcaggagtggcaaggtggatggcaagccccagcagctgccacagtgtagtttcaccagcttcttgctgatattcatcaccatgtcctcactgcccccactgctgctgtgctggcagggcagcatttgctgtgccagccagctttctggtagcaatattgctcctgctgtgtttgcacatgggtagttgctgccacagaagagtgatgaagcaccgaggaagccaggtgggagctaatggcattgagcagagggaacttttaggaatagaggtactgggttcagcagatccaacctctgcctgccaccacccaccccttgccaacctggcttcacttgagaacttagtcccactggtccttaaggactaaaaccagaggctgtcaggggtagggcgtggaagatacggactatatccgctgattttatgtatatagtgttgcttgtatcactttcacttttttgagacagggtcttgctctgtcacccaggctggagtgccatgttgcgatcttggctcactgcaacctctgcctcctgggctcaagtaatcctcccatctcagcctccagagtagctgggactataggtgcaagccaccacacccagctaatttttgtattttttgtagagactaggttttgccctgttgcccaggctaatctcgaactcctgggctcgagcaatccacctgcctcagcctgccaaagtcctaggattacagacgtgagccaccgcacctggctttcttgtaccacttttaaccaggcaagttcctggagcagatggaagtcagtgtcctgtggcctcgactcctactctatctgtttctgtggttgagtcagtagctcccttcatccagtagcatcctggttcatgttgcagactgaacgatgttgatggttctgaccctggccccttgcccaaccctctgggcagtggggctg

SEQ ID NO: 117765 - DNA, 1075 bp, Homo sapiens
ctgttttcaagttgaatgcctgcgtgacagtggtagaccagcggagtagcagctgcttcccttagtcaaggcaagagggctccagtttctgcagtcccaccactccctattgtttacacctggtccactgatttccctgcatccctgcctggcccctggggcatttcattgacacacctccaaggtaaattttattaactttctcctggtcctgcagtctaatgcttctgaccagggctgatcctagtgtatgtaggctctgggtacttagcagacagggtggtctttgttctggaatgtgaggcaagtacctggagcagactcaggtgctttgggctttcctcagtctaaggcacccagaagacacacctgcctatgggaaggggcattcattcatctgttttttcagcagcttcaaactaagccctgtgctaggcatgggggtgatgaaggagactgacatggtgcctgccctctggaaactcagctgttggaagttcttgatgtccatgtcctcagaatggaggatgcctcctgccagtcagtcttctctgtagtctcataagcacacctattcttctattcctagttttcttttgagctcagatttgtgcaaactttaagttgaagggataggaggggtttgaggcaccaggctgcgcaggtgacctgcttgaatgatgccatattgtatagtcactcctggatgtcacaacacagcctggaatctatgactgccttcataagtaatagtagcagccaccatgtacccaaagccagtggtttacaatgtagtacctcatctaactatgagctagatgttgttattattttcatgttgaaaatgtggaaactgaagcttaggaggttaaataactttcccgagacacaagaaactgggatttgagttattccagcatcttaagcactatgctggagtcagtgcctctcataactatgcatattacatctcccaggtgtggttagatttgagagcttcttcttgccaagatattttccttattggtccttagtaaggcctgaaattctgccatctaaatttcatgcctttatt

SEQ ID NO: 117766 - DNA, 1048 bp, Homo sapiens
ttctgccattgccactggcaggaggagaatgcccagaaaggccctgagcttggcctggctgcagcacactacggttcctggccctgtttacttggcttgtcccagcaacagcctgcccttgaccagctcctaatgccctccctctcctctcccttgataagctcccactgtcagttatttgacagtttcaccctcccctggccaccttccccaacccccagggctcccactaaatgttggataaagcgctggaagctctggagcgggaggtccttgaagtgcaaatgacaattgtgatgaatttaataacaatccagcttagctgtggttcacctctggctcatggcaagcttccaccttctctctgaaatcatttgtttcctctctgcctttccccccacttcgtggagcaggggaaaacatacagttaggagtcacgagtccttttgagtttttaatgccctctgagatcctgttggtgctgtttatttgcctcttcttcaaggacagtaagaatgggatcccaggggcccctgagaatgggactggctacagcgtgaggttggggctgtctctggcatgggttggcggtggaatggcccagaaaagaaccttcagggcccagggctgtgtcccctccccaacttgtacctcatgaggatgccatgctccccatcgtgagctttagcagatgcacaattaacaaaggcatgctgatgaatttacttaaggaccgagttaggaagtcccttttggataatagtccaaccaaatagatgagctttcagagcataattattctggcccatttatattagctctattgagtctagtctcagaaaaatgttaatactgactttcatcaacagaagctgcttttatccttatgtctgttcctaagctgtatccatttgtcataatctttcatcatgtgctaagcacaagtaggagttgaagcatcttttctctcataccataaaaattgctgccctgatgtcatttaaaatctaaattatgcagccagccaccttcacaacagtgaaaatgg

SEQ ID NO: 117767 - DNA, 1050 bp, Homo sapiens
ctttcttcatttttaagattgttttggctattctgggtcccccgaaatgtcatatgagttttagggatgagtttctccattgggattttaacagagattgctctgaatctgtatgttgctttgggtagtactgttgttaacagtatgaagtctctaattcatgaacatgggatgtccttccatccttatattcttttaattttttttttttttttggagggatggggtctcattctgtcacccaggctggactgtagtagtgcagtcatggatcactacagcctcatcctctggggcttaagtggtcttcctgcctcagccttccacatagttgggactacaggctcacaccaccatgcctagctaatttttttgtttttttaattttttgtggagacagggtctcactgtgttgttcaggctggtcgtgaacttctggcctcaagtgatcctcccacctttgcctgtccttttaatagctactggggcttgtacttttatttgtttgactgtttgaaagctgatgtgagaggttttgtgacttgggaatatcgaactttgctgtcttagaggatattgatgccatctgtcttcaggtaggataatgggtgtgttttagaagtgggtggttataaaggcttatgtggatttgtgcccatgtttgttcacatgcagatcagttggttagtttccctctctccttatagtcaagaccacccgccacaacctgataacaagttctaatgaagaaggaagggactagggctgtaatagcttatgcaggagtcctgatcgactgtatggttctacccagggcatatctcttgttggatggctggacccaccatggtagatggaggcttcagaattatctagaagtggtagaagactcgttatacctctatgcaggaaatgtctgacatgtgagcaagtgacgacatgggaatcacagtgcgggggaaccaagcattagcttttcattgaccttctgttgtctatgcttgcacctgcaggtccctgactatggctccccagagcctgccttcatct

SEQ ID NO: 117768 - DNA, 1048 bp, Homo sapiens
tctcccactgcccacctcagctccatgttcttgtcctctctttctctctctcattctctctccctgttttgtggaaaaatatatagaggcaataactgggtcagctgtgcagtccatgtggaattattgagggaagatgaaggatccacttgtgaatccacctctcatccttagtattggcagaaaatgtttctgacagtgttagcgtgtgtgcaggagacagagatggctgggagccctgtgggagctaccatttctctcaccctccactcctcttcccactccaaggagtgggggaagctgctgtgtgtgcatcagctgcccctgacctcttcttcctcagtcccttctgggcctcccccttctgctcatttgtcttctttgcccttgactatttccttctcatttagctcttcctcctcttctttttccccagcaccagtttcgttgttgatccctagctgtaagaaggaagctcataactgtgtgtctgtatgtgtgtgtctgtgtgtgtgtgtgtatacacatgagtatctcatggaaggggagggatatctgtggctttgggttaatctttgttttgttgtatgttgtcctgataatgctgtgagtcccccacttctattctttattctttttctccccacagccaaggctgcagcgttaacagaagtatagagcagtataggcagctctagggttgtgccctctcaggaaccatctccctaggcctccctagccttctccctcctgttgtggtgacgccttgcccttgttcatcctcacccagcctggcccctctcctgctcacacccagggatggccagtcacctatccagagcctggtgtggtgctgtgaactcaatccctgtctttcagtgtgattggtgccccagggagccaggttgctgggggaagctctcgtggcactcagccgttccattttgtcggcaaaaaaagagggggggagctggcagaaagctaaggcttttgctgctgggtgagtgtagcagctatttttagtacccgagcctttgcttttccattt

SEQ ID NO: 117769 - DNA, 1047 bp, Homo sapiens
tctgtgccaagggcatttagtaatcaaggtgcctgtgtgtggtatgtgtgtgtgtgcgcgtgtgtgtggtgtgtgtttgtgtgtggtgcagaaactagaacatggtagaggtgggtctttccacaagagggccccagtaggctcatttaaaaatttctgtcctttctacatatggctagccagttttcccagcacccattcagaggtgggaattgaacaatgagaacacatggacacaggaaggggaacatcacacaccggggactgttgtggggttgggggaggggggagggatagcattaggagatatacctaatgctaaatgacgagttaatgggtgcagcacaccaacattgcacatgcatacatatgtaacaaacctgcacattgtgcacatgtaccctaaaacttaaagtataataataataaaattaaaaaaaaaatttctgtcctgacacaaaatgtgcctttttatttatactgttgcagaacaaataaaatgatgagtccagtttctgtggctgatttcacagacccctcgagagacagcacggctatggaaagagcatggctttggggccaaactggctttgaattctgactctactgctctgtggctgcatgaactctggcacgttacttaacctctctgaattttggtcccctcatgggtaaaatgagcagcatattggaaccacctcagagggttgtcgtgaagagtaaatgaactaatactttgcttgcaacatggaaagttctctataaatgttgactataattattatttgacagaattaattttcctctgggatgcccagatagtatatttgaatgctgggggaaggggtggcactagggtatttctctgtctccgccatggcggagttattattacatttccacaaagtggaaggactaaagcctccgggcagtctgaggcatggctgagagcccagagaaggtagaattgtgtctgatgggagtttcttcttagaaattttacctccctgccccctccttctgctggagtgactgatgcccatcatt

SEQ ID NO: 117770 - DNA, 1034 bp, Homo sapiens
tgtactacattagtaaattccaagtcttcccctttgctattccaccaaactgatttttctcccaggaaccccaaactggttctactggctcctctgcaaagatttcatagccacagcagccacagtgtcctctgttaccaagacatcattatttttacaaaacatactgctgtgtttctccacctgcattttgaagtgtcataaacagataaagctgaagcacacttgtcagaataggttcaaaaagtgcattttgggttgctttacctttgtcctgacaatgtgtttattagcttgcttgttaattccagaattggttaacttgaggtacctctgggccagcctgctcacaccaacactcatcctgaaaacttccagagaaggactcaggtggctcactccttctcttggtgttcctgggaagtcaaagtggtgaatagcagtccttctcagggggcagagaggaaactgaattactcgtggtctgataccttccaaacatgtctctgtgggaaaggagaaattgtgggcaggatggagcagaccaacaaaggttaggagcttctcagtgattggaaaaacaagtacaaacaaaaaattagatgaaaacctttgttagacagtttgatttacttcctcttgtggatgatagattctggactatttctctccacacctgataattagaacatcaagaagataattcagtctctgataagcttttgcagtgatgttggtgggagaaaggagaggctcatgagaaggctttgcagcagaggagctgtcagtgctgattgcttcaattcttggcagggtcacccatcagatagtggacaagtctggcttggggaggctgtgtatagaaaaggagcaaggcacagggctcaagagtgctggcctggagtcataggacccaggttagagtctggctagctgggtgtgttagtttcacgtggctgctgtaacagatgaacacaaacttggtggcttaaaacaagagatttatcctttcatggttttggaggccagaagtc

SEQ ID NO: 117771 - DNA, 1517 bp, Homo sapiens
agccaccgcgcccagcctgttattcttgttactattaacttgctttagttactgactatcccctatccttctggaatagtctttatgtttaaacttatgtagaagtccccttttagtgaaactcttgctacccccacccttttttatttgtgatggagtcttgctctgtttcccaggctggagtgctgtggcatgatcttggctcaccgcaacctccacctcccaggttcaagcaattctcctgtctcagcctcctgagtagctgggactacaggtgtgtgccaccacacccagctaatttttgcattttgagacgggttttcaccatgttaggctggtctccaactcctaacctcaggtggtctgcctgcctcggcctcccaaactgctgggattataggcatgagccacgacacctggcctcgctcccttttttatgcaagaatttcagctatacaccagcaagacagggatttgaaggttctagtagttaccagaaggtagttttttggtagaacagctttttggtagagtggctctctcaaccaactttgggctcaaaaatcattattaaggctctgctcacttcttttactgccccttttcagtgctaaatgatgatcctcattcctttaatcttttttcacttgctctgtttcctggcccctgtgttgtttctgcagttcttcaaaggagtgttttctttcggaagttttcacagctgtcttctggctagggttgtaggtaatatgttaggctccatctcttctactcctccaggctataacttttgtgtgtgtgtgtgtgtgtgtgtgtgtgtgtgtgtgtgtgtgtgattgtggaaatgtgattgggatgggtaaaatgcacagttaggctctcccaccccactgtgactgtcatttgtgaatctgtgtcatgtaatggtacctcagccagggtccccaaacttgagatgctcttgaccttcagggatggtaatggcctgcacttctgtgatgcctaatgaggctgcctttaaaaggaaatttttttttaggttgagggtttttgttttgtttagaaagtaaacatacttgcatctctttttattttgacttgcattgatttcctcttctttcttaaatcctgagtaagaacttcaaaatcagttgccaacctttgtgttcacaagaattgagtggatcagcctctgtattcttcacctgtgcacctgatggactaatatactgctgtgggggaaacagcttccaaaggtctctcttctcttacacatgcacacacacacaagcacaactgtgttataaagaataggcacttctctaagaggaacttgtcctgcttcatgcaaataccctccattgcagcaaaattctggaaactttgaaagaggtacaattagtgattttttttttccccaagaagcctcaaagctcttaaaataaatcttaaaaaatctggtactcagagcttcagctcagaaagcagacaaattgcaaacctggtgcaataagact

SEQ ID NO: 117772 - DNA, 1027 bp, Homo sapiens
tgttttccctccactagaacgtaagtttcatgagagtagggacgagatctgtttgtcacattcacagctgtattcccagtcctaggaaaggtacctggcatatagtagatgatcaaacaacatttgttgaatgaatgagctgtgaatgagaatgtgttcttttattacgctgaacctgggtacacaggtgttcacattcacattcctactgctttgttccttaaataaatgtaatcaagatgattttctttcttattcattaactattgtgctcctccactcccattaattggaacagtctgtggagaggccattttccccttccttcgttttatgtggctctctttcttcctagcattttgttactggaagggggagtttgtggttgctaggctttgagcattgatttttaggatttctgtcataaggaagcaagctttagtgaattggtttggaataaaacaaacacaaaagctcaccaggaatagcaaatttatctcactctgattttttactgacattttttgtagtactccctaagttcttagataaggtcattagacaggaattgacaatggccagatagaaacaaattcacagaatgtgagtgggtggcagggtgagacatggagaggtcagaggggatagtgcttctctttctggtagtggcctggtttttcatggcaaatattggccagtgtaactgttctcctttcgtagggcctgtatgtttgggagctgtagagactgtagggggactgctcagtgctggtgtgcccacctggtaaggcctaggcaatcctaatttttttttttttttgagacagagtctctctctgttgcccaggctggagtgcagtggcatgatcttggctcactgcaacgaccacttcccagcctcagatgatcctcccacctcagcctcccaagtagtggggactacgggagcgtgctaccatgcccagctaatttttgtgtttttagtagagatggggttttgccatgttgcccagtctggtctcaaact

SEQ ID NO: 117773 - DNA, 1038 bp, Homo sapiens
ttttttattaatagccctgtctataaagtacctgtcactatgcctggcactaagtggtgctcaaaaaatacttctgcctcccttcctgccaccccctacctgcctaccctacataagagaagggtaaggagaagatcctcctgcttctgtagagggaaaatggccttaattagagctttatgtgaacttctttagttgctgatattgcttttctgagccacaatctgtggacctcctctgaagctgcctcatcaggagcgactttgatatttagtgtttgggcacatctctgcttcatccaaggagtaaaagagggtttaaaatctcatcagggcacagaatgcctgcttctgcccctgtagccttgcctcccctcccttctttctttgggtgggtcactcggggggcactgtctgccctggggattactcatttctttcagggggtcctggttgtttggttcagtgtctttactggggaaaggcttttgtgtttgtgcctgcctgggcctgtgctgggaacttttattttggaagcctggagcactcagacaaggtgatatctttttagactgtttctggctgtaggccagcttatcactatggctaccaccagcttaaagaatgtcaggacagaaagtaacttctgtaagaaatttgggagagaaagggggaaggggagagaattgtttggcttaaggtcatgtagggaggagaacagctctaagtagaactctttgatttggatacagcttcgttttccttctctctgaaattttattttttcagtcaacaaatgtatataaaacatctgttacattccagagactgttaggccctgagatacagtgtcagatagggttccagcttagagtgtactgatgaatatgtcaaagttagtaaaattacacttggaataagtgtattgaaagaaagagttaagaacatctgagagggatttgacttggtcctagggctaagagggtatcatagaaggcttctttgaggaagtgatgttcgagtaaatattgtgaagacc

SEQ ID NO: 117774 - DNA, 1049 bp, Homo sapiens
ctggactctggcgggtcctataaagaaggctgagcagccagtttagtgatttctcaacttcaaaatagaagcctggagatagtcctacccctcctctcccttctgccaattttaccagcaattgccaagaactgtgtgtggggaaccaggcagaatgactctctggaaatcatttgtttgagaactcccagtggaggaatgcattttcctgtgcttcttctcttgtgatggtgtgtgctgttgtgatttggtactgcttgtccctctgcagtactgagacttgtatataactcctccagccctgcgggggttttcaacaataaattgcttgctgggtagtatttcccccaaatccctgggagagcaggggagcatgttaacaattagggacctagttgagcctctgtttctggcactgtgactagaggcatggtgggtgaacccagatgagccatgtttcccactgctgctcgggctgggcatttattgcagttggatgtaacattaagagtcacactagaggcttggttggaaaggagagagcactgcataattattgcttatgtactgtttaaacctatcagccaacagatgtcaagtgcagaaaaaaagcacaataatgttattataatggcataatagttatcattataataatcagctggcataggttttgataagaggcagatcctgaaatgagtgcagggggaagggttaaccttgaactacagcacaatgaatggctgcttaaccttgcagaagatgctgtgtagaggcaggtgactcaggtatggagttgctaccctctctgcctagctagaggagctatggagacttcagctgggattgtctaccctgcaggtactgtctttctgatggtgtgatggagcacaccatcctttggtttaaggcatgctacactgcaggaataccatactagtgcccagagctgtgggttctgggaaatgcagagacttcatcactgtggtctcattttgggttttcagaaaatccagcctcatgcccatagttgcagatgatgaattttg

SEQ ID NO: 117775 - DNA, 1035 bp, Homo sapiens
cttgttcttagttcttgtagcaatgaggcagtcctctttggaattctttaccatttccaggaccattgcagttagggcaggaatggagtggtggtgattcctctttcctcttttggtttgaaccctcctttcaggatgcttagttacacaggcctgtcctctctggaaaaaggggatcagtagtaggtttctccactttttggagaaacctaaactaaagcttcaatggggcaataccttttaggagagtttgaactgacagtctggcttcctattctttgcggagagttattgctgctattaggcagagggctttgtttccaggttacaaatctttttagcaaagaagtgagtgtggaatagaattggaaggacttgtgtagtccttggatataatttaatgctccacatcccagagagagtaaacattgtaaagtgtgcaagatgggtttggattaatatcctgacagcatgtggcttggcatgtagggcattccttggagacccttcttaccatacacagcctgcctttgccgggtggcctcttcccacaggtcttcccagcagctgttgtgcacctgggtgaatcatccgcttccctgtgctttgaaaaaacccattttaactgatgaaagccctcatacaggaggtgcaataaacagacaaccttgaaaatgttttttagtacaacctaagctgcctctgagtttgtccagggtattcacctccattaggagcactggctgattctcacctctggtctcttctgaatagaatatggaaaatcaccttgccctttctactctgctgcacctgacatcatgggtgtggaaggtctctggaaactccggggaggcaggagcaccatggacatggagggaaggctcatttgcttctaaggaccatgcagaaatccttggctttttacttctgttagtcctacttaaatcagaatttaaagccttcaaatagaattctgtgtatggctgacatagcatggagtagggaaggcttctttgtaatttctgaggagaa

SEQ ID NO: 117776 - DNA, 1056 bp, Homo sapiens
ttcccagccacagtgagttcacatgctccattcccagagccctttgtttttgaagcattggattccttagagtaagccttatacactcaattggattagaacttcctagagggcagacactgcatctgtcattcctcttcatgcatccaatccccagcacagtcctggcacatagagagtgttcaataaatgtttatgaattcaagagtcctgctatttggtcagctgatgtacttgccagtttagcctcctgtgttactcactggctaggagtctccaactcagatgtttttagggccaagttgggaacagagaggcaacagagaatggtaggcctgtgtcaaaccggagtgcttatgtgcttcatgaggggtggctgctactcagcctatcgtcatgggtgagtatggcctcctcatgtcatatgggaggccagatattcataatctctagggactaccaaagcatatttgtggtctagatttgacctataggctacccatctgtatcctttaggtagaggctggagtttcacacatttaaattccttgtaaaataataaaggtgggggaggggaggacatagcttgaaaacttttgagggcgtttggtgaaagcctatctttagataaaagtgtcctatgattttctgtgggtagtgacttaatctcttgggttcggccctgtagaacatctatggtctgggctttatcctcccttatattctgatttcactgggctatgaaaagcaacttttgtccctagaaaggtggtgactcaagaacttttgcactttttgcccttttgctcagcttccactgaggcaggtttgatagttgttcctgcttctggctactttgaagggcctggtggtcaggctggtgcagcataaggtcccagaggccacttctgttaatgacatctctgagaaagagctctgggtgaacaaatacaactaaaagggaaatacattgtacagaatcactgcttaaatgtggtcagccaaggggcaaaacagtataatagccagaaggaagtctgcatctccatggaacct

SEQ ID NO: 117777 - DNA, 2261 bp, Homo sapiens
tgagaatctaatgctgccactgatctgacaggaggcggtgctcaggcgttaatgcaagcgttggggagcagctgtaaatacagatgaagctttgctcactcacttgctgctcacctccttggatgggtttctgataggctacagaccagtatcgggggtttgggacccctgatgtaaatgctctgtgttgtcatcattattgacaacaatagtttccagtttctgagccacgtcgtagtttcaggataggttatgctgaccaagcaagttttatcttaaccatcacctcattgttgtcttagttggtttgtattacatattatttataccaatagttataggtatttcatgctgaataactaaaagttgtgagtagcaaggaactttgctgcttctctgccatctccttccttactcagcttagtgcttatctttctcaggttctctcttgtcaggtgctcaagccagcaggccttgtttcgggggcagtgtctgatgaggggattttattggggtagggctggctagtccagagcctgcctggtccctcagatagtatgttctccttatctcttgctttctgctcttcagccagacatgaagcaattagctcatcaagggaatgttgacttttgtcactgctttcctctgatttgtatgctcatttctggtccttgtgcaaagtcacggaggcacagtcacatacactgacccagattttgtgctcaagttgactgtctctctctttgagatgtacaactggttccatgtagcaagggagtgaggaaaaagcccctggagccaatcccattattttgatctcaagttgagtttttaaaaaaatccaagcactatgactatagaccatgcctcacttctctgtatgaaacaaataaggtaaaaaaaactcactatttggagggaaggccaatctgaattggtaaacaataggaattagtacattcaagaaaatgccattgtctttttctttttagcgagcctctgcagtatcttttttacctagttttgttgcttcccctgtttcctgtgactgtgctccagaattattacagaagcgccctcttatttcttgcttttgcttcctccaggacactatataccactgccactttgggtcttcctatatattgtgcttatcagagaatacttatgcttggaagctgtattagtctgttctcatacagttataaacaaatacctgagaatgggtaatttataaagaaaagaggtttaattagctcatggttctgcaggctgtacagacttctgcttctgggaaggcctcaggaaacttaccatcatggcggaaggcgaaggggaagctggcacgtcttacatgtctggagcaggagaaagagagcaagggggacatgctgcacatttttaaatggccagatcctgtgagaactcacttttgtgaaaacagcaagggggaaatccgcccctatgacttagtcacctcccactaggcccctcctccaatattagggattacaatttgatatgagatttgggtggggacacaaattcaaaccatatcagaagccttcaatggcacccactagctcctgaataaattccaaatgtatcaggttgttggtgttccaagcctattgcagtgtatacccatcctaccattttaattaatatgtccgtaccatcacccacgtgtaccccttgctcctgatgaactgatccacgtggtcctctgagtatgcttcatgttggtgtctctgccagttcttttgcccagagtactctctccttagtttcctacttttttttttttttttaagatggagtcttgctctgttgccccaggctggagtggagtggcacaatctcggctcattgcaacctctgcctcccgggttccagtgatactcctgcctcagcctcccaagtagctgggaccacaggcatgtgccaccacacccggctaatttttgtaattttagtagagacggggtttcaccgtgttggccaggctggcctcgagctcctgaccttgtgatccacccgcctcggcatcccaaagtgctgggattacagacgtgagccactgcacccagccggttccctactttatgctgcagagctgccgccttcagtgagccttacctgatgtgtcctcatctgtatccccattgcaacacctttattatagaattcagcacacttttattatggtatgatgtttgtctctttttatatgagcttctcaaggatatgggttgtga

SEQ ID NO: 117778 - DNA, 1344 bp, Homo sapiens
agctgctaaagtctaaaatgattgtgttttgggctggaagatattatagagatctttatttccttgcaaacatcagggctggctgtttgtggtactgtggatgagtgaagagtcaggagatacacttctagttctgttactgcccaatgcctccattttgcatttgataggtttttatttttctgacgacaaaaactgagccccagagaagtgaagtgggccacgtaatggtaggatcttttttaggccacccacataatagtgggactctagtgttagagctgggacacaggctaggggtcttacaaagggtggccatagaagttgttagaattgtttaaagcattgtaaagatgcaggatgcttttgcagttaaaagtctcctgggaaggaggaggccctgtctccacttactgccttgtacatgatcttataccctcatggttgaagatttttgctgtcgtgctgtttttcctcctactcatgtcgaaatgtgtttctcttgctcttacctcagaggaaatgaatttgaagccttcctccgtgttagaaacaaatagtgctcaggccagacttgtgtgtttctgtaaagaatgaggccagatgtaacagtggaccttatctggtgatccaagcaaaccttcaagacatctctaagagaaagagagaaggaatgagtgtatttcagagtggtttaaacacactttggagtcagactcacttgtatttacgttctgatatctacttactagttgtcagattgtaagttacttattttctctaagccttagttttatgatctgttgaatgggaatagtaatatgtatttttatagctatcttaagaattcagagaatagatatggtgcttcctctggcacaatgtaaaacagcagtccccaacctttttggcactagggactagtttcatggaagactatttttccatggactgggggatgtgggggatggtttggggatgattcaagcacattatatttattgtgtactttatttctgttattattatttttgagacagagtctcactccatcacccaggctggagttcagtggcacagtcttggctcactgcaacctctgcttcccaggttcaagcaattctcctgcctcagcttcctgagtagctgagattacagatgtgtaccaccacacccgctaatttttgtatttttagtagagatgaggtttcaccatgttgaccaggctggtcttgaactcctgacctcaggtgatccacccgcctggacctcccaaaatgctgggattatgggcatcatgcccaacctatttctattattattacattatagtatgtaatgaaa

SEQ ID NO: 117779 - DNA, 1007 bp, Homo sapiens
gttgctcaggctggtcttgaacttctgggctcaagcatttctcctgcctcggtctcccaaagtactgggattattaagtgtgaaccaccacacccagccaagtttattctttattgttttaattttcttccagtctttggattttgaggtggtccatttatcatctgcttctctggtgcctcttggaccttccatcttcacagctggggctgctgtgttggcccaggtgtccccagactggacatcggaacctttgggaagagtctgatgtttggcccttgtcacatttcacatttcacatctacagagaaatggggaagggtatgtttctgaggtctgctcataggctatgttgtgactgaggaagttcttgatcatcccttttggttaccacttatcatcactggcagaaaaacatcaaagtggtcagtgaactcatctccacatctggctacttccatctctgcaagtagtttgcttcttcagtcttgtgatgggaaagagatctagaaactggaagaataatctgagatacatcctaaagttctggtgaggaaagctaatgccaatggacttttttttttttttttgagatggggtcttgctatgttgcccaggctagtcttgaactcctgggatcaagcaatccttccacctcaacctcctgagtagctgggattacatgcatgtaccaccatgcctcactcgccagtggatttttttttttttttttttttttgagacagcatcttgctctgttgcccaggctggagtgcagtggcacaatctcggctcactgcaacctctgcctcccaggttcaagtgattcttctgcctcagccttccgagtagctgggactacaggcgcctgccaccacgcctggctaatttttgtatttttagtagagatgggatttcaccatattggccaggctggtctcaaactcctggcctcgagatctgccggcctcggccttccaaagtgctgggattacaggcgtgagcca

SEQ ID NO: 117780 - DNA, 1040 bp, Homo sapiens
gccacctcgcctggcatataaacaggtttttttttgacattgtgaaagatattttgttgtgtgtgtgtgtcttttctgctctcaccccacccaagtttttttcttttctgataaaagtatagccagatttggggattgggtaggattttgatgggagccagagtgtaacgatattgggattgatatttgtataacatgggtcagaacttggtctgtggttttgagaacatggctctcgggtttttaagatggtgttaccacaccacatttatttcccctttctttcatttgtttagtgaatttaatctgctcatgaatacatgtgctgttttaatgaaattggcaatagaagagacgttctgctcccattttacaggtgatggaaatgttagtagggatgcggcagtccaggaatgaaaagttgcctagtactttgattcccacttacttccccttccctgctgttttctgaaggccagctattacttctctactgaggccaactgtgagccctggtgtgtttcattggcaggagaagaggctaattaagtgaaactgaaaggtaacaaaatggattttaaaataactgacatgtgggaacttgatccaccaatgaatgttctcctttagagtgatgtgtgcaggtgtaggtggtgggagttgaggatggcgtgcctaagtgatttggctgttgtccaaggcagttttgaaaatccacctctggaattgttttcagagacctttttgaaccatgcgagagatcagtttctttaatatattaaaccatactgtattattattattattatttttcagatggggtctcacactgtggttcaggccggagtgcagtggcataatcatagctcactgcaaccttgaactcctgggcttaagtaatactctcactaaagcctcctgagtagttgggactacaggggcgcaccaccaggcccagctaattttgtaattttaatttttgtagagacagggtctcgctgtgttgcccaggctgtttttgaattcctggcctcaagcga

SEQ ID NO: 117781 - DNA, 1228 bp, Homo sapiens
accgtggaccaaggtgacctgcgtgggtgagcgatccattagccgaatgacagcgctgccgcagaaagccagaaaaaggatatgcgtgggaagcgcaaaagcgtgggctgggcctgcagcaacggaaaggcgccacgctcgtgagcggaaccagcgttccgggggcgctcagtgtgggcaggcaggaagcctggctccactaggacacacagattctctcctgagcagctgcgaactatgcgccccttctacccttaagagatgggatgggagtccaacaaacccagccattgctcagaccccagcccttctctcctctaagaagcaggttcacctctgccaccgcactcgcatttttttttttttttaaagcccggcctttcctaggcggggtcaagggccccgcccaccgaagccacgcccagtagccgccccggggcggggttcccctcggctcccggctgccctttcccctccggcctctgccggtgctgctgcgccctgcggagctccgaacacgtgcgcgtgagtaaggacccagaggggagagtccttggaggtttcccagcctggggaaagaagcagtgcagggtggcttctgccggggcacgggacgaaattggggttcgtcccctcgtgatcccgagcttggagggcatctgaaagagacttgggcctcggagtcgtcccctgtttttctaccatccctcttccctcttctccctagggagtcccatagagcctgactccgagagcctcgatctcccagggccagaggcagggactttggaaggtttgtgaggaacaaatgtccggtggaactgagtcagcccctttaacccgagccttgaaaggggcaggctatttttagatctgtttttagacccagcgaacaatgaaccctctctactcattttcctgttcctctaaattatttggaggaagtcaggagtgaaatttggggatggctggaaaaaggtatgatcttagccttacataaattataatggtgactgtgaggccgggcgcgtggctcacgcctgtaatctcagcactttgggaggccgaggcgggcggatgacgaggtcaagagaagaagaccatcctggccaacatggtgaaaccccgtctctactaaaaatacaaaacttagctgggcgtggtgtcgcacgcctgaagtcgggaggctgaggcaggagaatcgcttgaacccgggaggcagagattg

SEQ ID NO: 117782 - DNA, 1100 bp, Homo sapiens
tgagcccaggaagtggaggctgcagtgagccatgattgtgccactgcactccagcctgggtggcagagaaagaccctgtaatataatacctccattctacaaatgagactgaggtatagagaggtttctcgcccagtatcatttggctagacactggttaggggatagagccaggctccctgatatttgtttaatcgactcttttgctactattgaactgctgtggtgtataagtaacaagagatgaaaacaaagctaaacaaggataagctattggttttattgtctgctattgtttctgtggcttaggcctaagttaccgtgttttgaggggagggactctgagctgcacacgtgttcactgttggctgactaacctggagttgtttcattgcagagaggctggctgtggcagatgcaactgcaggtgagtgcaaccccttcagctctcttggctccagctgtaggcagctgcctaggttgtcttgtacctaggcaagtgttacactgctgggagaacagcagccaatagctggttggcattctggccctggttcatgccaactcttgtgttgactaccccaggatgccagcatagttgcttatccattaaggcaggcgtgttttttggcttccctgggccacattggaaggataagaattgtcttgggccatacataaaatatagtaacactaacgataactgatagctaaatttaaaaaaaaattgccaaaaataactcctcataatgtgttaagaaagtttaccaatttgtgttgggctgcgggttggaaaagcttgcattaaggtttaatctgtgagagcatgactttttgcagagaataagtccagaccttcctgaatagttctggtccaacaggtttgggtagcatgaagttacttgaatcataccttggaaacagaacaaagctaatgggaagagggggttggtaaaaatagacggaaaagtcacacctttatttttagtgcctaccaagggctcaaagggggccagatacaatgggatttttgctaatttcactgaaattaaagtccatggctcctactacccaccataaaagctagtcatgacaccctt

SEQ ID NO: 117783 - DNA, 2105 bp, Homo sapiens
atattctgtgtactagatcactaagtttgcttgtcttcctttttaggatgacttgaaagtagggcatccttcacccatctgaagggaggaaatagtggcaggtgacagtctgcatgtgcagttttcaggtaaatatccctattcattccaacattgactacctcctctgtgccaggcctgtgggctagttggtatctatcaggaaacaaatgggaggtaaattaacctgtatttgtaagatccatgaaggaaaggacaatatatcttgttttattcactgctagatcccaatcgcagtgcttggcacatggcaggacctccctgaatgttgcataaaacaactgaaaacacagaaggggattcctgttaaagggtttgacaacagggtctgcaattagtgcttccacgcctgttttgcagtcaatattcaactgatacgtcttctacctggagtgcctaggtatctgaaacaaataatgagaaagctgtttcaggaatcatccagcggttgtcagctatccaggctcatgtggtgcctgtgatggtgttacactgttggaagagcaaacactgtctttattgaggtttggctccaagcactgttttggtgttgtagctgagtacctttgggcagtgttttgcacctctgagagtggaatgactcctgtggagttgatcctagtctgggtgcaaacaatttttttctgtttgcagaaaaagacaggttgtcttagggacagcctgtcattctttacctctttgaatcctagatgccttcacctgaatgacatctacctccatcaggaccccagatgtctgacagccctgtgtgacaccaagataagtaacgtatgtagtcttcttgtcatgtaggtcccaattaaattactatagctcagatgggggtaggggacttaaaattatgatgtgaaaaattatgtagagtatcagacttttttttggggggggacggagtcttgctcagttgcccaggctagagtacagtggctcgatctcggctcactgcaacctctgcctcctgggttcaagcgattctcctgcctcagcctcccgagtagctgggactacaggcacctgccaccatgccaggctaatttttttattttaagtagagacgaggtttcaccatattggccaggctggtctgaaactcctgaccttgcgatttgcctgccttggcctcccaaaatgctgggattacaggtttttttgtttgttttttgagacggagtctcactgtctcccaggctggagtgcaatggcgcaatctcggctcactacaacctctacctcctgggttcaagcgattctcctgcctcggcctcctgagtagctgggattataggcgtgcactaccacgcccagctaatttttgtatttttagtagagatggggtttcaccatgttggtcaggctggtctcgaactcctgacctcgtgatccacctgccttggcctcctaaagtgatgggagtacaggcatgagccaccgcgcccagccaagtatcagaattttagagaattcttaggatctaaagtccatccctcacttttctggagctctgctgtgcagtaggtatatgctacatgtggctgtgtaagttgataaaaattaatcaatttcttaatctcagaatctggctgctgactaccctattggacaactccaatattagagaacatttccaccaattcagaaagtttattatgcactgctgttctagagcagggatcagcaaacttgctgtaaagagccaggtaatataatattatgcttgttcagccatgtggtttttgcaactatttttgcagctctagtgcaaacacagccttagacaatatcaacacatgagcaagtctatagttctaatagaacattatttatggacactgaattagaatttcataaaattttcagtgtcaaaattgttttcaatgatttacaaatttaaagaccattcttattttgagagccatacaaaaacagcaggctggaattggcccataggctatggtttgccaacctctgtcctggagaatgaaattcaggccttgaaagttgaacagctcattagtgacaggttc

SEQ ID NO: 117784 - DNA, 1058 bp, Homo sapiens
tgttaatcttttcccatgctgcaatgaaaacttgaatgagactggcagggttactggtctgtaaatacccaggctgccagctgccataggtagcagtaaacacaagtgcctcttttcattgcttaggccaagtttcaggtcttaggcctgtaccatattaagaggaaaaactaaaaataaggagggtttccaaacacccccaccaaccttgaattttttaaaaaatgagggaaccacaattaataaacactattcctggcacctgtccatgatttcacttgctgggttgaaacaaactagtgtcagtgggattttatgttgaaattttggatcatgcctcactcaaatttaaaccagaaaagcaaaacccagagggataaattctgcaagtcccaaagggacacaaagaggtggctaagtgcctaggaattcacacaaaggaaaacaccgtgctaagagcaactaattaagaacttaaaaagagtgacaatgactcctgtgaatgttgttgcttaattagggctttatgaacacagctccagttaatggacctgtcaatatactcttgaaaaacaatttcactgaattaacaaattaactgtaataacttaaaatctctgcttagcaacatctttctccttaatgctatttaggaacacttgtaatgagccaacttgatgagtcataaatttgtcagtttagtagcctaaggcttgttcagaggagaccctgttacttgtttggtcttccttgccctccagtaaaggccctttaggatgtaagaatgttctgtgctgcttcttaagggtgatatactcattgggaaagtacagtaaaaaggactttaaaatttattttattttacaatacttttagatttatagaaaagttgggaagatggtacaaagagttcccatatataccatacccagtttcccctaataacatcttacattggtatattatggttgtcacaattaaatgggctaatattgatacattagtattaactaaagtccatactttgttcagatttcattagtttttatgtaatgtct

SEQ ID NO: 117785 - DNA, 1907 bp, Homo sapiens
aaggtaggcgtgaagcgggtaagagtcggggtcgggtggctgggggttctccgtgtccgccgggaggggacaacgacggcgacaggggctgcggggagccggcggcgcgcctttcttgctcgctcccgctctgcctccctccgcgttgcgtatgtgagccgcctgatcggcggccgccatgttaggagcgcagtggcggcgcaaccagccttctagggcggcggaggtgagcggtccgggagggaaacacgcggccggccaagggcccagggtgcggcgggagattttgggtgaagaggtgcgctgaccggccgagcttcctgcgcgtcctgggctcgttgtgggcgggggcgggacgactagcccgttacacgcgggccgcggcgctgagggggagggaggagctcgctcgaggcctgagggacagactgtacactgggggcttgccgtttgaggaggatggttaagatatctaagtccttgggtagcgccagtgccaaataacccgttcgcctttttttctctgaaaatgttcccccaaaatggaggatttcgcagactctgaagagcctgcttgtttgagcagcgtttctttcttttcccggtgtctcggccttcacgccgctccttgcccatcgcctcagagcgccccctaagactcccggcccacacgcgcgcgcgcgcgcggcgttagctggacatcagaaacaattcctccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctaggtgtttatcctgctctgtggccctgttctgtggaatattcctattggatcagttacagttttttagccagatatttctagaacggttatggtggttctgaaatggctagtctttcgggcgcgctggaataatgtgaagaatcgttgatttcgtaggtaggggtcacgagattttgtattggtactgcgttctgtgttttaaaccttggcttaagatttctgaatagtcggtaaaatacatttttctcccagggaaatctaaacagttgactatgcggacaaaaatgatgtttcaggctattttaataaatgtttaaaatttccctttaaaaacatttctttactaatggctcagtcatctacgcagtctatcgacgtttttcacagtattgttttaaaaatcaagaaaggcttgacattttcgttgcaaaaacgctctggatgatgccttttccacttaaatagaatgtttttgcaaactcgaaattaaacaacattaaaatactgcatgaagtttcttggttatgtaagatttggaaaagatcatttagccagatgtgtgttgaagtgctttaaatttgtatttcttcctttgcacttaacagtatatacttagaacattactttgtactttacccagagaagtttcgctttatcatctttatatatttttcagccgtgtacagcttttatatcacattttgaactaacttggaaggatttaactacccttgatctgtgcatttgttttagtctttaaacatactaatttttttactaatgcttttagagtttgtaaacgctaatattacaagtcagttaatggtttttactgaggagtgcaacggtggtgtcgtattttaggagc

SEQ ID NO: 117786 - DNA, 1227 bp, Homo sapiens
ctcctgacctcaggtaatctgcccgcctcggcctcccaaagtgcaggattacaggtgtgagccactgcgcctggcctattttaaaaactcttaagccactcaaggtacatgccatactgagatgagattgtgacactcaaaaacatagattagagagcataagatttgaaagtggctgaaactctaggaaaaaaatgtagttcttcagcatacttcaaaaaaacccttaaatgaaataattgttacaaaatatgttaggaaatattatatacaccattaaaatgaaaacttgtagtacttttaaaatggaaactatggtaaattctttataaaaccattataaaatttaataaatgaagaaaaatttaaatagtaactgaaacctgttcttgaattgaaaataagttggatgcttggtttgaaagtcctgaccgcaggaatcaatatttttgtgtgatttatgacaaaaatcaagcagctaccttccaaatggtgctgctttgaaattactgacagtcaactatgtctgccatctatcagtgacataggttaagacatttttactaaattggtattgttgattgctacctaaaacatatttggtatattttcacatgaataagctaataaatgatcaaggtgattggccttgatagaacatttggaaaatctgagcatttcttgcaattcagaagaggaaaatataagaaactgtagttttctagctgttgcttgtaagtttcaatgtgaagttaaaataatgtcattatgaaggtatttttttccctgagtatctctagttttatggttaaaccataaataatctttcatagttttatgggtaaaccatctcaaattagttgttttttttttttttaattctgactacaaagactgagaagagaaaaattatttttttatttgttttgttttttgagacgatgtttgctctgtggcccaggctggagtgcagtgccccaatctcggctcagtgcagcctccatctcccaggttcaagtgattctccggccttagcctcccacgtaggtgggactacaggtgcgtgccaccatgcccagctaatttttatatttttagtagagacgaggtttcaccatgttggccaggatggtcttgatctcttgacctcgtgatcaacccacctcggcttcccaaagtgcagggattacaggcgtgagccactgcgccctgccagagaaaaattat

SEQ ID NO: 117787 - DNA, 11591 bp, Homo sapiens
acactagtatatagagattttaaataggtaaattggattttgataataaatgttctcccaaagctactatatttaaaattgttttaacctctagtgcagtttcctatagaaaggcaattttataattacaggaaaaaacaatacagtaaaaggagctaatcttttgtaaatctttagtaagtgtctccatattgtgctgcctttgctaataggcagtggggcccatgtgaatgagcctttaaaagtggcttgtacatcttatgttcagcattgacatgatagaggaactgttttcattaatgctttttcaacaatgttgccacatctggtttctcccaactttgttctaataaaaccatttttaagaatttggtttatttgtggtttaatccaaaatctaacttaagttgcttttcactaattttaccctaatatccttgatggagctgcattttacgttgaaactgagtatcttaaaactactaaggtggttatggaattacacgttgtcatgggatttacattgtttgtcttgactcttttctgagtttttctgacattcattttctgtttgtcttaaggttatcctttacctttgcttctcttaactttttccttttgttgatccactgttttcctatgagctaccaaaaaatgtaattcagagctctgtagtctaacagtcacatttccttaaaatatggccgttttaaaaattttaaacataattgtaataccattatataatttctcttagggaaaaaataattcaaaagactgacttttcagtaatgcaaagctttggctacaacatgaaggtcaaagctgcaattaataaccctgatacttcaacatttttattttgaaaaaccctctaaaggatttgatttgtaaaaatatgtgtgaaaatttagagggtccaccaccatttacatagcatctcagccgccattctgtctggcatttataagacatatcaaagaaactttcatctgaagaagtccacttattctcgtctttattaatcttaaagcttaagtagtttacatagtggatcttgtctagaactattaatagtttctttggtgtattttctcaaattcatctttcttggtgtgcaaaaacatcttcctgtaactccagccacctcttatagcatttctgtgtcttttaaaacttgattatatctattttttaaaatccagtctaaatctttcttgcctgcaactttttttatacttcctttgccactgtatttgtccattgtatccttgctttaatctatcattggtgaaattgatcctgtaatagacttgtaactactggatattgtctggttttactgttaaagtttcacatattaagctaccagtgctgagtgtattggtgatcaaaaaatagaaaatttaagcaatgcctcatagaattctgtaccaaacaacttcagatttacctctgtatgtagttgtgattataaaattgtttcactgaagatgttatgtatatctttcaactaatattttatgacaatcgtgatataaaagatttggaaattcttatgtgacagtttctgaggtacaacaataatgatttaagaaagaaaacaatttcatctagaaacacgtcttgggggatcataatcagaacataaatttaccaggtgatttgggctattcttgtgaaaagtttacaggaaactgtgtaaccaagatctcattttcatttttacctgttttgtgctctagatgtgctgtagccctgagcattaaatgagtactgatggatgctgatttggggagttcccttctttaaatcacctgtatttcctgtacctaggttttttcttgggagggctcctattcctgtactgaccagagttagttctccttactttaaaagactagatatgaagtaaacactgcctgatgtaggatggtcagtaagaaggcaattagttgtataacttaaatttgggcagcaatccttaaaactataggaaatgacttatttttcttattcacatctatcttcacctcaaattgattttgctgtataaaggtctcagctattatgtttggtcttatatcttacattaggtacttgaaacctaagcttcatttacttgtgattttacttggttctttctgatagtgataataggtctcattttccaaagcacagtacaactgattcatctttgacttgctgaccttgatttttttgtttttagtcttctggaacttaagcatcatactatagggtgtatttttattcttctaaaagaagaaacccatctatatttttactgaaattttgatgtactcagacatctaacctttcaatttacatgtttttaaactcagtatgaaagtccctttaatagttaagctttagcatgaaatactactttttaaatatctatatgcaggctctgcatacatcaggaatctgtttaagatatgtaataaattccttgtaagtttgagatcttaaatgttttttttttaaatcaacatgatgcataagtttttttttcttaaaaaaacggcatctgcttaaagggatttatgactaaaattgcttatttttctacagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggtgagttaactcaacagatgcttctaatttcttttacattgtagtgcctatttacctatatctttgactctaattctgtagtctgatgacattgagttgatcaagcatttttaaacttttgagaacacttactttatttggaaggtaattgtttttgagcattttaaaccagggctttacattaatatattctgcctagattacttctggccacaaagctatcatccactgagattatcttgttggtttttggcatcaatatgttcttcttaatcatatatttaagcaggttttttttgtctgctttgttgaattgttttaagtattttttttgcagtcaatgtgctctgccattcaggatgctagatttcagctctccatctgtcttgattgctgatttgtatgtagtaaagatgtattcttgaacaattctctttttttccttatctgtggctacagggaaagagttaatgtagagccctggtgtttgtttcagtatgtttcatattttagattagttcattcttccttttttaatttccctttaacacaaactctcatactatgactgaaatttttcatcattttttttctccttttccacaactttcttaaacatacttcaaaactcactttttattatcccatgttacatctgtccctttagagacttggacaaatcaactactacagtatcctgctctgtgttcctcataaacaaattctttttctgagttaggcttagacttctgaaatagtcatttgaaaagaaaatctaattctcctttgctttaattatcacatctggcaaaatgggaactttttcaaaatgcccttttaaatatgttgtcctttctctttcaactttttcagtgttactcattctgactttttttcccccaatatatggtgcagttgacttaaagtcattgttatagcaccccactagcttgatctataatctgtgaccgtccattttttcctgatgtgctctacttaactggaacaagttgctgccatgaaattgatttgatggttactgttacagggtttttctttacagtaacatctggaagggtcattttcttttcatagctaatcctttgataagcattttttagtaaatgagtatggatttttttttagtagactaaatcataccattgtttttaatattctgttaaagagtattaccagtcactccctttccttgtgtttggatctcagtatttttgtcttttaatctttaatctgtaccaaagtaaattaacataaatgctaaatttaggtttatttaaacatttaagaagatgtattttcattaagaaatacaaccccagactcacaaaagccagcaaattttaattggtatatgttttgggtgttaccttttcctaaatttgttggctctactaaatatatcatggaattcattttagtttctgatcagcactaaactttaaattttaggtcccgtgtgaattcatagaatgaaaaggtccattaaacactggtgactccaattttttctgcgttatttcttgcctgtttataaggaaataatagcagaaatgtcagtatgaccaatattctcagaaagggtctctaaattctgaggaaaatagatagttacaagtgtctcaaatgagagtgatgtgaagggacttaaaaaatcttcgctactggagtcattaagctgttgggacatcatgaacacaatggaaccatgagaggacttcgagaaaagtttctgtttttatgtatgattatgcttttttccttcaaattttgctactttctagttcctgaagaaggctaataacttaaatggatctaaattaacaaaagagcagtttttacatattttgatgaaactatggattcaagagtaagatacactaccctagtgcaagaggtacttttagcctgtaaaaatgcttaggtcctagctagttttggtattctgtcaaaatactgagtacatttgagaactattttagaggccttttgtttaattctgtggtttaaatgtgtaaattggaccaactttaagaagtttaaacacatggattatctgaatttctagttttctagttgctttactatgttttttacgtatatgcattatattgaaaaaatctttactcactttagcagtggaccctctataaccgctatagaaatgaccttagagaaaatttctgtgatggaagtagataatgaaaaatttttaaacatttaatcctgctctctggtattgctgcataacttggaaaatctgttctttttacttagtggtattgttaaatagtctacatgatcaaaaattcttactgtgaagtaagaaacttaagttgaaaataatttgtcatggagtgtcattatttttaggtgacttaaagtgatggtggtgtttttatttctttataggtcattttaggtcatcaaattgcttttcttttcttttctttttttctttttttttttgagacggagtttcacttttgttgcccaggctgtaatgagtgcaatggtgcgatctcggctcaccgcaacctccgcctcccaggttcaagcaattctcctgcttcagccttccgagtagctgggattacaggcatgcgccaccacgcccagctaattttatatttttagagccagggtttctccatgttggtcaggctggtcttgaactcctgacctcaggtgattcactgccttggcctcccaaagtcctgggattacaggtgtgagccatcgcacccagtcatcagattgcttttctatgcaatctcaagctttctcagcttcctttcacttaaagaaaattacccactacagcactttggctgtcttgtcacttgagtttatattaagttatacttttttctgccattctgtaagtgcttcccaaattcttttttttctctctataaggtatctcagatacatcaaggtgaatgtagttttcctacagaaatgtctgaatttaaaaagtgcacgaatcctttattaatctgattttacaggagttacctcagtgtagagtccagggatatatatttttataaaactctttcacttagtccccaccgtaaaccaaccagtaatagatcagtagtacagattagtcattggatgagtttgggaggtatgtgattgattttttgatcttggccttccttttttcactttgaaagaccagacacacttttcccctaagtttgaacctttaaacaacgtggaggattggatataatttctgttcagctatgtaccctttctagctcctatgaaatagaagcatgcgtagtaggataacatttatttctctcccacaacttaagaatattttaagtaaaatctgaatatttttagttcagagaattgtaagtcgttaattggtatttgtttaattaatcctttttttttttttttttttttttttttttttttttgagaaggtttctcgctctgtgtcccaggctggagtacagtggcgtgatcttggctcactgcatcctctgcctttcgggttcaagcaattctcctgcctcagcatcccaggtagctgggattacaggcatacatcaccatgcccagctaatttttttgtatttttagtagagacgggtttcaccatgttagccaggctggtctctaactcctggcctcaggtgatccgcctgccccggcctcccaaagtgctgggattacaagtatgagccaccacgcccagccaaggcttctaaattttgtgaacttacctgtggctcctctgacttagagccatttttattttattttattttgttttatgtttttgagaaagggtcttttgctttgtagcccacgctgaagtgcgcttaggtgttcgcagctcattgcactctctaccacccaggctcaagtgacgcatgtaccaccaccacatctggcgtttttttcttgatagagatcgggtttcactgtgttgcccaggctggtctcaaactcctgggctcaagtaatctgcctgctttggcctcccagagtgctgggatcgtatgcgtgagccactgcacccggcccttacaagccattttaaaactggtccccaagaaggcagtggtccattactttccagttgaaactttagatatcccaaatagctgatgattagagagccagctggagagatcttgagttccttagctattagccattattttaaaaagataatctagctttgagagacctggaaatagtagtttatagcttccaacattttaaggaaggtaccattctatttggatgagttccattttagtttacaggattttatttttatttatttatttatttttgagacagtttcactcttgcccagactggagtgcaatggtgtgatcttggctcactgcaacctctgcctcccaggttcaagctattctcctgccttagcctcccaagtagctggaattacaggcacctgccaccatgcctggctaatttttgtatttttaataaagacagcgtttcaccatgttggccaggctggtcttgaactcctgacctcagttgatgctcccaccttggccttccaaagtgctgggactgcaggcctgagccaccgcacctggcctttcacaggattttagataattttactagagcataggaatgtacctaaactgttgtcaggtaaatataaaccagttttttttttttttttttttaggagctcatttataaaataccaatccgcagctttttgaaagcacgtatcttgtaatttggtaccttggtaccttactctaatttagttcagctctcagtgagacatccccctttaaaaacacatcgcctgaccatgttttatattccaaatataattgtattgggtagtgtgggtgttacagaaattacctcaatttgtgggagtttgtgaaacatcaataatagttgtaaagcaggaattgtaaaacaagactgctttataatcagtgtaataatagttctttttttttttttttttttagcacattccatgtgcctggcaagggtctgataagcagtttacctttattgactcatttgcttttcacaacaaccctatgagactcttgtcccagtgaatttaaataacacggaccaaagattcacatctttgtaatttgggagtgaacctaggcagtctaatagcagagcccactttttgtaacttctctttcttacattgcctaaaaagttaactcatttatatctgcatttttttcctaaagaaatttatttgaataaaataagagttacttcaatttaaagtaaaccataaaagagtaaatagtgaaagaatgtcatgtttcccaccctaaatttggaaagaggcactccttaaatttgcttattttggggaaatacaaagggagcataatattttgataaatgggattcgttttctagaaaagccattcctgttgaatcatgttagcattttatggtaatgctaatcatggtgtatttttcattcactgtgtatttagtaggtagtaaacctggaacatcctcaaaagctggatgtgattaaagttttagtttttgtttttgtttttgttttgttttgttttgttttgagacggagtctttgtcatccaggctggagtgcagtggcgcagtctcagctcactggaatctccgccttttgggttcaagagattctgctgcctcagccttccaagtagctgggactacaggcgtgtgccaccacgcccggctaaattttgtattttttgtagagatggggtttcgccatgttggctaggctggtttcaaactcctggtctcaaatgatccatccatctcagcctcccaaagtgttgggattataggcatgagccaccatgctcggcctaaaagattctattttaactaattgttcacatttatagtatatagtttctagaaaagtagatataaacatggatgttttattcagagtgctataaagtagcatacaatgaatacttcagtttggtccacagtaaaaattaataagccttgctgatctcaaggttagttactactcttgatctttattaactctatatcttttccctgtcaaatatcttaagtatgttgacaagttaatccagtttttccaagaatgtgcatagcgtatttgagggcaggatcaagcctcaaggattcagagaaatggttttaaattaaatcaatgtgatttagtgaatgggcaggtgtttgtacagcctatgatactgcatagacattaatatcctagagtttgaatggttcagatgaaaatatttcagctttatttttgttaattctactaatttactttgctgcaggagtggagtcaacatatcaatggagcaagtcacagtcgtcgatgccagcttcttcttgaaatgtaggagtttgaaatacctttaaaacatccttatcgtgaatcagaatcagccattattggtttttgggagttcatcatttacttgtaatatccacaatgttaatatcacatagtggtactgtatggacaatactatttacaagtaaaatgtttagatctggaaatttcatattgaatattagatgcagtaataatattttgttatttaacatttctaggatacatatatattggtcattatacaaattggtgatttttactagacatagtgaaagatagtatttgatatgtagagtggattaaacagtagcatttttaataatacatgctctaaaaatgtaaaagatacggaaaagagggtaggttattaaaagattctaattcattgtccagcaaaatccttggtgatgaattttttttttttttttgcttttgagatctttggttttgagttcaggctgctaccatgaaatggaattcctaaagaaactccctgcttaagcagcacacagtgcccattgttcactggagttggaattttcacatatgcctaactctgttggggctattctttctttctaatgtcacaactcaactgtgctcttggtattaatattggagaaggaaaatctgtgctctgttcttgtttctatgtaacccacatttctaattctttgtgcggcacttcctccttacaatttaacaaatagaggaaaaacttaatttcaacattatctgcatttgcaagcaatacaaaacaagtttattctcgtggattattttgaagttctgaaatttttcttttgaaatatctattggaaatgctttaaaactatgtttctaacacttagactctcagataactttactaataaatgatctctattttagaggccaaacaaggctgttttgtgaaaaggacagttttattttaaagttaattttctggtctttttaaagctacccagaatggaatcctgacaatgatacaggacacacaatgtaagttaaattttttaagctaccatttgtaaaggagatcaatgtaaggaattcaggtttcactttcaacatttcataaacaaagtattttcagaatttctttactgaaaatgagactttgataaaattcactttggttaacaatttttagaatatatattatgtagtaatttgtattcttttattgttaatgtagactttgacctagttacttcacagatactctgaaagattgaagtggttgtggtcatatattggggtgctttaacatttaatcttaattctttccaatggacctctttattatgatttatattttatgtcttcactttactaggggtgatccattcatgttgcagcagtctacaaatccagcaccaggaattctgggacctccacctccctcatttcatcttgggggaccagcagttggaccaagaggaaatctgggtaattatataaaattcatgttacttttccctacagagccgttact

SEQ ID NO: 117788 - DNA, 1550 bp, Homo sapiens
tctcatgcttcagcctctcctgagtaactgggattacaagtatgtgccaccacacccagctaatttttatatttttggtagaggcaggggtttcgcggtgttgcccaggctggtctcaaacacctggcctcaaatgatctgctcagcctcccaaagtgctgggattacaggtttgagtcaccacacccggccccattctgaaaattaaaggcaatgattataggtgaaagaaggctcattcaaatattacacagaaaaaacattgcatgaaaagtgatggtaatcatatatttgtaagagcttttcatttgtgtttggaagatgcacgtttttcagtaaaattgcttctttaagcaagtatagtgattacaagactgaaaactttctcttcccataaaggtgctggaaatggaaacctgcaaggacctagacacatgcagaaaggcagagtggtcagtaatgaagcttttggttttactgtatttatgatttttgggaatatgatttgacctaaatccttactagttgagtatgtatcgtggtccttatgggaacattgctgtaatttgaaaacaatcacgtttttctatggctttgataacagttaaaactttaaattttgtatgcccatagtccagtgaggtcaccttaattcagcatcttggaagctttgctgtccagttacgcgtacaatatttaatttaaaaatcactacagagagtatgttttgacactttgaagtagtttaaccgtttggttatggtcagaaagaacttacccagtgacgtttgatatgtagctttaaaattctctagaatgttatgagttgttttacttacactctcctggttaattatagattataaaaagtcctaatgcgtaattggtttcatattgctttaaagagacttaattgcttggtttttttcccctaatggataggaaactagcagagttgttcacatcatggattttcaacgagggaaaaacttgagataccagctattacagctggtagaaccatttggagtcatttcaaatcatctgattctaaataaaattaatgaggtatgaattgaaatattggtattattcatttattcatgccactaatatatgttctgcaagaattaaatgattttgtattagaaaaataaaactcaaggtaatcttaagtttatcaaatgcagaatgtagtagaggaaaaggccagtagttgatgaatataatagggtactaatggattattagtaactataaattatgatccttaggtagtaattgtcattatactactataaaagttgtaaaaggaaaattctgtggaaagccatttcagatctataccaaaatgatggtttcaagtcattatttttagtccaattggcatagtaaatgataaagtaatgcagtagaaaattaatctgaggtggcctttgtaataaaatagcaaattggcaacactgttttttggggtttttttgtttctttgttttgggagtcggagtctcgctctgtcacccaggctggagtgcagtggcgcgatctca

SEQ ID NO: 117789 - DNA, 1041 bp, Homo sapiens
atgtgagaaagctgattggaaaaaacagagaaataactttttgtataatttcaggcatttattgaaatggcaaccacagaggatgctcaggccgcagtggattattacacaaccacaccagcgttagtatttggcaagccagtgagagttcatttatcccagaagtataaaagaataaaggtaatgtttatttttttcaagctgtatatcagtttaacaaatgattttaatagttattaactgtggttatttcaaattattgctaaggccaggtgtggtggctcacgcctgtaatcccagcaccttgggaggccaaggtcagaaggattatgtgaggcccaggagttccaggcaagcctgggcaacatagcaagacctcgtctctataaaaataaaacaattggtaaagactaggatgtttttaactgttaactaataattattgcacatttgtccttttgttgttgttatttattaaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggtaatatacataaggaagttttagagaagataatttattaaaatccttaagatttttcaatatggagctgggcgtcattcctcaacctgtaatcccagcagtttgggaggccaaggcaggcaaatcacctgaggtcaggagttcgagaccagcctggccagcatggtgaaatcgtatctctattaaaaatacaaaaattatccaggcgtgatgtgcctgtaatcccagctacttgggaggctgaggcaggagaattgcttaactggcagggggcggaggttgcagtgagctgagattgcaccactgcactccagcctgggcagcagagcgagactcccaactcaaaaaaaaaaatttgcttttttttttttttttttttttttttttaaagta

SEQ ID NO: 117790 - DNA, 1149 bp, Homo sapiens
ataagttattgaaagagaacaacctttttttctggtctttaatggcagaagtttttaaacgagtcttccctaaaggacaccttcattgctcttatctgtttaagtttttcatagcgttctgctaccagaatgttttattttccacttctctgttggtatggtcatgatgaatgtctgtaggcagcttaggttctcaaataaggttacgggaattgaataagctgagttgattatagggattgtctccaattattaattcactggataattgtgtattctgcaaatgtgttaacttctgcaaaacttttgtcttttagattccaaacagaggcattgatttactgaaaaaagataaatcccggtaatttcattttgtttttcatatgtgtgagtatattcaactttactttttcagacaacaaattaattgtggtgtgtccttttgatttcagaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtaaagaaagatacattgatttgttttaatagaacattagatcagatcagtatttcaagttatttacctaagcaggatcagatagaattatatgatttaaatcagaaaataaatcagatatgaaccagaatataaacatttaaatctaaactctgcaataaataattaaataagacattttattatagttggcaaaaaacatcagctcaaagaggaaacttttcagtaaaaatgagggagaaagactcaaaatatatgtgcttctgtattgtagtggtgtagtggtagcatataggtaggcagccttatagtgtagctttgaaaaaa

SEQ ID NO: 117791 - DNA, 1932 bp, Homo sapiens
gcactttgggaggccgaggtgggtggatcacgaggtcaggagatcgagaccatcctggctaacacagtgaaaccccgtctctactaaaattacaaaaaaaattagccgggcgtggtggcgtgcgcctgtagtcccagctactcgggaggctgaggcaggagaatggcgtgaaccagggaggcggaggttgcagtgagccgagatcgcgccactgcaccccagcctggtcgacagagcaagactccgtctcaaaaaaaaaaaggcaaagacgctatccgtttcccttcaagtaaagcagacagaagggatgctgcaggataattgttgcagagtaaatttgtctttcttaacagcgtcgttttccagggagtatggaaggttttgtcactctagatgaggttggtgatgaggaagattcggaacttcagaaacttcgtaaatcgggcatggcatttaaatctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtgagatttaagtctttgttcttcaccttcctcactctcctcaaaacaaactcttaggttttaaaataagattttaaagttggtcttacataagctgtgatagcattttaaatttgctttgtttctatggggaacaatttataaatcttaattgatatattttcctctcatgcatgtctctgattttgtattattttctgttgttattccacaatgtgttcccttttttcgtaaaatttcttgcaagttacacgcttttgttttgcttttctgtgttgtttttctgtattatatttctttttttaagaatacagttaggtgagacctcaaacatcaattaggtaaaagcaaaatatggttcggtttttgttttttatcttaggctgtattggacttctcaaaaacatgttgtttcatttaaattatgttgacaggtgaaattgtgaatactaaataaaatcttcagtttaatttgtaagaatgtatgtttgtatttctaggtatagactatgtgatacctaaaacagggttttactgtaagctgtgttcactcttttatacaaatgaagaagttgcaaagaatactcattgcagcagccttcctcattatcagaaattaaaggtaaggttgaatgtaaaacagttcttttgtgaaaacttaacaagttatggaaataagtggggtatataagtaaaatgtgtatagtgttctctctagactcagtgcagtgctttctcctgaagataactttttatttacttttttttttttttttaaagacagtttctctcttgttgcccaggttggattgcaatggtgcaatcttggctcactgcaacctctacctcctgggttcaagcaattttcctgcctcagcctcccaagtagctgagattacaggcatgcaccaccacacccagctaatttttgtatttttagtagaaatggggtttcaccatgttggctagcctggctggtcttgaactcctgacctcaggtgatccacccacctcagcctcccaaagtgctgggattacaggcatgagccaccgcgcctggccttttctttctttattgatgggttatcaaaacatctgttgaacctcttgtcatagtttacccttgctacataacaatttagtgttttctaaccatattataaattctgtggtagaattaaacttattcaagtattctcagattgttgttgg

SEQ ID NO: 117792 - DNA, 2430 bp, Homo sapiens
gcctggccaacacggtgaaaaccccgtctctaccaaaagtacaaaaaaattaactgggcttggtggcgggtgcctgtaatcccagctgcttgggaggctgaggcaggagaatcacttgaacctgggaggtggaggttgcagttagccgagatcacgacactgcactccagcctgggcaacagagcaaaactctccctcaaaaaaaaaagaataaaagtgcatgtcatttaaacccatagttcttgaatagtgtcagttcagtgtgactgtggtctttgttttctcatctctaaaaattagggttaattataacatttgaaatacccattttataccttttaccattttttccccgtgccttattgtaatgtcctgaaagtttttgtgtgctaatgaggattaactaattgttgaaaatattgacaaaattatagtttaagtccctaaacttggatataggatatttgattttggaattaatccattttgctgcatttctcttaggtgacttaatggctgtaattctctttctttatagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaacgtatttgtcagttgtggtttttattcgctcttaaactttgtgcatgctttaacaatttattacttttaaatctagagtgaattctaaagactgccgctaaagatctgagttttaaaaatgttgttgctggtggatttcttgttcctgttacataactaaaagtgaggccatttgtggtttttaaaaaccttatgaattaaaaatgctacaggtgaacaaacagaagcttatgtttagagatattgatgacttaacagtacaattggaagtaatacggatgagcaagaattagttctgcagcttttcaaaataattacgtagagactcttggtatattggattatctgttgtaaacaatttttttttcttccctgacacagggtctcactctgtcacccagactggagtgcagtggcacagttctctgcaacctcagcctttgggctcaaatgaccctcctacctcagtctcctgagtagctgggactacaggctcatgccactatacctggctagtttttggtttttttgtatagatggggctttgccatgttgcccaggttgatcttgaattcctgggcccaagtgatctgctcgcttcagcctcccaaagtgctgggactgtaggcatgagccaccatccctggccaagaaacaaagttttaatttcaaaaaaatctacaaaaacaggataggcattgtctttcaaatgttcagaccccagtttattaaaggatacttcaaatagttggctaaattttatgatctctcccgttgaaaagtaggtgatgattt

SEQ ID NO: 117793 - DNA, 2567 bp, Homo sapiens
tcgttggctgccgtccccgctgctgtgcattgggtgaggggtcctctcgggcagagtggcgacaggggtgcggaggtcgagggacagcaagtcggcgacggcagaggggcctaaagggttccctgggtggttggccaccgagtccattgcggcctccgttgttcattgcctctttccaccaagtctgagggatgagcttgggccgacttcgtctctgtcttctccgagacatggccgtcgcttttttttcattgtcattattaatgatttggatctcgcagctctctatccgggtcctcagtggcgcgagggttgccgggatagcactttctcctgttcctcattctcccggtcctttatccctccgccgggtaccctttcccctgcccccctcccaccgcctcggcaacaaagcttattgtttctacccactttacgcctgcgcgtcgccacgcgcagcccctacttgctgcgcgtgcgcgcctcagccgaggctggggtttggggagagaggggcggagggactggcgggctcttggcgtcttgggggaacgctgcaaccgtcgacgggcctgatcagaagatcgtctttctcccgtttcttcgccatcgctaccccttatttttggttgtattgcagctcatgccctggaaaaaagaacctttggggtactgggaacccttaccctaggagggcgttgagttagatgaactttaaggtcctcttaccttttaataattttctgtgcttactctcctccttccccaccatcgccaccagaaataaataaggcttgtggtgaacttaggtcttcaaaacatttgttgcagcagccagcagtgatattttttagggactcctaaaaggggtcttacctgcttccttttgtttcttttttccctgatttggcacccgtatcaactcataaaaaccccaaactctagaaagaatttggcttccaatttgccttggaaggtgtagcagctgacagcctttgacgtttatttcaacggaaagtagatgttcatgttgggtgtgctggctaatgttgaaacgtggtggcattgttttttcacagatttcattagcacagttagatcaggtgttggtttatattttcattaagtcgcttttgaaatttcttctggcgtaggttgtgtttgcaataagtaaaagttctctacaataatttttaatgagactccactatttgcttttgtgattctgtttccagttagtgaaagacaggatatttggggaaaattagtctgtttatactacttgtcagttgtgaacttgaataaaactttttcacacacacacaaaatcacaggataggtaacttgacaagaactatagaacccacttgtgtttctttaagggatggaggttagggaatggagatttcctctaatgattcaaggctgtgcacgttgctccttaggaactcaaattgaggtaggtaatttcaccctcttttggtcagaatgagtttatagcaggcttttccttaaataagcactctgcactttattcaggtttatcactttatgactctagagtgtgatgctccagttttagtgaaaaacttgaacacttagcacagcaatttggttgatactgtgggagattaaagaatgtggaaggcaagacctctgcccccttgtaatctaataaccttttgtgcttttaaaacattttcttgtaatttacatcctattgtcattcattatcatgaaacgtgaaatgggcagagcaagtttttttttttttttttttttgagatggagtctcactctgtcgccaggctggagtgctggagtgcagtggcgcaattggctcactgcaacctccgcctccccgggttcaagcgattctcctgcctccgcctccctagtagctgggactacaggcgcttgccaccacgccggctaattttttgtatttttagtagagacagggtttcaccgtgttagccaggatggtctcgatctcctgactttgtgatccgcccccgtcggcctcccaacagagcaagttttatcttgcccatttgggaattaaagaaatagaagcctgaaagattatttttatttagcaaatatttatataacaataatgccaggcattgttctcattgcctttacaaatattaactaatttgatccacaacatagctagaaggtaggccctactgtaaaatgaagataacaaatgagacgtgaagtaactttcccaatgtcacagagctatgatagtcggaattcaaatccagatagtccagagattctatgctcttaaccattatgtggtgctgtgtgatttagtgacaggtctagggtactttaaggtggctatgtagcatagctgggatttgaacctacgtcttctgactgtggtctaagattaaagttgtccaagtcattgcctttgtgatctagaccacctgttgcacaggtgcatgaatagtttgcatttgatataggctaaggttcagttccaaaaaactcccttttttcttaattttttcattgtttagagtggtgctgtccaatgatgtaggtac

SEQ ID NO: 117794 - DNA, 1033 bp, Homo sapiens
ggatcacagtggttcaaaacagagtccaagggaatgagaaaagatggtgcctatggaggtagattaatgaaagaaacagaagagaactatgcttgaatttttttttttttttttttgaaacggagtcttgctctgttgcccaggcctgagtgcagtggcatgatctcatttcactgcaagctccacctcccgggttcatgccattctcttgcctcagcctcctgagtagctgggactacagacgcttgccaccatgcctggctaattttttgtatttttaggagagatggggtttcaccgtgttagccaggatggtctcaatctcctgaccttgtgatccgcccacctcggcctcccaaagtgctgggattacaggcgtgagccaccgcaccaggcctatatttgaattttaatgagaattcttaaaagatgaaactagtggagaaagattgtaaaacctaaaagatttctgtattttaaaattccatagacaatataaaaggacactgctggaaaccaatatgtctaagaggcatttcaggaggggaaaaacagctgaagacacaataaagccctaagttgataaattgaaagggtttgctgacttccaggcagtagtactgggaaaaaattgctcttacctatccaaaatctggtgaaatatatgaatttgttaaaacatcttaagctgtcgtctagaacaggatttttaaatttttatttatttttttgagacggagatttgctctgtcaccaggccggagtgcagtggcgcaatcttggctcactgcaacctccgcctcccaggttccagtgattctcctgcctcagcctccccagtagctgggactacaagcatgtgccaccacgcccagctaatgtttgtatttttagagacggggtttcaccatgttggccaggatggtctcaatctcttgacctcatgatccacccccttggcctcccaaagtgttgggattacaggcgtgagccaccgcacctggcctatttttattttttgagatgcagtctc

SEQ ID NO: 117795 - DNA, 1887 bp, Homo sapiens
agatgttttaggctgtcctctcctgtttcttaaaacattaaaatcatttggaaaaaacaaacatgaagctttccaattattcaacttaccgtgtatttttaatgtatcatctgcctctaacacctattcatgatgcctgctaataataaacagatgctcactaagaactgaaagaatcagctgggcctggtggctcatgcatataatcccagcactttgagaggcttgggtgggaggatcacttgagcccagaaatttgagaccagcttgggtaacacagaccttgtttctacaaaaaataaaaaaaattcagccgggtggtgtggtggtgcacacctgtagtcccagttacttgggaggctgaggcaagagatcgaggctgtggtgagccatgatcacaccattgcactccagcctggatgacggagtgaaaccttgtctcagaaagaaaaaaccctgaatgagtaagtaaattaactgtgctgttgttcttttaaggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaagttagttttttgtacaaacatgtttttatagtccattctggccctcaatatgattgtacttgtccctgaaatgtgtttatcttgtcctttatgtataaagtatgtagactgatgtgccaccactcctgtttatttggctgctgattactaccaggcttaactgcttacggaaataacctggggagcttgtttcagggtcccaccctagagatgtctgaatcaggaggatgagggtggagcctgggaaactttttcagagctctcagatggttccattgagcagtcagatgtggaaaccactgccttatgccagtaagattgctggttaccgtgaaagtcaagagaattcaggagtcaggagcagacaggcacagaaaaaagagacaggcatctctttttacttcttccctgccaccctcaatggaaaaaagaatgttctactaataaaagtaaaaacatagaaaaaccctaaacagatagatcttcgccggtcattatggtaagcattttttttccttagcatggaagcagaaaagaaagtatgactttgtgcctttaaatggtttagttcaagatattttaagccattcctagtgatatctaccaagtgtgctataaattatcctttattataaatctagatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtaaaaagttatttttcatctttttaaaacctagtgcatcttttgcataagtggaaaagccagctcccatctatttaagaattctacatctctttccccttcagaaattgtgctgcttctggccgggcatgtggctcacgcctgtaatcccagcactttgggaggccgaggcaggcagttgacttgaggtcaggagtttgagaccagcctgaccaacatggagaaaccccatctctactaaaaataaaaaattagccgggcatggtagcacatgcctgtgatcccagctactcgggaggctgaggcaggagaatcgcttgaacccgggagacggaagttgtggtgagctgagattgcaccattgcactccagcctgggcaacaagagtgaaactctattaaata

SEQ ID NO: 117796 - DNA, 1101 bp, Homo sapiens
gggacgccgaggcacgcggatcacgaggtcaagagttcgagaccagcctgaccaacatggtgaaaccccgtctctactaaaagtatacagaaaattagctggttgtggtggtgcgtgcctgtaatcccagctacctgggaggctaaggcaggagaatcgcatgaatctgggaggtggaggttgtggtgaaccaagatggtgtcgttgcactctagcctgggcgacagagtgagactccacctcaaaaaaaaaaaaaaaaaaaaaagcggggtggggggaattgtgataactaaacatcagcactagagtgagaactggctgggtccactgaactaatctgtacaccatgattacctatgaagcattaaatacaaaaatcagttctttagttacatcccaacatgctcagttgtctgggcatgttaattttttaaaagtactacagaggatttattatacagccaacttgcctgagtcggtcatttggaaaccattcttctaaaggatggtgtagagagcactgaagtttacattgtggtatatagcctttgttgcagtaagtgatggtaacccatttgagcagctgtatgatctgaatagtctggaggggggtatgattacttacggctacattagtcaccataaataatccagttgccctgcagagtaacactcttggctgagcataatgtataactttaatctggacccagtataattccatagtacagaagctggtttgttcttctcagtctatttgatattactttgtttcattcttctgttgctcccagaaaattgttcatttaagaacactgtgcctggatgtggtggctcatgcttgtaatcccagcactttgggaggccaaagtgggaagattactttggcccaggagttcgagaccagcctgggcaacaaagggagaccctgtttctacaaaaagtttaaagttagctgggtgtggtggcacaggcctgtggtcccaggtacttgggaggcagaggccagaggatcacttgagcccaggaggccgatgctgcagtgagctgtgattgttccgctgccctccagtctaagcaacagagcgagtccatgtctca

SEQ ID NO: 117797 - DNA, 1065 bp, Homo sapiens
ttgcttaagtgtaaccagaaatccagtaacttcacataagttaaaggaatagcacggaacaaggaattctgttaatcgaactatggtatgtagctttctttaaacactaaataccaaggaaccatgttaaacaagtgttgaaattatgattaaagtaactggggaattgctgattttactttagaatcctcactaaaaatgtggagttgtttttctacaattgccatcttctaattcccacaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttgaagaaataattttagtttcgtaatttatacatagcagtttctttggacaggatatattctcccttcccccaagggaaataatgtatctacattttaaaagtgtgaagtttaagaaaaaaaagcagcattccttttctctttttttgagacatggactcgctctgttgcttagactggagggcagcggaacaatcacagctcactgcagcatcggcctcctgggctcaagtgatcctctggcctctgcctcccaagtacctgggaccacaggcctgtgccaccacacccagctaactttaaactttttgtagaaacagggtctccctttgttgcccaggctggtctcgaactcctgggccaaagtaatcttcccactttggcctcccaaagtgctg

SEQ ID NO: 117798 - DNA, 1092 bp, Homo sapiens
ggactggcactcatctgctgactaacttgtagcctcagtaatatgacatacttgcctttaacaaattatctcaaattaactaacagaccttcagaaaatggagattctttttgatggggacataatcaaatttaagtctgagaaatatgcttaacagttggaactcaaattaaatgtactgattttaaagtttagacattaacaagtgatagattagcctcaaaaaaagacaatttggtaaggtttaggtcttttaatttggtgcttgttcacaacttgactggtgcttctttccttgctgtcttcacatcaagccatggggccaattctattttcagtaaatgtttgacagctttttacttagtaacagtctcagcacttttattaagcatgcaagactaacaaaaactttggcaatgcataagtgtaacacagtgacaagagagcttttacaattaagtcttctaatactgccttcacagtgtggaaattgtgctacatccaccaaaagagggccccgtctactcaaatatttccgtacttcaccccaggaacaaactcctttgcatttggattcagattgctcttgacctggaaaataagtacataaaaaagcaagttcattaacacagtttcaggtactaattcaatctagatcctcatgcaaaaacatcttccaaaaaaaaaaagacaaaagaactcagtctgtaagactatactaaaccccaaaaaggaagaaccagatgtaagctatatatcatattaaattacatcaactttttcttttctttttttgtgacggagtcttgctctgtcgcccaggctggagtgcagtggcacaatctaggcttactgcaacctctgccacctgggttcaagcgattctcctgcctcagcctcctgagtagctgggactacaggcgcgtgccaccacacccaactaattttttgtatttttatttatttatttagttttttttttatgagacggagtctcactctgtcacccaggctgcagtgcagtggcgcgatctcagctcactgcaagctccgcctcccgggttcacaccattctcctgtctctcatcctcc

SEQ ID NO: 117799 - DNA, 1853 bp, Homo sapiens
atcgcttgaacccaggtggcagaggttgcagtaagcctagattgtgccactgcactccagcctgggcgacagagcaagactccgtcacaaaaaaagaaaagaaaaagttgatgtaatttaatatgatatatagcttacatctggttcttcctttttggggtttagtatagtcttacagactgagttcttttgtctttttttttttggaagatgtttttgcatgaggatctagattgaattagtacctgaaactgtgttaatgaacttgcttttttatgtacttattttccaggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgagcagatggttgtgtttattggtgctggaatgtactgtagtggtgttactcacttgagtatgggcccagtgcctcaggacaatcttgctggcaaaatgtgctaagctttcaggctttgttagattctaacaggtatgttgccatgcaagtacctttccagaatatagcagtagaataactccattgcccatccttgcttcttaatcacctcagacttcagtgtcaggggaatcctagatagtcatgtaagaaactttatggctgaccaatatgatggtgaccttactctaatagaacctccattgttttttgttcttcacaagggctttttttgagcttattaggttgaaaaagattaagagagccatatagtcagttctgactcacattcttctggcagtgggtatgggggaggttctttggtgtgggcacctgtaccccagtgtgtggttggttggttggttggtttttggagacggagtcctgctctgttgcccaggctgaagtacagtggcacgatctcagctcactgcaaccttcacctcccaggttcaagtgattctcctgcctcagcctc

SEQ ID NO: 117800 - DNA, 1118 bp, Homo sapiens
ggggctattgggcacgggcaacgggtccacctcgtccagtcccaacattggcgtcctgggaattaccaaggtgtcgcgacgagccagagccaaatcctgccctaattccgtgggccgcaggccccgccccaactcggtccccactttggtttagccccaccctgtctttgagaggcctcgcccccgcatcaagccccagccggtttatgcctcgctcttataacaggccccgcccctggaactaaccccgccccagcctcgtccccaggtctagcttccccgctggctccccggcaggtgggcagccggcgcgtggtgcagtatggtgcggctatcatgctggtcctgggcaccatcggcaagttcacggccctcttctcctcgctccctgaccccatcctggggggcatgttctgcactctctttggtgagtgtctggcgcgggccacgggtcgcggtgcgggtcgccgagtgggactcacctggattacgcgtgtgcggcgcctccagccgttctcttgcgcccttaggcatgattacagctgtggggctgtccaacctgcaatttgtggacatgaactcctctcgcaacctcttcgtgctgggattttccatgttcttcgggctcacgctgcccaattacctggagtccaaccctggcgccatcaatacaggtgcctccagctgtttactgtctccaaaggcggggtgggcccaaaattttgagcacagccccctccctcaaaggctccacacagctacagccacaaatcgtacccaactctgggtgtcaaccagcagctgagagcttgggtcacagctgtcctttactaagacacttcctgtggacagatattgacctttacatgtgcttatttaattttcaaaacagctccatttatctacatttatcatttctccattatcatttcaactttacagatgaggaagatgaggctcagtgatttgtcccaggtgaacaactagcaactggcagaattgggacttgaacccagagataggaaagacagagataggtttgagacagggctttgtactgttcctttgccatagctgcacaagaggaagtccctcaactctgctctccagattgggcc

SEQ ID NO: 117801 - DNA, 1988 bp, Homo sapiens
ggggaaaaggggaggcccagagacctggaggtctgagcaactgtcccgggtcaacaccagggtgcagccatggcagcatcttctctccctctctgtctctgtacctggtccgtgtgtgtatccctgactctacccccagaggagatctacggtaactggagtctgcccctgaacacctctcatatttggcacccacggatacgggaggtgggtttgcatgtaagcatagaagaggccgggtcctgaggaggggctatatgggagtgagggtggccgctgagtttggggatttgaggaggtggtccaggagctttgttcctgctagcagcagccaggtcatgacctttacatggtgacttacggctgatgtttgcccttccaggtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttggtgagcaggcaccaggcctgatccctgcccagccccagcaccctaccctcttcatgtccttggtccttcttcccggctcctggccccagcctggcctcccatccacttcctgattgtgcctctgcccccagctccattctcctgatcatcctcttctcccagtacctgcgcaacctcaccttcctgctgcctgtctaccgctggggcaagggcctcactctcctccgcatccagatcttcaaaatgtttcctgtgaggacctggcaggcggctggggctgggactatggccagggcttgggctgaggtgggagcaggttagcctggacagagacctccagtgccttcagtgccccctcacccccctccttcagatcatgctggccatcatgaccgtgtggctgctctgctatgtcctgaccttgacagacgtgctgcccacagacccaaaagcctatggcttccaggcacgaaccgatgcccgtggtgacatcatggctattgcaccctggatccgcatcccctacccctgtgagcaacaccccttgggcccctctgcccccaactgagaccacctatgagacagactcctggtgaccccaatccagcaggtgacacacctagcattagccgcacatttatagtgcgcccagcagagtggtgttttacttagacaaagcttcagtcccacttcctggctctgagtgactcaaataagctcccacaactgtatagctcccatcccagcctgaggtctcctgatctgctcttgctccttccagcactgccctgtctattcctaaccatcacagtctcctcactgtagccaccatcctgtctccctccgagcacaggtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggtagcctacctgccctcctcagtatctgatctcctcaggcgccacccaggaagcacacacaggaacggggtggaggcccagggggtaggcttaggcaagtcgggaacacgctccagacctcattctccttgtttgtgcgatgggggtgccctctcatcacccctctgtctttgctgggagtagctgagaagatggtggagtccaaagggaaccaccgtcattgacagccctccatgtgcccggctctgactgtgcattcttatgcaatctttgaagcattttgtgagacgggcaccggtatttatcccaggaggaaattgaaggccagaattacccacaggagtaagtgccagggcactaggactagctctggagcctgagcattctggcctgtagtagggagtgctacagctgatagctgca

SEQ ID NO: 117802 - DNA, 1366 bp, Homo sapiens
gggcctggccatgggcacagcgacccagaagtaggtgggctctagagtgctggggctggggcagcccagaggggaacagaatggggacctcaggcccagccctcaccagctgaggagcctgagttcttagggcccctccccatgtccccctctgccatctcaggccctagggccaggctgggctgggcctgccaggaggggagacaggctgggcataggactgccttcctgggctaggtgatgggcagtcacacagggcttggtgcatagaaaggccccacgctccatctaatgctcctgctatctttaaattctttatacttttggaataaaggcctcacattcttactttgcactgggtcccagaaattatgtggctgggaggggaaagggatctgtgccctgacacagagtgcagacccggctgggccagcctaggcagctctgcctgcagaggcccatctgctgcctgcctcagggaccctgaggggtgcagggtggtgagggcaaggcagctcagaccaacctgaattttaggattggtttctgcaaacttgctatctgcatggcttgggtcaaatcacatctactgaatctgtttccttcgctgttaaaggggttaataccgcccagcacaggggttacttgggacagtgcagatccatgtttcttggcacaaggccaaggccattcctcaataacgagaatgactatgatgatgatgataatgatgaactagttattaatcagtggggaagggcctcatacagggggttacataataagtgcctgtttccactccctctttctccgctcacctggggcttggtaaacttctggtcctcaccccctcgactctggccctctcttgggaaacaagaacaggtccagcgcccaggcgcagatgtgggcagggaagggcacatgtggcagaggcttgggtggcttttactgtcctagtgagagttaatacattacctctgcccgggcccccctttcgcaatccagagctgggcatctggttacagatttacttcaaacaatgcctgatatgtggagtaaagtcctcctccttggcctttgtcaagtcatcccctcttctcctcaggaactgctcaaacctgtgccccaaagatgagggcccaggaggacctcgagggccggacacaggtgctgggggctgggggtgggggctagggggggcagggggggtggggggctggagggcctgtgcaggccttcttcctggaggccagagataaacgttctgatgaacttgataagagtgactgtcccaaattgaatgtggcaactgggggatgggtggaggtgggggtgaaggagcctgcagctttgggactggctg

SEQ ID NO: 117803 - DNA, 1045 bp, Homo sapiens
ggccctggagcaagagcactgccccctcctgtgcacttggcctcaaaccgacccaggacaggctacactgggctaatctgacccctgaagtgggtcctctgcctgggtgtgtccccatgatcacctagggggcactcggtgatggcttctgaaaaaatgttgctgctccatcccatccagccctgcctgtgcaacttgtgcaaattgaggtcccttcccagattgtttctccaccttaaaaccacacacagcattgtcttttctcttcctcccattgtgaagctcccgtttgggggaggtgtcagcaggtgcaaatgcaatttgcaggtataacattattgtcatgtgatggaaactgacttcccaaattccttgtggttctggaacccactgtctttgaagtttctggtcagggcttccggccctgtagtcaagttgggaagttaaatttaccaggacactgggagtggggtggaatattactgggtaaccagggctgtttatataggaagggattaaatacccaaaggaagcggtggtgcctaccagacaacaaagacccagctcctcccctaggctacaagcccccaccttgtggacccctaccactatccaagagggagggaagtagcaggggctagaggctggggactcccagagcagagaaggcagaggctggggattacagccagagaacaggaaagcggcggccattttatttttccctgggatgctggtggctgcgggcctgacgtgtccctgaggctttcttatgcttctggtccagcacctgggccatgtagctctcctgctgcttctggatccggaagtcagacatgtgattcctgcaacggagccggctggtggtgggctgtggacagccaagggtaggtaggggccagaggtctggctccccagtgtcatcaacaacccccagccgggcccagacccctcacctgaagatctgtttctgctggctgataacttgctgcaactctttaatctcattctctttgccattaagtatatcttcttgctttataat

SEQ ID NO: 117804 - DNA, 1042 bp, Homo sapiens
cacagacgtgcctagcatggctcatcaacatctgaacggttgttccctaccatgcctctgcaggcattccacagagtcaggagatgggttcacaggtaaagattgggggctttagtggcttgtaggggacaactgctcagttgcagggagagggagcatttctagaaatagccagattttgctgcccaactagatctgtcctcctggttttagggggcccttcttgatcccctctgagtgactgagggaggttacattgtaaaatatgtccatgagccaaacaggcttatggaaagttcttctacacacaaaaaaatcaaagctctcctctccccatccccaaccactgctagaaaattggccataatgaaactgacttgacaggttaaaagaccctgtcctagatgcccaggaatcaggtagtcacacattttatggacttcatggcagcgataagtaatctgtgatgatactaaatagaagcaataataactaactccattaaatgtcacgctgattgtctgtttttatagcaccgatggtactgttttatttattgccaatagaccacaacattcacatctgtttttcctcaagggaaccgtatttgcttttggttgaaggatttatctatttgatactatccagaatattgtgaagctataatttcctgggttatattttagatgggttgtctgcatggtggtaaaataagctttttcctctcgcctacgtcctttggaagatctcctgatcatacataactaggtagggcttattcttgctgccggagcttggcacccagctctagactgtttctttgagcattactgcagattggagacgtgtgtgagaggagcagcgctcagaaatagggcttgaggctcaagcagaaactgaagctctcattcaaatgaagatgctctctctaccgcacgatcggcagtgagaaaaggaggatgaaaatccttctcatcacaaagagcttgaaggaacccacgtccccagattagcaaccctagagttcatctgctcaggccgg

SEQ ID NO: 117805 - DNA, 1649 bp, Homo sapiens
agtgccctggccttctgtggacgcacacccggcagcagtaggctctgtgtgccttcgcacatgtgagttatgatgcagcaatgcaggagaagaataaagcagctgtctgtttcagatgacaggaataggccactggactccattctctcccagctgctgttggaatcccgtttgtaggaggctatagggtggtctcactgcacatgcgcaggtttcctaagtctggtgccaaatgttttcttggtaagaactaagtccagtgcttttataagagagcacagatactgttggactgcagggtcacaggtgccctttaatcctccacacctggtctagtacctaagacgtgttttgtgaataaatgactaaatgtttcttatatttaattgtaagaaaaagcttgaaatgaagtaaaaggagctttgactccagaaacattgaaatgaaacaaaggagttcagctcttgatgaattggttacctcttttatctttcagagtcagagctgacaaatttggcaggattatacagagatgaacgattgaaacagaaagcagagtcgctgaaacttgaaaactgtgagaaactttccaaactcattggcctacgcagaggtggctgagaggataatggtcctacgcagggctggggttttgctacttgttcctatttatgttcctgattccattttataatacaaaactaggtaatgatgaacactttactatttgctaacttcgttggttgggcagagtggcaggagcatgggcacgagagccagatgtgtcttcacaggatccttcctggggagtggctccagggaccaggagtagttcatctaagttaaattaatggcaaggcattggattccgtctccctgctccatgcctaccctgcctatgtgaatggagttcagggcatcccagagcagatccatgctttcttccttcttcccttcttcagtgaagtcttaagaaccaggcattcctaggcttagccaaagcttaatattagttatttacactgtctaccaagaattatacctctcccttcattagagtcatcatctccgccaagatttagcctttggaacatgttcctgcccagctttccattttctaggggaatatggagaaatttaaactattgtagtcaatagttttctattattccaatctctgctcagttagtagcattagcaaactgcctaatttgagattcctttatttccttaaccctctctcctttagagagtccagaaattaaaactactgagcagcatctggaggcgggggccagggcgaaggtataatgcaagaccgagcctcatctcctccacgaagcctccctactccatcatagaacccagagaatgtcccttcggtcatttcccctcagtatcatcattggtgtcatcgcacttaggctgagttcctacatcccacagaggcagatggtcagacccaggaggaggcattgccagctctccaggctgtttgctcaagcctagagatagaggagacagatcctctctccttggatatgggggtctagctttggccccagcagccactttgtttaacccagtatcctatagtttgtgatttgagatgatttttcattcattcaacatttattgagtgcctacta

SEQ ID NO: 117806 - DNA, 1318 bp, Homo sapiens
agtctcactctgttgcccagcctggaaggcagtggcatgatctcggctcactgcaacctcccaaagtgctgggattataggcatgagccactgcacctggccagaacacattttttatgaatgagagtgctgaccagttggagaacatttccccaacatgcctgggacttgtggtgactgggaacccgaactgaggggggcttcctaacttctaggacagctgggatgactacaggactgttgattgggagttaactcactgcagcagaagttcttaattcctgtgattccaatgttgttgtttctggcgatcagggaaaacctgaagggcaagcactgtggagaactttctaggcccaagcatctcttcttgggcccctgcgaagttgtccagcacgagtcacctctaggctctttgtcactgctgctgtgatcactctcagccatagcaaagactgtgtcctcatgtgctggttcttgttggttgcagcaataggaaatgcatttgcagtcctgagcaatcctgataagagacttcgctatgatgaatacggagatgaacaggtgactttcactgcccctcgagccagaccttataattattacagggattttgaagctgacatcactccagaagagctgttcaacgtcttctttggaggacattttcctacaggttagtctccccaaattatcattcttaaacatatttctttatttatggctctcagcaagctcctgtttgaaaatctgaatagaggtacaatggtatgatggaaacagcaaggatctagaatcagttgagcaggagtttgaggcaagtctccagcccccagctgtgcataattttgaccaaatcatttagtctctctgaccctgtttcctctcctgaaaaatggggctgttaataatacctacttcacagggtcactgtgaggattagatatttttaagtgccttataaataagtaacaaaatgcctattattgttgtgtaaaatagcacttacaaagatagaagataggaaagtaccccccagcaagttggaagttggtataattcaatgcccaggaagtaaattgaattttatgagttgctattaaaagataccagtgacacaatatggtattgggcacggaagcagacgtgaacatgccagataggattcacggccctaatgctctctctcttctagcctttcggggttctctctcactagttgcaaaggactatttaaatgaagtcaggagagctcagcacgctttagctccagctggttcacttggcttgcctattgtcttatttttctactgggtaa

SEQ ID NO: 117807 - DNA, 1765 bp, Homo sapiens
ctccgtcgggctcgcggcctccttggatcttgctgccggtgctggcccctcggggcggcctccataccccactcccagtgatggcgcccgtggaggccccggcgcgcagcccgcgcttaggccggaggtgctctcgcggcctcagcgttcctccccggctgcccttccaggcccgcatggtgtggactcttagggcttctctccagtctgggactgccgctgcacttgagggccattgtcgggccaggatggcggggttggggccgaggggggcgctggggcgttgggcggccccttcgacagaggtcgaaagggcttctcgccccatttctgttccctcctcccacacctgccctagctccctccacaaaaccgcctgagctcgggctgacagaggaagccgttttgcccgatccacaagtatatcctgagttcacttacctcttgggtggcagcacacatcggtccaccctgcttgtccagaaactgttaagagttggaagttcagaagaaaaaaaaaaggtgacttaatgagggaggagggaagtagagggagaatcattttattccttgaggttgctgtatgtagttagaaactaacacttccgttttgcaggattggatctaatagaaaagctgtacattggcaaaggtagaggtagaaacctgaacattgaaaaccaccagagaaattatacaaaagttcctttcacagcctcttcgcaaaatggacttgacgctattaggtgatatgtttaccgagactcttaactgggaaggggttttactagattttgtattaaaaaggatttctttgctctttaaagtgaagggttatttagttatcaataaggaggttttcctaataatacatctagactataagattggcttaaaatttattttttttccctttctgatgttgtaacctcttagtgccactttcatgttttttttcttagaagtagggaggcaccactattaatttctgtttggtgtttcacttggctactcagattggctatattaaaccggtagctacttttttcttcaatacatctttttccttttagtggagaacggggtcttgccgtgttgtccaggctggtgtggaactcctgggctcaagctagcctcctgtctctgcctcccttaagtgttggaattacaggcatcaatcagccactgcacacggcctatacctgtagctacttagaagtaggtactggggttatccattctgaatgatgggatggggatgcaagaggaagagaaccagtttttagcttgtcttaaactaagtcagaatacagattgatgatttaaacacctcagctcagcggttggtcctcatttcatttttgctcaaagacagtgtggaatcagtcccattggttactataattaggttagctccttaacttcttttgactctgatttctaacaaatgaagaagggcagattttagacaataaatcttgtactaaaatgaaatggtatttgttaaataccataaagaagcttgaaccttaagcaaagatgtcttaaagaaccgtttaaggggcaggggagcacactgaggagtagtcatccaaaaaaaatatatacatatgtattttaaaggcttttaggaattgctaggtccttatagaatctaactgggaagttatcaaatacctgtagaagcttgtcctcttattttataacctgagaaagagcaagtgggtataatgtgtaataatttacagataaagaaatgtagacc

SEQ ID NO: 117808 - DNA, 1753 bp, Homo sapiens
cttttttttttttggagacggagtctccctctgtcgcccaggctggagtgcagtggtgctatcctggctcactgcaacttccgcttcctgggttcaagcgattctcctgcctcagcctccggagtagctgggattacaggcactccgccgccatgcccagctaatttttgtatttttagtagagacgggatttcaccatgttggccaggctggtcttgaactcctgacctcaagtgttctgccaccttggcctcccaaagtgctgggattgcagatgtgagccacgtcatctggcctggcctgaacttttagaattcaatattaaccattttcccctagtttattccctagagctcttcacaaagtatggcttgacttctctgagacagctagtgataagaaaaatgaagtttattttggtataccactcaaaaagattgtgaaaacaaaatggagattaattttttttttccaaactctttgtaccacaattttaagttgaatagctgacttcctaggcatggataagatcagttctatcttatcttctgtcctagtaatgtgtctgcagtggaatccccattgcttggcttctataattgatcttgaaccttcccaattatcattccctgaaaaaataattctacttaaataccttcttgacttaaatgtcatgagttgctacatctgggttctgataagatttttctaagaaaaactacatttgacatgtgacatcttcaggaattcaatatcttgtttctttgacagagggacgctattcatgtctgtgaatttggcagtctttgaaatgccatgtcttttttggaaaaagcttttgatggactttattttgatatacatcttaaggtcccctgacctatactataagcagagcatagcaaagagggtcattatgaacattgtgtgtagttctgggcagggcttgggatcctttgggattgttggtatctacaccacatggccccaccctgctatgttttaaggttttctgctgactttttaggtcttcagccttgattttgatgctttgagtgcctgcctctagcagcaccacccccagcccttttccagttggctgcatctcatctgttgtgggctaagaaaccagatcacagagcttattaaaattgtgtctaaaataagatccagtaggctcttgactgaagagggcttcatgtgctctgtgaactgtgtggtttccttggctgatcggagacctttctgacttgcttcctgtttttcttctttacttttgctatacagatgtaggaggctttttggtgctcttagagtgctgtaatgttgaagtatttggttaatttctctattcttgggaagggtaaaaggctaaataaatatcttgattctttgaggagttgaagactgaccagagttggatactaaaagcttttcttaacagtaatagtgcattgtacattttaatggtgtcctactagttgcagataacgtttggcatacatagctttcaaacaaagtaatgccaggattatcacttgatctatttctgtgatagagattttttttctttctttttttttttttttgaggcagtcttgctcaggctggagtgcagtgtcatgatcttggctcactacaaactctggctcccagggtcaagcagttctcttgcctcagactcccaagtagctgggattacaggcactcaccaccatgcccagctaatttttgtatttttaatagagacagg

SEQ ID NO: 117809 - DNA, 1010 bp, Homo sapiens
atacttttgttcccctacttgctatagaagtagaagtagttttactggaatacctacgattttcctgtcctgtctctctcattcacttagttattttctgccttggctctggttgccaaaattctaaacttctgttttgtgttttgtgtgtgtgtgtgtgtgtgtgtgtgtgtgtgtgttttgacagggtcttgctctgttgtccaggctagactgcagtggcacaatcacggctcactgcagccttgaccctctgggcttaagtgatcctcccacctcagcctttccagtagctgggacagcaggtgtgtgctaccatacctggctttttaaaaaaatttttgtagagatagggtcttgctgtgtggcccaggctgctctcaaactcctgtattcaagtgatcctcctgccccagcttcctaaagtgctggaattacagacagccaccccactctgctaaacttctgttttgttaggtatatgatcccatggctgcagtatcagagaatgaggttattgcctttccatgtaccttatttcgttgactctgaaacacatcaattgaaagatgtaccattattctactaagaaggaaagtatatttagtgccaattaagctgacatgccattgattatatgcagcttgatttcagctatgttttatttttgtttatttatttatttatttatttttgagacgaagtctcactctgttgcccaggctggagtgtagtggcacaatctcagctcactgcaacctctgcctcccaggttcaagtgattctcctgcctcagcctcctgggtagcttgaattacaggtgtgtgccaccacacccagctaatttttgtattttaattttttaaatttttttgagatggagttacgcttttgttgcccaggctggagtgcaatggtgcgatcttggctcgctgcaacctctgcctccccggttcaagcaattctcctgcctcagcatcttgagaagctgggattacaggcatgcgcca

SEQ ID NO: 117810 - DNA, 1411 bp, Homo sapiens
tccagcctgggcgacagagcaagactccgtctcaaaaaacaaacaacaaacaaacaaaaaaaacagtatttttggctctttaatacataatacatgttttttgtttgtttgtttttttgaaatggagtctcgctctatcacccaggctggagtgcagtggtgcaatcttggcttactgcaacctccgcctccctggttcaagggattctcctgcctcagcctcctgagtagctggtatgacaggcatgtatcaccatgcccagctaattttttctatcttcagtagagacaggcttgttggccaggctggtctcgaactcctgacctcaagtgatctgcccgcctcagcctcccaaagtgctgggattacaggtgtgagccatcacgcccggcccataatacatgacacatgttttaccttcctgattgtatttatttgctaagctctgaacaaagcaaaaatgacccactttaaaaaaatacacattgccttgaagaatccaaaataccttaaagattcaccaatctactcatctcttactctgaaggaatgctcttaagagagtttcaccagcaggacagagaatattggtaacaatataaactttagtaatggataaaaggtacatttatgttgaatatatttcttttctttcttttttctgtaggaattgaatgatctggcacgggaccctccagcacagtgttcagcaggtcctgttggagatgatagtaagtatttaaaaggaataatggagtaatagcataacagtggttattttgtgtgaagaaacaattatggtatagggaagaggcagtgtttaacccttagtggcccatgaagggagcaactctatgttcatcccattatcatctgtgttgttcattacattttgaatcttctgccaggtattggctatgtagttgttctagtcctctcctaccttaccttcatcccttctgggtattttcctggagtgaaatatttaagcttttacctacaactagctattattcttgagtaagataatactaaggatgatagtatgtgtgtctgtgtctgactttctactgactcatacttgcgaaatcaggtctttatttatttttttcttgagacagggtctcgctctgtcaagcccgggctggagtgcagtggcgtgatctcagctcactgcagcctctgcttcctgggttcaagtgattctcgtgcctcagcctctcgagtatctgggattacaggtgcatgccaccacgcctgattaatttttgtatttttagtagattcgtggtttcgccatgttggccaggctggtctcaaactcctggcctcaggtgatccgcccgctttggcctcccaaagtgctgggattataggcatgaaccaccacacctggccaaaagcaggtct

SEQ ID NO: 117811 - DNA, 9430 bp, Homo sapiens
aaaaaaaacgaacctggcgtggtggcctgcgcctgtaatcccatctactcgggaggctgaggcatgagaatcacttgaacccaggaggcggaggttgcagtgagccaagactgcaccattgcactctagcctgggtgacagagtaagaccctgtctcaaaaaaaaacaaacaaaaaaaaaagtttttgtagacaagaggagtcacgtgaaacaatcagggataagactggcatcatctacttataataatactcaatgcatatatttctcttttctagccccaggagagtatattaggacttcactttaaatatctggccgatattcagcccttaaacaagaaagatttgtgacaaacatctccatcccaccacagataactttccatcttgaggccatacttacttttctctatctgttttgtagatccgagcaatctcaggcactaaaggatcatctggattgggatcacacaacagagaacagatggacaagagtactagaatgaaaaaaatcatataaattagcagaggatcaaagcaaagggttgagagaaacatgagacgccaaaacatgagaaaattctaagaatttatactgtaatgcctagcagctttgtaagttttacttaactttatattaacagtaaccaacaaggattattattattattattatttcttttttttttagcagaattggggtttcaccatgttggccaggctggtctcgaactcctgacctcaggtgatccacccacctcggcctcccaaagtcctgggattacaggcttgaaccaccatgcctggcctaatttttgtatttttagtagagatggggtttcgccatgttggtcaggctggtctggaactcctgacctcgtgattcacccgcctcggcctcccaaagtgctgggattacaagcgtgagccaccacacctggcaaatagttttttttattttttattttttgagacggagtctggctctgtcgcccagactggagtgcagtggcgcggcgcggtctaggctcactgcaagctccgcctctcaggttcacaccattctcctgcttcagcctcctgagtagctgggactacaggcacccgccaccacgcccggctaattttttgtatttttagtagagacgggggtttcaccgtgttagccaggatggtctcgatctcctgacctcgtgatccgcccaccttggcctcccaaagtgctgggattacaggcgtgagccactgcacccagcctaccaacaaggattttaagaagcttaaacagactttaggttaggtcattaaaaaataaaaatgaaggctggctgcagtggctcatgcctgtaatcccagcactttgggaggcggaggggggtggatcacgagatcaagagattgagaccatcctggccaacatggtaaaaccccatctctactaaaaatacaaaaattagctgggcgtggtggtgtgtgcctgtagtcccagctactcaggaggctgaggctggagaatcgcttgaacctgggaggtggaggttgcagtgagccgagatcgtagcattgcactccagcctgggcgacacagcaaaaaatccatctccaaaaaataataattataataaaaaataaaaaataaaataaaacaaatagcagaaaattaatgttaaatgacatcttggtctcccagatacaaatataagcccctttgtgcaaagtctcacaacaatcccatgatgtaagaagagttgatatgactgtctttatgcctgaactcctaagggagctggcccagacaggtgcagtgacgtgttcaatgtccctggctagtaattagaatagaattagaactttgtctaaattctagaccaagaacatttttcagatcccataaagttcaattttttagaagcccatattcaaggataaatggctttcaaaattccaagtgcgatggctcactcctgtaatcacagcactttgggaggccacagcagaaggatcgcttcaggccaagagtctgagaccagcctaggcaacagagtgagattctgtctctacaaaaaataaaaatattagctggatgtggtggcacactcctatggtcccagctactcaggaggctgaggtgggaggatcacttacgcccaagaggttaaggctgtattgagctgtgttcacaccactgcactccaatctgggtgacagagtgagaccctgcctcaaaaagaaaaaaaaaaaagacagccacactactgaatattcttagcaaaaacgacaaccataaaatccaacaatcactgttttccagtggcaggcaccacattcagacaattgttttgtttaattttcagttgaaaacaattcagtctaaatcaagaacataaatgcaaacacttgcccctaaatggggatggtcatacactcattacagagaatacaacatacttctatgaatgtctcaaattctcttcagtgacaatttagaatctcatctaagccatttcctcggtgacaacctgggatgtagcagacaaatctcaatagtgtaatttcctttgttcaaatctgtcattaacttatgttttaaaatatttatttatttatgtatgtatttatttagagacagggtctcactctgtcgcccaggctggagtgcagtggcatgatcttggctcattgcagcctaaacctcctgggctcaagtcatcctcccacctcactctccaggtaagactacaggtgagtgccaccatgtgtagctaattttctttgtattttttgtagaggttgggttttgccatgttggccaggctagtcttgatctcctaggctcaagtgatccacctgcctcggcctcccgaagtgctgggattacaggcgtgaactaccacacccggccatatctatcattaacttatgcattccttactgaatgcaaagggggcataaagtcactgattacattaagttcagtagcctctgacaaaataaatttaaatccttctatactaatgctaatagagctcagccatctttcttttctctaataggtgttctgtaccaagagataataactctcagcccattttactcccaacacataaattcagcagggaaaggattcgctcatattcctaccaaatctatcctatagagatcaagggcttctgagaagtaaagaaatagttggcatgccctattcagtttggtaacaaaaatgctatttccttgccttaagagtatatgaaaagtttttttaaaaaatcaggagagatgttttctgactcttcattcctgttacccacaattctggcagctggcattccaaaaacattttcctattgtcaggtgtcatcacctgaagccctcttcaagcatagaacattctaacatcaattaggaaagacttcatgtatttcctggaaatgacaacagggaagttagaaatttttgaatgttcctttaacttattcttctaaatattctaataagtcaactttaaaggacaggttttaaagaaagggcttttctttctttccaggaaaggagagtactggctatctggaccttgtgaaaagatttttagtacactacttagcttcttgatttcatgaagaattcattttggtttctaatatactgatatggtttggatctgtgtccccacacaaatctcatgttcaactgtaatccccaacgttggaggtggggcctggtgggaggcgactggattatgggggtgtatccttcatgaatggtttagcacgacccctttggtgctgttcttgtgatagagttctcatgagatctggctgtttaacagtgtgtggcacctcccccatctctctcttggtcctgctactgccatgtgagacaggtggctccccctttgccttctgccatgagtaaaagctcccgaggactccgcagaagcagatgctgccatgctttctgtatagcccacagaactgtgagccaattaaacctcctttttttttgagacggagtttcactcttgttgcccaggctggagtgcaatggcgcgatcccagcttcctgcaacctccgcctcccgggttcaagcgattctcccgcctcagcctcccaagtagctgggattacaggcatgcaccaccaagccaggctaatttttgtatttttggtagagatggggtttctccatgttggtcaggctggtctcaaactcccgacctcagtgatctgcgcatctcggcctcccaaagtgctgggattacaagagtgagccaccgcacctggcaaaacccttttctttataaattatccagtctcaggtatttctttatagcagtgcaagaatggactgatacatatactataccttcttctgtaaagatagtaactcttatttctataacctgtatagtctcttcactgaacttttacctatatatattcttcatcagtattactttttttttttttttgagacagactcttgctctgttgcccaggctggagcacagtggtgtgatgttggctcactgcaacctctccctcccaggttcaagtgattcttgtgcctcagcctcccgagtagttgggactatagacacacaccaccctgccctgctaatttttgtattattggtagaaatcaggtttcactatgttggccaggctgttcttaaactcctgacctcaagtgatccaccttccttggcctctcaaagtggattacagtcatgagccactgcgcctggccagtattactttttcactagtgttacagcaacagttactttcacttctaaaaacatataatcaaatggctttatggcacacttatctgcttcccttcagtttttttcagtgtttttgtttttgttttttaaatatttaggtccccatcacggaccttcaaagtagagtgaatactgggtcaaaatttctgtccttgaagacagactatatgttaaaggaataatatcatatacaggattaaggcatttcatagaactacttgcccatacattcaatttacaaaaagggactcattaaaaccttaaatctgagacagttaatacaatcaaattcaacaaaatggcactgcaactattttaaaggatagctatccagatagagagaacctaacaaatcagacttgtaacagtccttatcatttggaatagctgaaaaaaaatcaacgctaggcaaggggaagaacaaaaagaggtatggcaataatttcagctatcttgtgtctccaacacctcaccccaccaaacacacacctctcacacaattctacttatcttggtcccattactagatttacatctctattgctatttggtgaaggaagtgcaaccaatgggaccctcaccaggccaggcacaggtccacaaacactttctcaagtagctcttgaattgtaagggggcctaccaaaagaaaaggggacacttctctaaaaaactatttcattaaagttgtaataactttaaaaaaatgtggttctctggcatcctgtttttatttctgcctgggactccaaaaattttaaattaatgtctcagagttttgtttgctttaaaaaattaatttgtggccaggagcagtggctcacacctgtaatcccagcactttgggaggctgaggcgggcggatcacctgaggttgggagttcgagaccagcctgaccaacatggagaaactccgtctctactaaaaatacaaaattatctgggcgtggtggtacatgccctataatcccagctgctcagaaggctgaggcaggagaatggcttgaacccgggaggtggaggttgtggtgagccgagattgcgccactgcactccagcctgggcaacaaaagtgaaactccttctcaaaaaaaaacaaataataataataataatttttttttaagattgagtcttgacatccaagtgataacatgacaaatacccaacacttttgacaactgtgcctttatccccagtttttggagtacttacaaggaaccagttaactgtctgtttttgcttctttaatcttcgtaacaacaatgaaatatgtattattgttccttttctacagatgaaaaaactgaggaatacaggggccaatgtgtctctagcctcatttaataagaggtggatctgagatctgaacacaggcaattggatctagaatctatgttctttaccatgaaactatgttgcttcctgtctaaatacatgcattaaacaaatggtaaattataagcagataatttctacttaatggttcaaatggtaaattataagcagataatttctactaaaaatacaaaaattagccaggcgtggtggtgggtgcctgtaatcccagctacttgggaggctgaggcaggagaattgcttgaacccgggaggcggaggttgcagtcagtcaagatcacaccattgcactccagcctgggcaacaagagcgaaactccctctcaaaaaaaaaaaaaaaaaaaaaaatcacacaccacatttcaccacacaaataccaaaactaacattgcttgtctatttctggacactcaacatacttttatatgtaactcttgttacagtgtatatgccttttttcttttttctgcttttctcaagcacagtattttcctattttcacaatatttgtaaagatcaatacttttttttttttggagacaaagtctccctctgtcacccaggctagagtgcaatggtaccatcttgactcactgcaacctccgtctcccgggttcaagtgattctcccgcctcagcctcctgagtagttgggactacaggcacgcaccatcacacctggctaattttttgtatttttagtaaagatggggttttgccatgttggccaagctggtctcgaactcctggtctcaagtcatctgcccatctcagcctcataaagttctgggattacaggcatgaaccactatgcctggccagggtcaatactcttttaaatgcatgtgctggaaccgatctattttttcctctactgtaagtaacctccaattttcagaactaaatcacaatgtcacaaatgtacttgtatacaaagttttttcagcatttgggattgttttcttagtataaataaatgaaactagaattattgggtgaatgggcatggatgattaagtctcttaacacatactggcagactgggctctacaaatctatacctctacttgaagaatatgagtgttcatttcaatgtacctcattagtgttttgtcttcttttaaaaatatctttgttaattaaaaaggtaaaaaataggaacgtaacattcatttatttattctttggttcccctgtgtccattcatctattgggatctgaatttttttctgatttttgtacttcatattttaaacatattaatccattaccatatttgatttttctcttaaacaactgatttcattttcacaaaagtacatccagtgaactcttttatcacctttcagagtacagcagtgagatctgataaatattcttgtttttgagacggagtctcgctctgtcccccaggctggccaggctggagtgcagtggcgcaatctcagctcactgcaacctccgcctcctgggttcaagcgattctcctgcctcggcctcccaaagtgctgggattacaggcgtgagccaccgtgccaggccataaatacttgtttttgttttcctttataaattctagattatttggctgggcacggtggctcatgcctgtaatcccagcgctttgggaggccgaggcaggtggatcataaggtcaggcgttcgagaccagcctggccaacatggcgaaacccagtctctactaaaaatacaaaaattagctaggcgtggtggcgggtgcctgtaatcccagctacaagggaggctgaggcaggagaattgcttgaacccgggaggtggaggtttcaatgagccaagattgcaccactgcagtctagcctgggcgacagagtgagactccatctcaaaaaaaaaaaaaaaaaaaaaaaatctagattattgtaacgcaactgtgatttcatctgggaataatgttgaagggttgtacaatttcaaatcaacacattaagacaacaactacatcactcagttcattgatacagaaacctaaagacaagagctggtaaaatatttacctatattttgttcttcaagaacctaacgtctatgtttacagcataggcatttgtctaaagggctggtctatttcctattctgcaatagtatctatctttttccattcatgaatctcaaggttggaagagatgttaattgtgctctactttatgctctaaaaaaacattcataccagtgtccatcttcttttttttttttgagacagagtctcgctctgttgcccaggctggagtgcagtggcacaatctctgctcactgaaacctctgcctcccgggttcacaccattctcctgcctcagcctcccgagtagctgggactacaggcacctgccaccatgcccagctaatttttttgtatttttagtagagacggggtttcaccatgttagccaggatggtctcgatctgctgaccttgtgatctgcccgcctcggcctcccaaagtgctgagattacaggcatgagccacggcaccaggcccagtgttcatcttctaacctatgctagagtagcacaactgacagactagtcactacaccaaggaatacttttgcttgaaaaatccaactcgttttcagttctcaaggtccatttcagattaagaagaattgctatctcttcttaaaagaaacataagtaatcttttcaaaaataaataactctaaaaagacaaaagacacggttgctttatcttgatatcaaatacccactgttaccttttgaaatagttagtgctggagaccactgtgatcgtagaatatcaagacaaatgctgccattactgttaatatttggatgataaattcttgttgtaaatgcaacctacagaaagaaaggaaactttctgtaaactagtttattagtattatagaaagtacattaaaaactgccacattccaattaattaccttaggtggtttgaaggggtaatctgttgggaaatgaattgtcaagaaaaatactccaccctgatagggactgtcattctgttgataacaagaaaagtgggattaaaatgagtaaattacataaactgtttattctgaaattaatctgaatacttactggccccattattgtagcttgccaatggaacactgaaaaataacaagaaaaaagtcaccatgtaacaatatctacattgtatctacgccatagtaacatatcattccccttctaatccaaattcatttataaataatatgataatgagtatgagcaagatgaggaacataaattaacagtc

SEQ ID NO: 117812 - DNA, 1051 bp, Homo sapiens
atttaggggcaagtgtttgcatttatgttcttgatttagactgaattgttttcaactgaaaattaaacaaaacaattgtctgaatgtggtgcctgccactggaaaacagtgattgttggattttatggttgtcgtttttgctaagaatattcagtagtgtggctgtcttttttttttttctttttgaggcagggtctcactctgtcacccagattggagtgcagtggtgtgaacacagctcaatacagccttaacctcttgggcgtaagtgatcctcccacctcagcctcctgagtagctgggaccataggagtgtgccaccacatccagctaatatttttattttttgtagagacagaatctcactctgttgcctaggctggtctcagactcttggcctgaagcgatccttctgctgtggcctcccaaagtgctgtgattacaggagtgagccatcgcacttggaattttgaaagccatttatccttgaatatgggcttctaaaaaattgaactttatgggatctgaaaaatgttcttggtctagaatttagacaaagttctaattctattctaattactagccagggacattgaacacgtcactgcacctgtctgggccagctcccttaggagttcaggcataaagacagtcatatcaactcttcttacatcatgggattgttgtgagactttgcacaaaggggcttatatttgtatctgggagaccaagatgtcatttaacattaattttctgctatttgttttattttattttttattttttattataattattattttttggagatggattttttgctgtgtcgcccaggctggagtgcaatgctacgatctcggctcactgcaacctccacctcccaggttcaagcgattctccagcctcagcctcctgagtagctgggactacaggcacacaccaccacgcccagctaatttttgtatttttagtagagatggggttttaccatgttggccaggatggtctcaatctcttgatctcgtgatccacccccctccgcctcccaaag

SEQ ID NO: 117813 - DNA, 1038 bp, Homo sapiens
ttttatcatgttgcccaggctggtgtgaaacgcctgggctcaagtgatccacccgactcagcctcccaaagtgctgggattacaggtgtgagccaacatgcccagccttctgtcggtttaatcattattagtatatgagttcaagaactatgtaatgtagaatcatataatttcaagtactttaaatgaatgaattgagtggacatcttttgtagaaataggccaatcaagtatggaataaggtatatgccaacaaatactaaaatttaatcagaaccctctataagtagcaattaaaggagactttcacattttacagctccttcccattatcattgaattaatccttatcagaaatttgggatagaaaggggcctttccttgaatgtcctataagctactctcttcaagttacttgatgggataatgaatggaatctgttgcttactgactccacacctatgttaagccaagcttctctttgtgtgtacaggtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgacca

SEQ ID NO: 117814 - DNA, 1309 bp, Homo sapiens
aagggtgaaaattcatttgatggaaatacttgtgtatatttaaagacccaattgctcctctggagcttgtactttcaagaatgattaatctgtgtaataaactggttactacagtcattacatataattttgtgtgaataggctttttcatttttaagaagtttgtctagctgagattagtggtggattttctcccacttctgaaatgttcatttatactggttgcattttaagatcatgaaacaattccagttacattgtaaaaaggatatcttacgagtaattttattgaacaagttagaggcataagcttaagagcatttccatgaaacaacacatgcagcattccaggaacttgattgttaaattcaataagaaatttgctttattaatgaaactaagctgcatttcatcaaaaccttgtgacattcccttggtacataggacataaaacacagaggcattgctatttggtaagttaagcttctgtgattgtaattataaaagagcaacattgaccaaacctgggaaacaagagcacagtcttgtttggagagtctacataattactttgcactaacatttgcaggatgttcacacaattttaaattgtactgtatgtggctttttgaagtcttcccttgaccctagtaaaatatagcttgaaacttgtaaacaactgtgtttgccagaaacatcattcatgtgaactaggcaagttaccttttttccccccttcttttcctaattgtaaactaggccaacctgaaagccatggctgatgctctagccatcaggttctttcaaatgcatctttacactcttgcacaaaagttaaggaataaatgtccactgcttttggttttaaacttgttcaccttgtcttatctctcactgtcactgctcctccaccttggaacttgtgtgataaaacccaaaacctcttacagttctcttataagcatttcaagcatctcttattagcatccttgactttgcagaaaaggcttaactgttaacagttgtggggaaaggagttagaatttagcttaagcctaaaatcaccctgtattctcagtattatgggcaagtgggacttcatctttttttttttttttttttttttttaagagagggacagggtctcattctcttgcctaagctggagtgcagtcggagtcatgacagcacagctcactgcagcctcaaccttctaggctcgaacaatccccctacctcaacctcccaagttgctgggacttatggtacatgccaccacacctggctaatttttaaattttttttagag

SEQ ID NO: 117815 - DNA, 1053 bp, Homo sapiens
atacagggtgattttaggcttaagctaaattctaactcctttccccacaactgttaacagttaagccttttctgcaaagtcaaggatgctaataagagatgcttgaaatgcttataagagaactgtaagaggttttgggttttatcacacaagttccaaggtggaggagcagtgacagtgagagataagacaaggtgaacaagtttaaaaccaaaagcagtggacatttattccttaacttttgtgcaagagtgtaaagatgcatttgaaagaacctgatggctagagcatcagccatggctttcaggttggcctagtttacaattaggaaaagaaggggggaaaaaaggtaacttgcctagttcacatgaatgatgtttctggcaaacacagttgtttacaagtttcaagctatattttactagggtcaagggaagacttcaaaaagccacatacagtacaatttaaaattgtgtgaacatcctgcaaatgttagtgcaaagtaattatgtagactctccaaacaagactgtgctcttgtttcccaggtttggtcaatgttgctcttttataattacaatcacagaagcttaacttaccaaatagcaatgcctctgtgttttatgtcctatgtaccaagggaatgtcacaaggttttgatgaaatgcagcttagtttcattaataaagcaaatttcttattgaatttaacaatcaagttcctggaatgctgcatgtgttgtttcatggaaatgctcttaagcttatgcctctaacttgttcaataaaattactcgtaagatatcctttttacaatgtaactggaattgtttcatgatcttaaaatgcaaccagtataaatgaacatttcagaagtgggagaaaatccaccactaatctcagctagacaaacttcttaaaaatgaaaaagcctattcacacaaaattatatgtaatgactgtagtaaccagtttattacacagattaatcattcttgaaagtacaagctccagaggagcaattgggtctttaaatatacacaagtatttccat

SEQ ID NO: 117816 - DNA, 1198 bp, Homo sapiens
cctcccaaagtgctgggattacaggcatgagccacctcgcccagcctattttcttttatattgtgcatgcacttagatgaaaactggctttctccatcccacaaaaaccttctttaagtgtttccctggcactataaccttttttaatcaggactggtataagtggttgatattcaggcccctcagtatatttccagaccaatttctcagatgggcttagaaatagggaaatgagacgggatcacattgtcagggttactattcatgaagcaattccttcattgctggcatattttaccttagtcaatgtaaggagaaaagctcaatggttaggactaagtaagcctttaaggcctttgtcctctggctgaatgtataatacaatcaccaaccagctttgctctttctatgtctactcctggtctgggtaaggcaaaggcagacatttttgtgatgagcagtcacttttcattaaattaaactatttgtggatctttatctgatcagagacacagcgtaatctgcctcttagcagatgtaaaactatatgaataccttagtgccaagacagcagcttaatagttttccttgattgagtggtggtttgtgtgtttgttcttaacgtcctgtgtaagttgttattggtagaatggttttttccagagctgaggagcctgattgcccaacattgtactctgaaagcaaatggttgatcccatttggaaaagccaagaagaggccattgagtgtccagcccaggcctcctgtgactgctgtacaggaaagagcagcagcagccttggtgaatgtaccatgttcctttcccaacttctaaggatgcgaggagtgacaactgccattttcccaggcacacctctccctgccctgagccacttgttctcaattctgtttaaacttcctttttggtacttaaaaatcttaaatcttaaaaagatgtcacccttccctaaactttagagcctctggaaaatgtgagtggggagggtttggttttttgagttaaaacctagtcttcaaattgccagctttccttgggtttaaagttctccatagaaaatgagattgctttagaagctccaaagctcctgggccctctgacttggaggtttctagaaacaacccacaaatacaatctgacatttgggacgcagagccagcaccatcttgggtaagagaa

SEQ ID NO: 117817 - DNA, 1864 bp, Homo sapiens
gccattgcatccagcctgggcaacaagagagaaactctgactcaaaaaaaaaaaaaaagggcggggggcacttccttttgaagtttcagatgtatattggagggagcagaattcctttgtgatttcttccttaatacattgtgtccctgaggtggtccctgttcttcctgtctcctgtcagccccctggctcagaggacggctgaatggagttgcatttcagtgcccacagatggaggtgatgactgaagtgtgtttgcttatgtggggagtgagatgatggctttggtgtctgagtggatgctagtgccttgagtggccagcagagggcagtggtgacccatagctgtgacaaccgtgaggcgtgtggtcagtgaatctgcatgggcacaacctgagaggggcttttgttggagtggggagattctttcggacttaagctttgtgcgtggtatatccagaatcagatgggccagtgccaagttcagtcaggttctcagccttacagtgaaggaaaaggttagtgacttgtatttcagcccaaagcctactggaagtgtcaagctgccagctcccctctgccctccccgttgctatggcagccatgtctctgtgtgtgaataggtgaaccaggctccaggttaggacctctgcccacctagctccaggttacatgcaggaaaagatctgtctattgctgcatgtgaacaaggagatcccatatttctagcaggtcacagaggcagcagtccattatcacttgcctgcccacctaccctgggcaaccagcacatggctccttagaccttgaagatggaggcctggggacagaaggagcagagttgggggctagtgatagggcctgggaaatgttcttgtctgtttcaagtttatcttgtattttggggccctggtctcctcagtcttccagcccaacaggtgtgagcgtccagggccaccacccggaagccagctgcctcttcatggggaaatctttgaaattcaaggcttggccatctggatatgcaaatgttccagatttgctgagcccaccaagtggctgagccccccatgcctggggcctgtcagccacattctccatggctccctccttctaacagggacaggggcaggcagggaatctaaattcccaggtcaaggagtttatttgggagccccaggcagggctgtgagaattagctaccactgcccctagatggggaaagctgcctgggtgctgttggtacctagaacctaagcttttgcctactgatagactctaaggagaacggtgtattgagagctccacgagtcctgctgtagtgcctaatcatgtgagggattttgctggatccaaaggaatctcaactaagaaagtttctggaataaggagggaagccttgggtctagcctcgctagagggtgggagctacctgcagggaaagctgctgacttcctattatgtcaaacccaggcaaataactggagcttaggcagttggcccccagaattgcttattctcccccaggcctccctctggggctggttttctggctgtagcaggaggtatgtgttctctgagtgggaaaggagtggggtcagggtcagggcggaaacccgggaatttagattccctgcctgtccctgtccctgttagaaggagggagccatggagaatgtggctgacaggccccaggcatgggagagcttaggccagcctgtatgtgtgtgtgcagaaggggactgcacatgtgttcaggagcttgagagtgagaattgtgagcatgtacactccttagtgtttatgcatcagggtgtgatgcataaacacgaaggctctgtagcctttgaagaacaggatcaga

SEQ ID NO: 117818 - DNA, 1116 bp, Homo sapiens
agttccatctaaccacagccccactgctgcactctcccttgctgtagtctctgggcctctggacacagttgcagtctctgggcagtggcctttggagcctggcaggtagggattctcttcactttctcctccttcccctggattgaggtgggtgacacaggaggccagccagctcaggaccagatcccctctctctagctggagcaatagccagccctcctgacggagctcacatatatctaaaacatcgtcttgtagatcttaatgatttctcaacagcccctgattgaagcatgcccaatttagcaatgccgtaagtaactttttatatttccttagggaatcatttcacttatgaatcttttctgaatctgcaatctcgattaaaagttgatgttgttttttctcgtctcctcggcttctgagatgcctccctagtgaaaagggtggtagcaccatcaatcctcctcattagtctgtctggagaatttttcttgagggtggggtgggggacagcaaccaagtctcctctgtcgtggcacctagcggggtgtgacctgggggagggttgccctcggggaggggctcggagaggtggggggggcattgaccgtctcctgcccacatacactcccccatctgcccccatctcaggggcccctgacagtgtttccgtgggagagaggggttgtccagcccattctgcctttagggtgtgtcctcacacctgtagcttaggaatttgaggagagggctgaaccccattcaaggctcagcttgatagcacaaaactggaccaaatccaagctctttcctgtacagccgccatagcctgggtgaatcagtcattcccctctcagagcctcagtttacttatttgcaaagtgggaatgagattgctaaacagatgacctagcatgctggtgaagggatcacttaacacagtgcctctacaaagggtcctgtcccaattctgaacagtatctagttcttttcctcatctcattcaccttctagtcctggtgacgcctttgaggtggagtgagtgggtctggcataattatctccaggaggagaaaggactggtgggattgggacttgcccaggggttgcccc

SEQ ID NO: 117819 - DNA, 1022 bp, Homo sapiens
tgctggagactgaaggagcttcttcctgacttgaaggctgattggttcaaaaaactcagcaaaaagtttaatagcaaggtgagacttcaattctcctttttgaggtaggcagaggtgggagaatagtgaaccaagcttcccttcttcttggggaagggggctgtggtggggacagtctcacccaagggcagagatcctcaccccatccttcctggatgtcccccgcttgtctcattggcatctgtggtggagagttctttgtggatggcttgcacatgacattttctgtttctgtaacactttctgtgtggacaattctgtccttttcctctgtggctcccatatgggttggataggtgacagtctaggtctccctcccaaggtgttaatttccagcaagggaaaactccaagatccaccccctaaactgggccagacaagtcaacaccccttccctgaggaagccatcaccactgggaccacctggccttcctccattgcagcctgtggatccctggcctcccgcctgagttgggggtgggggtggaggcataagtctgaaaaaaaagtgggtaatagtcagcagttccctaaagtagaattactacccaccctctgccatggaccccagcataaagctttttgtggggcgtgcatgacctgactctgtactggcgttaggcttcaggagatctgtggaatagagtttgacttcatggatcctaaccctctgagacctgctgctgactcccagggagcaggtcctccctcacagtctgtgcctcagcttccccagaaaaggtagatggaggtgagttaaatgcttggagatcctacacctgggcttttgcttcctttttccttgcacggtcagtgcccaacacagtgcctgacattcacactgaggcccagcatacctatctttaagcagtttggaagtgatcttctgggggtgatgggcgtcttaaaacggtttccatagcaagcaccttacttttactcacatgggatgtttgtttgga

SEQ ID NO: 117820 - DNA, 1021 bp, Homo sapiens
gccccgcgtgggccacgcagcgtgcagagcctgggagggagaatgggggtgttcctctagctgcggaactgtggggggcgtacgtccccggcgcctgccacgctgcactggccccaaatttacccatgaagttcggcccgacccccctccccttcgcttccccggagcggagtgaggggctgaaccgccgcgagaggaatgtgttaattttctggctgggggaagttgtcctcgcccggaatgggctgctttccggcggggagcgcggggtgcgcctggctttgtttatttgtaggatcgacggaaagcgagtgaccccggtttttaaatggggggccaccttcgggacctgtcagaagagctgaaacgcccaaagtgggagcaagatctctttttgttcttttttcccccccgggaatctgaaggggtgcgcggagttgggctggtgcctcgggctgcaaggaagcaccagtaaatttggggggttctgtagtgactcattcggaaagacccgctccctgaagtctcccgcgacgggggtctgaaggtttggcaaccgcgccctcctttgccccctggactttgggtggtctgagagtcgcgccttcggatggggggggagctaagggggtgaccagcggaccagactcctgacccccacctttcctcgcgcggcgggcgctgtttggagcccttggatttgtggtgggccctgtcccccccacccccgcattttctttggaagcgttggggagggggcgtgtgtgagatcgctcggccctcgcccccgccggagccgccccagggccgccggcaaacagagtccctttcaagttttccgctggggccgcctggcgggggctgcgagcgcggtcgctgcggacttgtttggagcgcgatttgaacgcccggctccacctcagctgccccaggccgcggggtggggggcgtctgtcctttgcagttgggagtatttaaattagacgtcttgggggacctactggcctaagcttcacctgat

SEQ ID NO: 117821 - DNA, 1069 bp, Homo sapiens
cccaccgagcttcttggttggctctggccccctccatccctggctgtgtctgcaaagccccccgggaaggcagggaggaggcgcagcaggctcagaacagcgggtgcccgcgcagccaagtatttgctcgagctgtcagagacagacaggcatgtggggaatttggtgcgtgtggggctgggggaagcagccgggtgggcaggcaggcaggaggagggaagctggggctgcctcccagcctgtggaaccctgcagagaccacctctccccagtcctagaggcaagctgcatccaggcaccttcctcctgcctgtgccagtgcagtgaggggagcgggatgatcctgtggggtctgataatagctctgacacggggaagggggtgccttgtcgagggcctgcaggctcaaagaggctctggtggagtgtggagccaggcaggaatccgggttgtgcccgactgtggcctccaggaaatagcagctgtcatgctcccgcccctccaccccaagcctggcacaacttgtttcctggccaggatccggccagggcagattggaggagcctggtattgcccggcctgggcaaggaacaggcaggatgcaggggccatgtttataagcctaaaggcgtttggggtgctctggggaggggacctcagcccttatctcctatgcgaagaccccaacccagtcacctttgtggtctacactccaaaagcacccattaggtagggtagggcccagagctgagtaatgcttggtttttcgtagcttgagagcccagagagggggatacgctgccccaaggtcacacagtgggctcctcagccttcccctctaccctcatgtgggtggggccactgggaattggtgaacatgggggggtttgctggggtggggggcctatatttagtcagtcctgcagagccagggcgcctctgggagcagctgctggggttggggggagtacacagacagaggcctagagctgcatttagtctggacagaaatatcctccccccacccacccacccactggctgggaggccaggctgcgggcctgtcccc

SEQ ID NO: 117822 - DNA, 1019 bp, Homo sapiens
ggggatgctgaggtacctgagtgaagaggctgagctgggggccaggggttgggggagggatgggaatgggttggacccagggcaaaggaacccatgggtgttgggtggaaaatcctggaggcttcctaatatcagagggagcagagagagccgactgtagtttcaaggctttctctgtctcccaccccctatgctcacacagcaaggctatatgttagacttgagcagggacttccaggtggcaaatggagcctttgcagggtggcgagaggcttgggatgtgcctttgtggcagggctgtcagggctgtgggagatctaagaagagccgacatgagctggcagggctgagggcgagggaggtaggaggaaaggctgtctagaagtgtaggtaggccttcttcctttgggcagaagaggagatgcaagcctggccagtggggtgctaccctcgttgtaaccttcaggcttctaccacatgtccatccccccatggtcctgcaggctagacggggaatgctttgtatttggggctggggaaactgaggcatgaaggattgcctcagagctcaaaagcaaatggtgagagaaccagggccatgacctgggttacccaacacgcctggcctgacttgtccgtgacgttcacacttatgctggcagatgtggacagtaaaaacaacaacatggctatccttagttgagcacctactgcatgtggacgctacactgaccccttcacataggtcctctccaggacctgacgaggtgggggctgtcagcggctgcatttcactggctaggggttgggctcagcgagggtcagcaacctgtctgaggtcacctaggctggaggctgcagagctaggagaggaatcctgactccaaagccccacttggaccctggcatggcctgagcctgtgtctctgagatgaggggctcccctcgccccattacacacaagatgtgtagtgttcctagttgagccagccccctcccccatgcccagctccttaact

SEQ ID NO: 117823 - DNA, 1023 bp, Homo sapiens
gggcaggtcccttagcttctctaagcctcattttgctcatgcgggaaatggggatgatcacagatgccattcagagagctgcggagaggtgcagggacgcataaccacttgaagtggtgctggctctggcgcaggctgtttcactgcccagtggaggcaggctgggtggaagagcagtgagctgactgagactgtgctgtggctggggcctgaggaccagtgggttttgagaggggagcctggtgcatgtgtcagaggaactgaagaatacaggagatgatatttgtgagaccctgggccctgctccaacggagtcagcccacccagcatttaccctctgacttgtttcttgtgttccctcacctccaggatttccaggggccaggtgggccctgctcagtttagtatgcctcacctcccatagctgttcaggatcaaagggagcatcatgggcaggctgagctgggcactttgcatccctgtcactctgatgtggtctgtagttctgggtttcttcaaggtccaaccccagtcttgggtttaagtgggtcacacccactccctgagcatcctgtgtaggctggttatggggtcagaggagaggcatttcctcctcccacctcacctcctccaagaagccctctgggtactgctccccagcactttgcccattgactgagcactcagggttctctgcacagacttttttaaacctttctctgtgtgtccctacactgggagctctctgaccacggggtccatggtatctcctgtctatcctagtgcccagcactgggttagcactcaatgtgggggcatagggctcttgtgcccctattttacagatgggtcagttaaggccctgcaaggtcacacagcctgttgaggggcagagccagcctggttcaggtgggtgtggggccacttggtaccggctggggtcttctttcaggcctcaggaccattcctaggcttccttaggccctgcagctcctgaccctcctggcactattcctggagggt

SEQ ID NO: 117824 - DNA, 1024 bp, Homo sapiens
tcacagacttgggtcgcacacacatgcctccactttaccctcagggaggtcacagagtcaaagatctcccccagcactgctacatgatccccatatatgctttaatgctgtggtctgtagagggcgacatcttgagactacacactcaaccgggcacattcacagtccactggacacacacacagttgtgcagcacacctcccaggtagacacgcgaaaacacactgtatgcattgctctcgtcaccatacacactccagccccctgagcccgctcccaggtgcccagcatccttgggtagttatgccacccgaggggcttttgtcccccgaaatactgggaagtgagcttgaggcctcagcttgctgagccctgtgtccagggagcctcggagagtgggaaatggtttgacaaggactgcccggcccctgcccaacctcactgtgtacaccactttaggcccaagagcgccaggatggcgtgggatggggcggggggttccaggtgtgtcatgatgggcttggtggctgctggcagaggcagactctggggggtgacctcagctctgtctctgggtccctcctcccacctccagcccctgatttgggtgtgtaaatgttggaggaatggggtgtgggcagactccaggcccccagggtctctagagtggccctggccatcccctctcttcctcctccagctgtggactgctgtgactgcccccgggagaggagctagatggaggcttagcagtggctgggcccccaccccccaggaaactcaaaaccctgggccagccgcgggtggcgggttggggcaggcacaaagagggcctctgtgcggccggctgggctgcccacaggattctgggggaggaggccggagccggtttccgtcccgttctgcttcctgcggaggctgcggaatgcccggagctctggcccagcctgccccgtctggcccacccgcagccccttccccatcttttccagggccttggggtacagctgcagacttctctgca

SEQ ID NO: 117825 - DNA, 1051 bp, Homo sapiens
tccccagactcctccccaccctcctccccaggcctcctccgcagattcctccccatctcctctccagcctcctccccacctcctccccagcctcctccccacctccccccaagccctcctccccaggctcctccccatctcctcctcagtccttctccccagtgtcctccccaccctcgtccccagccctcctccccagactcctccccatctcctccccacctcctcttctcaggccttgggctacacagtgggtctgatctggtctcctcgccacttctcctctacccttccctctgcctccctctcctgtgggcatgcccagctgccttctgggattccctccttagggctgtttccttgtcttttagaccctcaagtccctgagcctggacaaggtgtcctgggtccctgggtctctgaaccctgttaccccagacactgcttcccatgacactgtctccactaaccttgaccctctgccccttcctctccagctccccttttctctgatcctcccctctagttctctgtctcatgattctgtccccaccacctgtctctattctgcccccgcatgcccctctgccccccagctttccatgactcgtcccccctcagccccccgtgctctgtccccgcccgtcagcccctggtcccagctcccggctggccggctcctgcatggacaaaggggtcctttgtgggctgaccgcggctggcggggcggcggggcgctggctccgcattgctgatgaaacggagccctttgttgtccctcctcaggcgcagtatttctttttgggggctggatgtgttcctggcagggccgatgatggatgcgcccgccgccgcccgcctgcccgccagctttccctcccgctcattcccgctccgcttcaacgcagccctgactcctcccctgctgcctgggcactgccaggcccttcctggcctggaaggggatggctgtgtgccctagagtagaagactgggacctgggagaacgtcccctctatgtcctcctcttccatgagtagggcaaatgggg

SEQ ID NO: 117826 - DNA, 1034 bp, Homo sapiens
tgagccactgcacccagctaataagcatctccaacactctcccaccccagcacaagaaggactgcctgcttctggcaggtcttcctagaccctagcagagcagatttgggctgtggaggcctggactagggcctccaccatgccgcttggtggctgtgtgttcatagactggtagttctcctaaatcttgtttccctcatctataaagtagattaccagccactgcttctagagttcttgtgggtcttaactgagatagtacaaataagaaatttctcaccaggatggatctggtgcttaataaatgcctggtcaagcacatggtggtcaggatgacaggaccgttgatagtggcggtggtggcgatgttgaagggggaggtgttcactgctgccctgaccctgtatcctcttgtgacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggcca

SEQ ID NO: 117827 - DNA, 1050 bp, Homo sapiens
gaggggtggctgctcttcctccatgcctgtccctccgccatgaggccatccatgggggaacgtctttgctccaggcctacccggaccctgactgaactctctccttgtttttgtctcccgcccccgccagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggccccc

SEQ ID NO: 117828 - DNA, 1056 bp, Homo sapiens
aaaccccgcaaataatgcagccccagaggcaggccaggctgaccctgaggtcatgtttcacttgacagcctgggcaggcacacgtgaacacaggagacccccaggcgggggcctcggggcctcaagaagtgggtttgctctgaagggagtggcactgggcaacccgcagcagctccgcactgccccgcacccgcactaccgcatccagcagacactgagtcactcttggggacgggggcgaagtcaggacattggcagctaggagcagagaagttctctcagaaggcctccaccctgccttccccactgcgtcggccccgcccacccatgctgggaaaagggccccctggggttgccattcgcaaatcctgcccagtctcctggcccacactcctccccaggcgactcagcatagatgactcaggacttggagtggggctgttaatgggcaaatgtggtggtaggggggcctgagtgtgtggccgaggctggaaagtccctccaccatctgcctgtggcaaattgagggacaggtaggagaattcactctagtggggttctaaccctgccccaattctttcacagtgacacagcctggagacccagctctgtcactcaactctacatagccttcacccagagcctgacagtgtatatgaacaagaggctgtgcctgtgagtacttgcgtgccagcagctggccttgtgacatgcccctgtgggaccttgggctgcagcatcaagtgctagggcaaacaccttgtttgcagaagacccaaggaccccacagccagtgccaggacagctaagagactccaccacctgccaccccccagaacttaccctgctaatgaaccaaacttgctgtgtgactttgagtgcagctcgcacatctctgggcctcaaacttctctgtaaaaccatgccctcctgaatgtaccattcccagtggtggcagctgcagagaaatcacaatagcaggggcagggtccaagaagggcctgagaagctggttcagcctgtggtctgggagccaagtggggcagggacaagatt

SEQ ID NO: 117829 - DNA, 1060 bp, Homo sapiens
cctagaagcgctctcaagctgtcagcggagaaggtcatgggcatgaacggggcaaacaagaccaagggctcctaccatgcctgagctgcaggctaagctgagatggattctgcccctccactccacccccacgccccagtgcaacagaaagcccagttccagcacagacgaaggggggcctgggctctgccacttactaggggtgctctggggtaagtcactgaactttctgagctcgtgtcctcataggtaaaatggcaatcatgtccacttcataggagtgctgtaagggtgaaatgaggtcatgcgtggcaagaactcagcatgagcctggctcacagaacactctcagcagcagtcagctgccacaaccagcgtttgttggtgttctctcccagctaaggagtccgcctggtgccgcgggtgcagtttccaaaaacaccagcaggtggcgccccgaccccaaaagagcccccgtcgctggccttcccagggccgggaggggctgggctgggcggcctgttgaatctcggccagttagacccgcgatctttcccgctgcacggggacccgtgcgtgaactcctctcaattctctgtggtctctggcacaaggaagagggggtctgggtcaccatgggatagttggggagcctgttttccatccgtgttgtgtaacggcacggccttcggagacagcctgggcaaagttgaggaaatacccgggttggagcggataggagactttgagaacgggcgggatcccgacgcgcaggctgatttttgagtgcctgcggctgaactcggggcgccgctgggcctggtgctgcggtaggaggatgacccatatgacctgtattcgcttcctttcagagtgcgggcgagcggggctgcgcttcgcggaagactccgcgcagtgctgggcactgggacgcggggagtctggaaattctgcgtctggccagcagagggaggcggagagcccgccccccccgcgcccccccccgaacccgtgcccaggcctggcccggctcccccagcccgagctccccctgcgggaa

SEQ ID NO: 117830 - DNA, 1023 bp, Homo sapiens
agactggggacaaccctgcccagcgggccccctcggaggaggaggtattcagctgttcctagaggatgcagggactccccggaatgatcactgggggcattgtttttgcataggcccagggggccactgtctcaagcccacccctttgtcttggggccatcttgggggggccaggaagagaacagggagcagaagcagcagtcacaatggaagagggcctaagactcctggcagcctggggataagccaggctgaatttgatggggatcagcgagagggctcaggatttggccagggcaggtgggcagcctgggtttggactttcctgggttccccagttcctttttctagatcctacaaacaagagctgcttaatagtggttgggggtgggggggttcactgggctgggactgcctccaaacccaacccgtggcccagggcagttgcagtcgttctttcattcttccaccctctccccaggactttaggaacctgtctcccagggaagctacaagttctggggcctgggatctccgaatcagtaaaatgtgcctgctgtcctcccagcagcccctttccccaatatatgcgggaagcagggaacaggggcttttgagtggggctactgcaaagtttggtcctggtggaaacatagcaggtccctagggtttggccagagcccccaaaagattcccacgcagtggggtgagtaggtgggtgtggcccagctaaaggaggatgactgggttgtccttggaaggcctccctcactggtgcctcttgcaaggttgaagtctcaatgcttgggtgaattgcaccctgcagcccagggatgcccccagaggcctccccgctgcagcttgtcctggtctgacaactatggggtgcacgctccacaagcagacctgacaaatagtgcctcccagggtcttccctgaagggagagagcaaagatagctggaaggaatgacttcctgctctagacaggactgagagagagagtgtggctggggggtattacc

SEQ ID NO: 117831 - DNA, 1062 bp, Homo sapiens
cttagagggtttggggtgtgtgaaaactgggcagacagaagggaggaggaagcttcttggtttctgtctcttggctgttgaagcagactgtggggagctactcagaggtggagctctctcaggtctgcctctgcccaggtgttgtatccgaggctgggctggttgggaggatttgcacttggtcagtccattgtagctctcaggattcaactctcaacccacaggctcatgttagcctgtgggctccatgagcctgtgggttgaagcagtgtgagtccagtgccctccgaagttggaggaaggtggcccagtggtcagtctggctgtgaactctcttgaccaagacagcttagtcctttgtggttcctgataactgagggttcaccccgtagggaagtcagttgggcatagagtcaccagctgtaaacatgatttgaaatttgacagcagactttgtggatttcattagtgttaagggctcttcaaccagcatgcagatgtacgcaaatgctaagcaaatgagggtgccaattggctggggggttggggagagaagcaagctgggagatgtctaggaatgacctttgtggagcaagctccaagggcccctgagaatcccagcagagcacatgcaggataagatgcaaatgtgcatgcagccccggggacttctgcctgcctgaccatgagaacatgagcccaaggcaagggctggttccctgatggccacactgagagaaggaaagcaggtgggggctggttatcactccaaacaggcattacctgaaagggatgggcatctttaaagagggcgtaggttcttggcccttgccctacacttgtgtgccctgagatggaaagataggagtgagcctggccttgggtgagggtgttgggagggcaggacagtagggacctcagctgccttgggaaagggaggggatgccctctctggcccccctcctggccccacgggagtctttgatttgcctctaccctctagctgggcttctgaagcccctgcctcagaacttgctctgacagctgccaaggacgcatatc

SEQ ID NO: 117832 - DNA, 1039 bp, Homo sapiens
gctcccacctcagagccagatttcctcagtctggacaattcagaagctcagccaggtttgcaaacctcctaggatcctatgccccaggctgatccccacgtaacagagaagagcctgagacttaactagattggaatcactcagggtggcacagcagcaggtcagtgcagaactgactcttgagtcagggtccttttatctaacccttcaatgatgtgggggtctccgtcacagggtcctgaaatcacacattcaaaacaggatcccacttccaagactgtaatttgtccaccagttgaggagctcagacattctacaagtgaacccacttgtctcttcctgtgagttgcagtttgctcttctgggtagtgaaatcaggctcaggcaccatggcccagccctgtaggcttctagggtgttgcggtgtcaagtagagaagtgacctgctatctggagcctcatcctcttcctcttcccactccctcccacagactctgaggctccccacccgggctcccagtacgtggacaggccagctaggcctgtggggcacagcagggacatggggccagtctggggacctcatgcctgcactctgaacaaaaaaaaaaaaattgggcccccaatgagggagctgggcaagctgtctgcaggaaggcttgagagttgagagtgctgaaggcctggcactgatgctgggaggagcaggggggctcctgagacccccacccccacttacctttcctcccagggacatttgccaactgactcttgcgcctctgcctcgccaccaggtactaaccccacagctcatctctaaagagcctgccctgcctgctgtttctaacatctctctctaccctccttggggctcttggggactgggtgtcagggaaggagctcaggaggctgggaggggacactactaacctgctttcacctcgcaggatggctgcccggtgtctgaggagtcctgaccaacgtttctgtctctctctctccccctgtccccacccacctgtctctctccctccacccc

SEQ ID NO: 117833 - DNA, 1034 bp, Homo sapiens
agatgtagagggtgtcctgcgctccttagaggagacggaaacacccccggcacccccacctccacatgtgggctgtacctcctgggcacagtaatgccaagttctctctgcagcagccagggccacacccaggcctcctcccaacttctggggtcgggcagcctggccagaatgggaggaagcatttgcagagccctcccctgctccgaaggctgcctgagggtaccaaagggtctggcagtgagtgtgtgtgtgtgtgtgtgtgtgccgacgtgtttgagagagaaaaaaagttctcagaaagcccattttccagtctggccagagtttgtttgttttgagggtttggaaatggggtagagggaaggaaggggaattaagggagagcaggacccagggcaatgatttccatgaataccagagatatttatgtggctacaggatggtgggagagggggcgggggttggtgctggagatgctaaaaagttgaggaaatgaggaattgaggggtaactggtgactctctcagcacctctgtggtctgaatcctcccatctaggattttattcccttcctttcttcaacttatgaggttggagctttcccttttgcacagtttgcaaaaaaaaaaaaaaaagaagaagaagaaggagaagaaagaaagaaaagtgagccccgaggcccaaggacccagccataattatggagtgcttttatttggggcctgagagcagttccttccagcaccaccaggtggaggtggagcagaacaaaaagcctctggccggccattgattctgcttgaggaccaggggtccgctggcttgcaaggcctgtccccagttacccatcccatcctgcagagcaggctaggcccctgcgtgccccccgacctcctcttctccagggaggacagctgggccccatgaggagtgtggaaccaagtgtccacatggcactggatactgggaggtagaactctgggaggtgctaaaggtgggatccaggggaccatgtaggtagccttggagaa

SEQ ID NO: 117834 - DNA, 1111 bp, Homo sapiens
tcactggggggagcgcaaattggtgcaacctttccaaagggcaatttggcaatgtacaaagctgagaaagattgcataccttctgacgcagcaattccacttttaggaagatcgccttaggaaataattgtgaataataataataatagctaacctttgttaaatgctctctatgtgccaggctctacatgcattgtctcatataatcctcacagccatcatcccaagaggtaagagctattatttatctcctgtattttacagctgtggaagttgaggcgcaaacgaatgaagttaattcttggacacaaatctaacaagtagcaaagtctggattgaaagccagacagcctgagtctagagccatcctcccccatacagcagtatacatggggtgtgtgcaaagataaagctgcaaggatgttcttttggggttgtttgtaatgggaagggggagggggcatgctaaatgttccacacaggaatcagttacataagttatgatacacccatacaggaacattatgcaaccatgaaaaatgatgctgtaagaaaaactgagtgtgtgaatactcgggggtgcgggatttgtatatgcataaaatatttctgaaaggaggtcaaaggaacccataagattgattatctcctagaaagacaactgtgtggttgtggccagaagttagagagagacttgttttttaatccatatacctcttttcacttcttgaattttgaatcatgttaatatctgtcaaaatatatgtttatatatatatattcaatggaatcattgttgaaatatatatatacacaaacaaatacacatataagtcatagaatttgttccacataactttcatttccttgaaatgctaccaagagttccaagaaaaaaggtttcaaggcccccacttagagaacgatactgaagttgatagatacttctttaactatgcttaacccacatgctctccaaacccattttcccatggaaccctcttgtcaagtaatatctgttttcatctctccagatactcctgcttatagaatacactttgggaaatgctattattaatatttaacacccaggcgaaagggttacactgtt

SEQ ID NO: 117835 - DNA, 1061 bp, Homo sapiens
ctggaaagccatttacagcctatttggtaataagctcttaaaaataaaattatgattgtcagataatgattttacagcacaacaagagcccccttgcaaccatttccgtaattacattaagccggtttgtctgaaagaagcttaatgggaaacaaaccattaattataatttggtcttttctcccacagccccttcccccttgaattactggagccacaccctggggccatgtatgggagtgcagggatcgcaaccttgaggatgggaaagatgaggtgacaaaggccaaggctcactgggagggaagaatagagagcaatggaaggtacaaggttgtggtggcccctgtaaccagctggggggcctacaatggcccccacctaagtggagccagtggtgctgtgtgtccacttctttagacctggagtgaaggaactgggagctgtagggcaagctgagcccaacatgggcatgttttcaggggcctcagagctagtgggtggggcgggcacctgggcaaacagaactaagaaacgggcaggaatgaatcaaagacagcttaaatatgcagaaatgcagctcatacctctgggcaaaaataatcccaaacagagttatgtaatgggcaggtggtatatgataggaggaatgaggctatgaggtatgtatacaggcatgagtgaatgagagaggttgagaatggagtgggagtgtcctggggaatttggcagaggagcttatgaagctgttgcttggaggtgggtgtgcatgtgtgtatatacacatactgggaaccctggaaagcagcgagaggaaggtagctctgaacgaggctgagttccacgcctggggtggccttaaggccactccagatgtgtgcactcctaattcttgaggtggtagggacagagaaagacctgagggcacaggtgtggggtttggagcaccactgtttcccttataagttagtgtacctccttctgaccgccatactcccactcctagcttgctcgcatcccacctccagacctttctgctaattggaatcttccccttcctt

SEQ ID NO: 117836 - DNA, 1075 bp, Homo sapiens
tcactgggcttgcatggaagtcctgctctgtgcagtccatggtctgccctcaaaagagcacccaatagatatctacttactgatatcccacctcactgataaaagagacgtgggaagacactgggttctaatctcctgaggagacaagtctggcagccatgagagagttaacaacagtccaaggcacatgttaagggcagagtgagcaccacagcccctcccatgattacccactgcctacaggactgggccccagtgtcctagcccagtttatgtagcctttcaccttctggctgctgccaaacctctctagcctcagctttcactattcctccccacagtccattcttaaccttcctgagctcattgtagtttccatatgcatcaccctccctctcccctctgggcctctgccgctgctgctcctcctctctgcaacacctctccctccctccactctgctaactcctatttggctttcaggtccccacttgtccgtcacctcctctgagaagccctcctgtccctcaatactgaccctgcccctgttccttgatggcgttgaagtgtacgtaccctaagctcagcacttgcacaccctgtaactgccttttactgtttgactttctcaagactgtaagctcttcaagggccggggataaccctctcattctccattttctccatgctgtctagcatgatacctagcatagcagaggatgcctgacaaatattgtttaaacatacatgaattgagttggcaaatgcaagaagaagggtgatgacaatcgtgagtgggcaggtcagggacacagtgccctacagagaaggtagaacttggggtcagactggaaggatcatgaatagaacaataataacaacaccaatagctaatgtttactgtgtgccaggctctgttccaagcattttctaatttatccttacaaaaaccctacgatgtaggcattattactctcccaatttcacaggtgagtggaatgtaaaaggggaataacaatgatttgatagagacaaaaaggcattttaggttaagaaaagtgcatgagcaaagaga

SEQ ID NO: 117837 - DNA, 1048 bp, Homo sapiens
ccttgggaggctggggggcatttgcatggggctgcctcggcccccacattatactgggattgaggctggatgagtttgcatgtccccaagctaatgccaagtcaggacagtggctattgcagacgattcctgaaactggattgagctgccaaggagagacctcttcctttaggagcctgaggatggcctgatagcagctgcttttgctttgccagccctgctttcacctccagctctcagcagggagcagggggccaaccacaatctagagactgagctggtgacacatagtgggaatggccctgttctctggtcagcctcccatgagaagttccccaggaggagggagggacctgcagcatctgaccagatgtggaggtcacagaaggagtccagccccatgctgatcagcccctacggggttgctgtcgctgggatggtgggagagggagggcctggccttgaagaatgttttattcttctggctgcagcagccaaagaccatggctcccacatgtttctaaacaagcttgattgtcctctagagtgatgtgtcacatgcagggctggagcctgagtcctggcaggaggggaggaggggggcagggatgggggtgaggggcactgaaattctcagagagacaggacagtagaggctcaagtcagggagagaaggccctgccgaaacctagatcatggcagatgcacttatgtgcagtagcagggcaggcaagggcaccggctggggctcccccttctcctcagaccacagacccaatcaaccctcccgaaacccccactaccaaggcaagaaccgtaaacagcctgagtcagagctgggcggcagcgtacaagcgtgttggttctgtcattagctgtaatagcagcatctcacctggctgcctatgcctttcatccaagcctctcaaagaacttgacagacagcaaagggttctattatcttcatattactagtggagaaatgaaggccccaacgagcctggcagcttcttcagagttcatggaggagctggcaggaggctgggaa

SEQ ID NO: 117838 - DNA, 1029 bp, Homo sapiens
ggttgactctaaatagctttcttgaatcccatgatccctggccccagcaccggccattgcctcctcttcctttccagccactcccgttgaccctatccccgtgggctatgcagtgtggagactcctcacatgtgattcccacatgactggcatctcaggtctcctgcaatcccctgggtgttatatctcggagcaaggggcaaataagttctattgatgtggagccactgggggaggctgggggcctgcatgacccctgtttcctcccaggcctttttttgagcagttcctgtaagctccttcccatccattagagataggagaagcctcactagccttctgcatgagcaggtatgctctgagcttgcttttctgtgcacttagggaagcttctaaatcacaagcttagattcttttacctttctgtttgtagcccatcagcagctcaccacacagtttcccaggccctccaggtcctcctgcttgcatttccaactctctctctcagcctctcctcatcacccctgaccatgccaaacttcccttttctccttttttaagtcgcatatgctctcatttctaaactcttgcatatactaacctctttttgtgaaatcttcttttcttccctctttcctcctccagtctttgctgctagttcacaccacccctaagagctcatcttagaatgtccctcctctgggaaagcttcccagctcccaagagtagggtgggtcctctgatcttacctctgatggtgcttgtcagactgaattgtagtcatttgtttcttaatatcccttccttaccaaagtcatacctccgtaagggaaggggccagtggttttgtttatttgtttcgtggagggatcctcacattccagtgcagtacctgtcgcgtaagtgctcagattagacttgtacaatgtggtatgaatgcatgggtgggagagctggtgggccttccttgaagaacttcctgccatctctgatctggattctctgggtgtttaggtgcatcactcctgt

SEQ ID NO: 117839 - DNA, 1041 bp, Homo sapiens
tgtatcaggaatgcaggtatgacttagctgggtgcttctggttcaaagtctctcatgccattgcagtcaagctgtcctccaggactgcggtcatcttaaggctcagccagcgttgcaggatcagctttgaagctcactcatgtgtcgttggcaggatttggaagatctgcttccaagcacactcacatgaggctctccacagggctcccttataacatgacagctagcttcccagggacaagcaatccaaaatggaagccagtctttttatgccctaatctgcaacatgacatcccatcattccccacattctatgtgttagcagcacatcaataagtccaacccacactcaagggagaagattacacaagaacgagaatcccaggagatggagattttcgggaggctgacctagaggctgccgaccacgtctctcattttggcctcatagcaactctgtgctctagccagggagaaatcgtctgcaggtaaggaggaaaaggaaaaggagctctagggaggtgaggggctctactcgtgatcaaagagttgtgaagtggtagatttagaatttgaacgtaggcgtccatctgacttcagacttagtagtctttctctttttttttaaattatactttaagttttagggtacatgtgcacaatgtgcaggtttgttacatatgtatatgtgccatgttggtgtgctgcacctattaactcttcatttaacattaggtatatctcctaatactatccctcccccctccccccaccccacaacaggccccggtgtgtgatgctcccttcctgtgtccttgtattctcattgttcaattcccacctatgagtgagaacacgcggtgtttggtttttttgtccttgtgatagtttgctgagaatgatggtttccagcttcatccatgtccctacaaaggacatgaactcatcattttttatggctgcatagtattccatggtgtatatgtgccacattttcttaatccagtctatcattgatggacatttgggttggttccaagt

SEQ ID NO: 117840 - DNA, 1054 bp, Homo sapiens
ggttatgagacaagagtgatagaattcatcttcttgcgttagtgatggggggcagggtctctgttccctgaaaagcttattcagatgacctatttggtctagactctgtctgtctcagcaatagctgtcatctgaatgtcactttagaaggtttgggtgcttccttttccttctctttcagcagtactatattacaattcgaatgctaattagtatgttttaaaagtaccccttttatcacacatttcccaaatctaaaaccttttatctctcctcattgcctctaggctgaagttcagactcctcagcctggcctccaaggcctttcacattttgacccaacctcccttcacaacctccttccatctcctcatcttcttaaaacccttgtagttcatcagagccaatccatcctttcattggccccaaatacatttacaggctggcttctgcatacccctctctgaatcaccctccttccttttgtggaacccaattctactcttctttcctaggccagctcagtccttcctcttgaagtctacccagacctcttgagtgcacagtgatttctcttgagctcaactcttttagcactatcttctatacaagtctataccacttcatttggcattaaaaaaagtgatagtgaagaacacaacacaaaatttgccatcttaactatttctaagtatacaattcagtagtattatgtgtttatattgttgtgtaacagatcttcagaacttttttatcttgtaaaactgaaactctatacccgttaaacaacaactccctatttcactttagttggcattttatccagaaccatgctgtgatatcacatatgctgaactgtttaattccactagccttcactaagcaccagtgttccaggtaagccactggtagattctagaggaatacaaagctgaataagacacagctaccaaatgtgaagagtttgcaattgttctcaaataagagtttgctcttgtattcatgtgtctcatgtccctaaatagatgaaatgagaacaaacttcttatgagcc

SEQ ID NO: 117841 - DNA, 1052 bp, Homo sapiens
atgtcctccaagatattttttaaactataaagggtaagatagtaactttacagtggagaaattcagcagatcaacaaggttattgtcaccagtaagatgccctcggaaagacacagcatcatttctgaattaatctcaccaaaaaggcataagttcacttcaataatgagaaaatattagacaaactcaagctgaggtacagtacattctccaaaataactaatcaacactcttcaaaagtgtcaagatcatggaaggcagggaaagactgaaaaattattacaaattagaagagacaaaggaggaataatgactatatgcaacgtgggatcctaggtaggctcatggaacagaaaggacacaaatagaaaacttgtgaaattcaaataaggcttatagtttagttaatagtattgtaccagtgttaattcctagctttgatcattgtactatggttatgtaaggtgataatattagggaaattgggtgaggtttgtacagaaactctctgtactattttttgcaacttttctgtgaatctaaaattaattccaaaaaatgtttaaaaagaaagattaagtctttaaatctaccattgattaaacaccattctgtaacttaacatctttcccttggttttacctgtaaaacaaaatgaacctgacatcttctcaggggatgtagaattgggtggattcccccacctcccctaaaaaatgtctattaggtcttgaactccctggggccaaaagcgaggatttgaaagggaaagccccaaagcttgaagtatctgtcttcccatatataagaactcctcctgtgaacatcaaaggacctgataataggtctgacattgccattaatgacacctatcagttcaccagagacctctactctcagttccactgccagagaaaggtggtcacggactagaagctggtgcttccccatactctcacgcctcagcagcgtggcaaaaccaacactgatcctcctccccagcactatgaacatagactggtcatgcttctactcacagcactatgcttctg

SEQ ID NO: 117842 - DNA, 1096 bp, Homo sapiens
ttgtcaggcacattaagggctcatctttggctcatggatatgaatttaaagtgagaccagtctaggtgattgtgtgcatttctccagctacattcaattgcatgggcacaggtactgggttggatttgactagaattgtggttttgccaaatgaagaaatagaattattataaaaattgatcatgaatgaatggaagaaagaaagagaagggaagaaagaacatcatattcactgtgagaatcagtaaaaaggtggtagtatcaatgaatttaaatcctgttaagatagaagaattgctggagtccaaacagtagagggtgtaagctggaaggtaggagttggtaggtggagagtaggatgcatgcatttgatatcatggaagggttgcatttcttggtaataacaaggtgatgggtagagatgactctcaagtatgaatgagcatgagagtcagtgggtagaatgaggtggagcacaagacgactagagaagaagagttcaaggaactgagaagccagggtattggaatgaccacttatgagtacaatgaaatttctgaaagttaagacaggattactttgtgtatatagtgaatgacagatgtgtgccctgccctcaaagagcttacaatccagcccagaagataagcaagtcagaagcatttggcatgatggcataattgctgtgattggaaaagtacaaggtaagggggagcacaagtgaaggatacctaaaccccgccttgggattgaagaatctttctggaggaaagagatttgagttgggattttgaagaacaagtcaaagttaatgaggtaaaaagacagggaaaagtactttagaaagggggaacggtatgtgcaaagggataaagatgagactggggcacactgaagtaactgaaaggagattcattgccccaggtgccatgggcagtggtgcaagagaagtttgggaaggtgagctgaattggatcatcatgtagggccttgggggctgtattaagtagtatgaattcatcccatgtgcaatgggagaggtatagatggactaggggagaagaaagtattaagaaatgtttaatagattaatgat

SEQ ID NO: 117843 - DNA, 1039 bp, Homo sapiens
cctggaaactctacctgtgcagtcagatgctgaagccttggttaaagcctgcagggaagccctccctgagtgaggcatcccttcctccattgtgtttactggaccacttctttctagtaattgagaattatatcctgaaagatccagaaatggaaagctccaggctgggagtggccatgcaggaaacaggatacttagacgtggaccctagaatgctggtaccgcacagatccagtcctacctcattcattttcaggtttttttcttttaattaaccaacacttatggaatctccgttaatgtcttgggtactggggacacaaagatgaatatgtcacatccctgcccatgggacactcacagtctagtgataaatagaccatttatttctccattcattcatatataagatattttgtaggcatctatcatgtgctaggcattacattgggcttatccattcattgagtaatatttgagttcctcctatatattaaaacttcttccaggtgcttggaatattgagaagacagaaatctctgccctcatggaatttactttctggtagtaagcgaccaataatatacataataaataagcaaattagataatatttagaaagttataaatattataagaaaaaaaaatggagggaggtaatgggagtgcagaggggtggattgcaattttaaatagagtggttatggtagacctaaattacaacgtgacattagagcagagaactggaaggaggtaagggagctaggcaggtagatatcatggtgaaaggaatttcaggcagagggagttctccctaaggtggaagcatgcctggcatgtttggggaacagcaaaaaggcccatatggctacagtagaatgagcggagtttagagcagcagtggtgccagatcaaatagggccttgtgggcctttgtgaagacttggccttttatttcagtgtaaaaaggatctgctggagggtttgagcagaggagtaatataattttacttatttgaaagggatcacaaagtgtgct

SEQ ID NO: 117844 - DNA, 1064 bp, Homo sapiens
ttactactgcaaagtctccccaatccaattcttttcattcatgatgctctagttggaacttttattttctttctttcttttcttttcttttcttttttttctggagaagagatcttactgtgttgcctaggctggagtacggtggctgttcacaggtgtgataatagcatactacagcttggacctcgtgggcttgagcaatcctcccacctcagcctcccaagtagctgggcctgcagtcatgtgccactgtgcctggcttctagttggatacttacatctcacctagcctgccttagcggctgtaaatggaattccctagtttcagactctctgttctcttctattatctattgctagaattcactttctaaaacagagtaattatctcttcccaaccccaaaatcttcaatagcttcctatttcctgtggcataaagagcaacttcttcacagggcatgcaagaccttccacaatttggcccctacctatctgtgatccttcagtccactctttcacacttactctttgccatagctaaaatgatctacttgacaatttcaaacaaattttacatttgtatcctttagtgcttttgctcattctgtttccttggcttagtatgcctttccatttcctcttctcagtcagtttcttgcctcctcttccttctgggcttagctgagattccacttctcctcaaagctttttctgatcccctcagtcggaatgaatcatggcctcctgtgtttctgtagcagttcattgctcttctgtaaacataaaggcctagtctatcacttggcatagtcggatgggggaggagggcaagtgtgtgtgcggtcctccagactgtgagcttcctgagtgcaagatggagctgcagcaaaagatgtatcttctttatctttttgtgccttatgtaagttaaccagcaactgctgggtgacttgaagagaatgaccttaggattttatcttggaattaaaactggccattgggaataagcatctggctcatggaaggaaactgaccttaggtatgtatatattggtagaaatat

SEQ ID NO: 117845 - DNA, 1028 bp, Homo sapiens
ttgggggttcttcctttaaatatttgttgtttattattacccctcaggtccttggctggccatcaatcccctgacctcaagaagtagtgtttattttttcttattcttaaagtcctagtatttgtggcctatattatgtatataacacttatcatttaatgccacacattgctaattatcttttgatgggccagtatcttatctcgtttacctggtggtaagatctttaggggcagtaatttaaaatatggtgaagttaatatttgattgctggtattgccaagtaaaaagggagcagtgggagcatttgctttctctactgcccacttttttcctagacacatttcaagattcatcaaatgacagcccaggctaagggacaaccatggaaagtacctttggacattttgatgagggcggaattttgcttcttggtcatgtttcagttctattttttttttctctcaatagtccatagtttctttattttcttgcaagtaattgtcctcttttattgagttttagaatgatttctaggtacttttcctcatgtatgtcaatattttggcttgtgttctttttctgtgttttggttagttggcattctgcaaaatttaccagtttcacttgccacctgagctttttggatattccttattctggtctctcactggaatgcctagctacactcttaatctggcctgttcatgcttcaggctgaataccttcagaggtaagaggtatgaccaggttccttttctgtagtaagctgagatcacgaattaggagtagcacctttttgcctagtagacaatttgggggcttctggaggccagtgctggtcctttgatcactggtttttgttttgaaagggggtggtgggagctcaatcctttctcctaatgtttctcctttggcatgttcattcttacaccattcccttgaaatgaggcattttctgccatgtctgcttggctgaagtattgggtagggtgtgggcttctcctccagctccaagttcccaagga

SEQ ID NO: 117846 - DNA, 1113 bp, Homo sapiens
ggctgcagactgcagtgagagagtacaagcactcaatacctatctggaaataagccctaggttatacgtcaggtctagtaaaagagaaatcaggtatctctgagctcctctactcctgagcccctaataccagagaagatcctttttagctatcaccgtccaaagactcactggttaattaatggtcagcaacttagctgtctgcataaaaaccagcgaccacttaatatgttacttttgggagtgggatctctccttgacacaagtttctgggaagagtaaaaggggcaagcgaacctgctttaatgaatcccgtaaggaactgcgtttcccaggaaattcctgacatttttagctcatgaatttccgaaagcctgcttggttttctcctccattctgggtccttccagaaaggaagaagagtgggctagggtctgaatgctcacagggcctggttcatccgcagagctggccagcaactcaggctgggctcagccctgagcagggtgccccccttccccaaatctcagaaggaggagggggaggcgggcgggcaggcagtcagtcgtggtcccaagggggactggctgcaggtttttgggtgagtgtggagtttctttttgattgttgcatgtggggaagggcagagtcgacgggaacagtcactgcgggcaccctagccctggtgcgtctactgtcctctgctcggctccccccatcggtgagtgcgcccgcccgcccgactgtgcggggctgcggttggggggaggggggagcgggatcatctgaggccagagccactgccgtgtgtgcggggagggggagcggcgggagagagaggggagggacaggctaggtgtctgctgctccacgccactgctgccggcgccccgacctcatccccagcagccccctctgcagctaagggttaccaccgcaccacctctcttctttgcctgcctcagcggccaaggctctgcggtaggagacaacccagccgggtggcgggtgggcctgtctaggtttgggtttgggtcttgctgaggcccgcatgagagggggtggccgtgactcggtgtcccctctttgcagggggctctgctgcgccgcgca

SEQ ID NO: 117847 - DNA, 5301 bp, Homo sapiens
cggcgggcgggtgggcgcgtacagtagggcgccctgctactgtactggggagtcagtgccctgttaccgggtctcgtctgtctcgtctctcccgcagatctcgcgagagtggctgactggctgtgggggttgcggcggcagcaggcggagccggggagggaaagcagcggcggctgaggcgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatcatctttgagtgaagagaaaatgttataaaaaagatgccttaaacagtacattttggtttggaattctgtagaaagtattttggtaaaaaaaaaaaaaaaaaaaaagggtcttgtctgacagagagttctggggatggaattgtttcttggcaaatccagccatatagatctaactgctgtatgtataagacaccacctgtaggagcgggaaggtatcagtgcttcttatattgtaaagcattggcctaggaaggcaaacagttgtctttttgaaggatttttttctgctggtcctttgggttttgatttgatatttttatgctccctggttgagtgtgttgtcttcgtttttgagatctactgtatgtgttgaataacaagctattttcattgtactgtgcattttcccattaaattgtttgcttttaatattcaatgttaaatatgaggtgaccgtacagtagttaggagtttctttacttacaaaatcactggaaatgattaaattgcttttccccctccccagaggtgcatttttcttatttccatatagtaaagttgagcttttacagtgcataatgtgacatttggaatgcttatcaactgcatgtaaacattaataacctgcacttttttgtcttaaggtttgttgagctgttttgttcactgtactttaactgtgatatggaaaagactgcattctctgtgctgttactaattaggaaagagaattgctttgattttgtctcttgtttactatagcttcttaaagttaagccttgtactacaggttgttggagtactcctagatcactgtttcatagtagccagcaataagtagtgcaagtcaacaaaaacacagcaaacttaggcaaagtgtcctttctttgagatgcgagttctttcatgaggttttctttagggccagagttacctaaagtgaagcctttcttatctatagacttcagattctgcttggaatcccaccggctcaagaagcacatgtattgtgcaattaattgtctttacactaaaacagtttaatacaatctaactacgattttgaaaccagtgtctgatttatggtcagtgggtttaaaaagaaatccacatgcagatcttttaagacttaaaaagtgatcatagaaaagactaagtgactgtaaagatgctctttttttaagcatctcactttacctccccaagcaccctcccaaaccttgtcttccctcttctgttgcatcctttccctacccttccctcccaggtgctcggtactttacctagtttctatatatcagtgttttatgttggaatttttccttgtttttattttactagttggtaaaccctgtttatgctgaaacaaataaggaaatggtatatttgaccatatgtgttattcatagaagacagtatgatcaaatgtgccaaaaacaagcaaacaaaacttaattcctgagaagtatgccttatttttattgatctgctttgtcttacaattaaggtccaagagcttggttaaactgtattatttgcctaagtataaaagaaaacttgaactgcattgcaatattgacgttctttaaaatgagagacactgtcaagtaatttaatccagagatcagccaccagatttgaaatgcttatgtatgtgtgtgtgtttggagttgtttttttcttttaaatcaccaaattttttttaagctactttttatttgtgcctcctatttatcatgctgatgttagaagcagcagtcatccagccacagagggagctaaagttaactaaccagaactgtagaaatcattatacatgcctttgacaacaaaggaagttcataagaaaagccatgtcggcttttcctctactagatacagattggaggtagatgaatatttgccaaatggaaaaaaagacaatgctagtcagaaaagacaaactgttttccagcttctcaaaaagccatggagagtagaaaccaaaaccaacagggaaataaaaaaccttgaaagtctcactttctagttgtcccatgcaggggttgaaatttgattccaagcggaaagtatattatgttttttcaggccttcacatctagagagatggataacttccaatttgatttttcaggtaatagagaaagctgctagtaattttaacccctgcctaaagaagacatatacttcatttgggagcaaatacttattgccttgaaaagtagcactgtaatagcctatgataattagttgtagaataacctttatccctttcaaactatgcaaattattaaataagtgtaaattaggattcaattaaagatagttgattatattgcaatcagatggcattcacaaacttaactggagcatatacaaatatattagtctaagttttgtatgctaacagaaagatataatttagctacctattctaaaaatggtgaatattattaatattgtataataggagtgggaagactgcctccttttttgaagagagagatta

SEQ ID NO: 117848 - DNA, 1058 bp, Homo sapiens
agcactttatatcattttttaagtcagttaagatttgatatattttaaaagatactatgtcaacttttttcttcctattttcttatgtaacttgacgtttggggggattatctcattcatttttgtttgtgtgcttttaacattttgtgttttggccctgttcaaactttctaaacacatttttcttttatgacattttgggttatctgctagacctggtgaccccaccatatgggcatgattatttttatcttccacacatggttcaccttcttgtctacaatattcccactcattttttcaggttatatatacacacacatttccagataattttagaatggggctatctgaaattgatggtctagtagctttcatagctccacaattcattttattttacatgtgaacataattttaagattttcttcaccataaaaagtgagataccaagtctaatgacttttttccctttttaaaatcttttgagtatcagaatgagaccttgctatctatgtaaaaggatgctaaaacaagggcatctgtagcaacttaggtttggaatagttggtgatgactctgagtataacatttatagtttattatccctaaatttgaatatcttcataatttggagagagatgtatacacacacatacacatatatatgtatatatacattgtgtgtgtgtatatgtatatagatacacacatctccttgagagtggaataagtaggagagataatttattggaattgcttacatagataaattcaccaaagttatttgtgtagatttgttaaagtgtatcaatttttaaatcacaatatttctgttttcttcattgcatattaaccaaattttggccattcataagtatgctataaaactaaagtgatcactgctattcacgaattattatagaatcttctttgcagattttgtgatatattaagaaaagctgattttaatattaatatttaagaagttatttgatcctgaaaacctaaatttaaggtataggccatttgacacgtcctttttgaacagaaatttc

SEQ ID NO: 117849 - DNA, 1809 bp, Homo sapiens
atgaaataagaaataatgattggtttcaagccaatgaatctgctaagctaactaccaagttttgatgttgaatggtccaggcaatttatgtctttaggaaagctgagtgtggcaaaggtcacttgttaacatttttcttaacaagaatgtcataactactcattcatttttattttgtccccacgtttggtatttgttttgttttgtgtttttccttcctgatgtcctttgcttttgtggaagattgtcctgttgataggcagaaacatggtggtgatcctctatgtaaaatatagttgcttcttacacatcagaagtatttcactcattttggaatcacaggattttcatgttttcataaatacacacattgttttgataattattagcaattagcttattttgtagcattagatggaaaaatgtttaagctaaagagtttaattttcttgattttggttccactttaataattcaagaggcctccaagttcaaggaccaagtccttctattttagaattgtgaaaaacatggaaatactcttgttagtgtgtgttttggtctaaggtagattattaacacagaaggatcctaggaggatttaagaaaatatgtccttatcgtgaagtggcagttaaagttatgggacaggtgaattacctattcatcttgactagctcaaacaatgatagccatcagctaatgacttatcagacacatgttgagtttgggtcaaactcccattcagctggagtggattggcaattttaaatgcaggtagttggtggtggtacttgacctacctccttaccatgtacatctggcatcttctctctcctatcctttttctttgtttctctctccacttttactcttgctgtaggcctaccagtggcactcaagcttacttcttcagagagaagtaaagaaatttctgactcctgccttagaacatagctaactgatgatccagaacaatttcagtattatgaggtaactgggcagtttttttctgattgctattttccccatagtcttaagctggcagtttgaaggtatctaaattaatgttaagaaacttgtgaactgaagagagtaagaagtatgtgtattttaggtaagttactgggaactgagacttactggtttggaaattggagagtaggacgaggagagctgtttaatgtgtttgtggatgggggtttgagaggtatatagagaatggtttggaaataaagtgagaggaatttttactagaggtaggaaaaggtactatgatggagtccgaatgagagttatttgctaaggaaatgaagttgatcttcactaaggaagtttcaataaagccagagaaaatgggtccctcattgattatgagaaagctgttagttactatagctagagttatgataatgatcatgcattatacaagtctgttttcatgtataggatgtctgcttttctgggacaaattagcacaattgtggaatgacagcttttctggtcaaggcaagtggatgctggggagttattattttgaggaaaagaaaatttcaagcttttcaccattattctttttaaactatcagaaatatttatcacacatactatctattttcttgggctcttgttacaatgtagtttacctttacttttcaaatggtccttagatcaaattatttgattttgtactccacaaagacacatattattccttgcttttatagaattttgagactttggcccacacaaatttcttagaagacaataaaccaggtaaaaacactaacttgcaattttaggtgtctt

SEQ ID NO: 117850 - DNA, 2890 bp, Homo sapiens
gataggagtctagctgggtacatgcttaaaaagctggaagtgaagtgggtggcaagtggcagctccctctttcatgtagttttccataatgttcatatagtttccttatggtctaagtgttacaactggttttcaagttgttatattgaatattcctttttggaattcagggttgaatcactttgagggggaagggaagcaagggcaagagactttattttaaccagatgcggtcttatgacctcaaagatgtgctctagaaagaaaataacaaaaagtgtacctgtgaacatattttttgtcttggtgatattatgcaacacagtgttcagaattgcaaaaaaatttaaaaattgatagttttatcaatggaacagagagatgtgtttttggctaaaattattttttgtaagttatttggttatttcattttatattccctttcccatagctttgtacacacctcatacttaaaaccaagtgagaggcctcttttcagatctggtttatttttggaatgcctgagtgtgtttccagattggggggggagaggtggtgttttactttttgacatgctcttagcatgttttgctagtcattctggatcttatgtttgcaaattctgttgaacattcagtgatgtatttgaaatgagaaagtcctttataacatagtgtgaatgtttgtggccaattcaattgtggaatcttatggctttgtttttactttgggtagaagtttaacttccattgttcagattttaggtttatctagtgaaattgtgccaggtagttgtctaaatatggaccaattttgggaaatgaagattaataagtgtatatttgattctagataatcctttactcaaaatcataagttaaagattcacatcattaagagttatctaacttttatgttgtcaaatctttaaatgtggatgatattcagcattctatctatgaatttcctttaggaaaagagaaaaattcagtctccaaaccttttcttggagacaaaatttaccacatatcgaaaatgaaaaaaatttagaaagcgatttgattattttttaatggagtttaaccagcttaattaatgatttttccagtttgaagcacttattttcccaatgtgaataaagggaaaagatcagcaatttgtccctggcctttttcgaggccatttttagttttctgcccccatttcccagtcctggtataaaatgaattacgggtatccctctaagtccctataaccctttttgggggtcacagatatctttgataatctgatgacagtgtgatggatcctctacccaagaaaaaaaaaatgcccatccctggataattttgcatacaacttcaggggcatcacacatcttctgaaacccaagttaaagatctctgctctaagtaaattgtagagaattttagtgcaaatcgttgataaaattaggaaccaactattggcttaaaacctttcatattggaattattgttagatggtggcccctactagcaaaatgtgacattgcaaccagcttcgttagacattataacaaccagagagaagggaaaaaagcaaagttctgaaagctatttataaggagtcagggcatctctagacatgggagccttcctggttcaaggcaggggtcagggtgcctgacaatttctagcagggtagagtttgataaaccacaatgctcaggatgccaaggggttagccattatcttaaccccttcctcaccaaaagattttagttttgtctgttgggaaacaagatgtcactagggaaaaaaagatttgccttacaactttgctggaacacatcagtttggtgacgttgggacactagtgttatttttgagaaggcgcataaaaccaaagtaaattattctctatgtagaacatttatttactagtaacatttgtttgcgtgtattcgctttgacaatttttaccagtaaatattggttttatttaaaactgggaatccagttgatatataggatagttgatacatctgttctttcccccatgtaaagcatagttaaaagatttatgcatactttttacttttctctcttaatgccatggggtggggagggtgggtgggggaaagatttttgagtctacaactgacaaaatgtcttcttcaaattaaaaaaaattgagaagcagcactttaagtctaactctacaccattttattgcatgtattagttttattaatgatttttggtgcatgcctttgggcttattcaaaagtgtacaataggaaagtatatttcctttcttagaaaggagatgttttctactttgcaacatgtgattacaaaaatcttcctctgtgggaagattaaccatgtattgaactactgaaaagtatatatttttagatatacagaaggaatctacatggagcagcattcagacctatatagaagtcatagcattctgtataggaccaaaaaggaaataacattaaacacttaaacagacgttgttgggtagaaatacctttagatcttgcatttacttccaaaaagaaaaaatgccacagaagtttgctgaaaacttttgtcgtttgaattttctctgtcagtgtatttagcccaaatacaacagctttgggttagcacacacataagaatcaaaaaaacaaagctcactaaataaatcagtctggtttgccaatccagcttgactgaaataagtaaaccaatcacttgcaacatgaaaaactgtccaactcctctaaggttctgacaaaataaccttggctgatgtgggaagactcccactttgattactgacctgacagtgaagattcatgcttgacatgatttcagacttgacaatgtctgtttaaggagctatggtacag

SEQ ID NO: 117851 - DNA, 1275 bp, Homo sapiens
ttgctaattcaatcccagatacctgttgattacctgtgagatctagagtccaaagtagccagcagccatatccctgagtgctctgtgcccatcagatatcttaaagtaagcagggttgggacaggtcacagcttggatgattgacctcaggtgccgtagacagccccagattcaagaattgtatctgctttcttggcagtcgtcactgaactaatgtcccatactgtgttacttactgtagatgctctcttttagaggaggcccagagcacacatcctaatcgctagcggtactcagagagggggtgctaactctgatgccctggccaaattccagtttagggatgtgggtcttcttcttgtcattctaattggaaatgtgcatcacttcccatttttcttactgatctcagtgcaaactacactagtctgtttctttgccctggtctcaagtctctaagacgctggtgtgtattatgtgggctaagttcatgtgttatcctaaggcacaagagttgaggaatgggtgagcttggtgtcagagcactgtgtggttggagggtggactcttgtgatgctgtggggatgaaattggccctcttttagcataagttggggagtgtgcactggctggaggcttccagaggcttccagccatgaggtgtgagctgaaaccaatttttcctctttccttatagcatgttgagaaaatctgttgggttttcagcagtcagggaaggccggagttctgctttaatctgggtaactgaggctaatatgagcaagactttggttaattaactgggttctcagatgccacagactccgtgagaagtcaccattattttcaatggttgtgatagaatttcccccagtagccattattttaagattatattgcagagttgctttattttgagctttttgtgtatacacaatcccaaactggaagaaattttaaaaaaaggaatcctgctgtgaaaggtatatattactctagatttttcttactgtaaatattgtaagattgtaatactgtcgatattttattaaccaacaaatgttaatctatgtgaaatcagacttattttaaatgtgcttcttatttactgtgtgtggtccctgttgctgacagtattaagttatattctgatgtaagattaactttattaaagaatgtaaacattaatgtttccttatgggaaaacaaataaagtataaagaagacaattcttttcattgaaatatactgtgtatttacacttgctagacccag

SEQ ID NO: 117852 - DNA, 1005 bp, Homo sapiens
agtacactgttcagaattttagttaacacagctgacatggttgtgctctgtttgaaagtctaagaataggtattgttggaatatacagtttgtatttgtctgctgtgaatcataatcttgaaatttctaatcaagtttgtaaaatttttatagtgaaacattttaatgacaatttaaaaatttatcttctctaaagaatggtcaaaacaatatcctttcagaaatagaattgttctttaatatctttccaaaatgactttggttaaatggaccagatgtatattagttaaaatttaggactaagttgttgatattctttgagtttacaagttaatccttattggagatgtgccaatatacagttagaatatcattaatttgcactgtttggggaccccatttaagaatgctgaattttgccaactaagaagtaagcaaatgcaatttaaaaagtaaatttgagcattctgtattaaatatgtgcagttattatcacatgaagaaacgcagtgtgtcgggctgtaatattaccatatttgctgtcatgttctcccatctcagtgctgggaaatcaccatgtggaaaccaagcaaacgtgttgtgcatcagccggcttgagtttgttcaatatcaaagctgaaaactagcgaggtctgctgtactgcttattgaagtattgtgattattttaggcattgattcttacaaaatatatactgtaacagtatactttgtacagatttaaattttatttgaaaaaatgaaataaagtaggcaaaaaaataaagatgtttatttttcatgtgactgtataatcagatcagtcttttgtttcagtgctttttgggggaaggggtctggttgcgatcttggattttttttttttttgataggtggaaactttttaggactcagtagcaggtatacttatgcttatgaattggctgcaagcattaagtgtgctctcatactagagaactctatcttctattttattttaaggtag

SEQ ID NO: 117853 - DNA, 1051 bp, Homo sapiens
gaagggctacaggaggagcatcccagacagccaggtcggaactacacggcaatgctggtagggccatggggagcccctcaagaaaggaacccagcatgctcaaacagaactatttgtcatttttcttcagtctttcttttctaagatgtaattggtggtctcttcctacatccacctccaatggatgttaactttcatttaaccatgtggtatatcatttattttggtattttgcatggcttttagaaatcctttgttcctagtctcagtaacaatttatttctaagcagtcaggactgttttatcttgggtactgagttttggaagaggtcctgctctttcaggacgagaggaaagagagttctcttttcagtgtttgcctcctaggtcacctcagggccggcacacacctccactgttctcacttcagcaaccccaccccacccccgccctgccttctagaacttcaggaggaggagccacagtttttcccctgaaactggggattctacctaaatattgcaaatcttcagagtgtttccaatgacattgatacaattttcctaccaatattgattttcattcacttcgatttcctcacatcaggctatttggcacttaggttggcagtgagaaaatgtcacaaaacagactcactgaatgttgcaaggcttaaaagaataggatatcattaccttacagccagcaggggtgtctagttaaccccaccatcgtaggcatcctggctctccctgcatgctcatctcacacctcagacctctgtcagccttctgtggagactagcagtagctgtaacatagctccactttctgtttctggcagtgtcacttagagtgggtctgtactgccactatcccaaatttcttcatgctcaccacactttattttttaaacattgagtgcttaaatattcaaggcaccaaactaagcattttacctgtgttattttacttcattcttactataactctatgaaataggcactattattaccctcaatttatagatgaggatactaaggcacagaacg

SEQ ID NO: 117854 - DNA, 1052 bp, Homo sapiens
cactagctcaagtgattctcaaactttagcctgcatcacctaaagggatcgttaaaacatataccactgggctcatcccaagttgctgattcaaaggtctggggcaggagcctgagaatttgcatttctaacaagttctcaggtgatgctgatgctattgatctaggaacaacaccttgaaaactactgccctaatctatcatatccagagtgtccctatgtcccactttgccagagaccatctggttatgcctgttgtccctgcttaattatttgtagcacccctgtttacctgcacaactatcttggtctggatgacaaatgatgtgggcaccaattttctcacctaacagcctcctcactggtccccctattgccatgattgccctatgtaatccattcacacagtagctagagtgatcttctaaaaagtactaattggatgatgtcactccctgcttcccattacacttagaatagaagtctgactctactatggttacaaggcctctatgatctggccctacttaactctccagctttctctccttcctctcacccacttgttcatttctctcaagcaatagtggttgcctttctgttttttaaatgcacagagcccaccgccacctaagggcctttggcgttgcttttctttcttccttgaatgcacttcccccagatcttcagatggctagctagccctttttcataatcaagcctcagatctcatgttctttcttcaaagaggcttcccctgacaaccaaactgaaatggtcccttccagtcactcccttaccagtctgtttcagttttcttcctagtgcttatcactgtccagattgtctttctcatgtattgtttttttctgttgatggcctaacactgagggcaggattcaccattgcatctccaatgcccagatgagtctggcacatagcagacattctgcaaatatctgatgacaaaatcattggactccagtgagtccagaccatttttgggagtcacctgtgcctctggggctgacttcctcatccactttgaaggt

SEQ ID NO: 117855 - DNA, 1059 bp, Homo sapiens
tgattgagtaggccgcacctgggacactgtgactggaggacgccggaatttaaggaggggacgagggagacgcagctctgtttctcgctgtaccccctcacccctccgaagcagccgcgggcggtgcgcaggccgttctctgcgtcctcgggctctgggtgaggctgggtgcagcgggagagacccggggcgagctgctgggggctgtgtggccggccccaagctggccgcgcgcacacgctgcgcacctgttggagcgggcctctgcctgttcggacccgagccgggcctccacgacacagtccccttgggcggcgaaacggccacatctagctttaggtttgaaaggaaaacaaaatagggggaaaaaagtgggtttacagttgcatacatggactctctgggtcagctcttgatgaggaccaaatatcagtaggtcttttggggctgcagccaacaagctggcagctgaggacagagacctgctccctggccttggcactgctggagatctttcagcttgatgagatgcagttttcacagaaaaattctgttccttagaacccaagtgagtctttctcaaaactgccagagttggtgataaacctgtgttaaaaaaaaaaaaaaaaaattcccctgtgtgtccacatactagccagtatccactccaggtaaaagtttctaccattgagtaaaaggaagttatgtttaggaagtttttgaaacagcccctctctacttgtctgctagttaatcacccacattttgttttggtttggtttggttagatttggtggggttttttttatttgttttcgttttttgcaacttaaagcaagaattaaaagttaattctgaagcttcacatatgctttggcttcaaatcctaacattcagcacaggtttccacatggggagtgccaggtctgacatctgtgtcagtccttattttgattcagggttggttagatagatgctcaaatcattgagggagggaagtcctggatgagggcactgcactgcccaccagggtgtccatgagacactttataacctaag

SEQ ID NO: 117856 - DNA, 1047 bp, Homo sapiens
taaatttttcttacacagtattacatcatacctcaaaagcataaatttaaaacaactgcaaaaaaaacccttattttttttcttggatattttctttccttggatatttaggttgtttttttccttcctctgttttgttttgatctgttttttatgttggaggccttcctccaatgtctgataatctttgtccattcatttatgtatgaggcagtaaatagtccattagaagttcagtgtgcataggctttactgtggagtgactgggtgagtcatttctttggtgtctccccaattattagtatctgtcattttttttccactgggactgttcagttttccagaggaaaattttccactttactgtctgcagagtcagtgccagtccatctagcaggtgtcttgtaatttaaaaaaaacaacattgaaatatattgctttttttcctccatctctactttgatgaggtcttatctccactgaccactttcccaaagaatagtttctgcccttctcattgtgtggttgaatgactgctaatcccgtgactctgagtatgtcttgaatgagatcgtgggatagcagtgttcagtgcagtctattaatggatcttgactgcagcactattttagctgtcccttttagagttctgatttgtctttaatgctacaatttacactgtttgcatttgatctgtagtaaaacacttcactagagtagggtttatattttacctgaccaaatttataagggaaagcagtcatgttacaaagttcagtatcataccttaaatttaaagctcttttgagttttggttatgtaaagtggtttgtactatactgtgtcagtgttaggtaatcttttttgctttgcttttcttctttaccagcttgggaacaatggattcccactggatgaagtcctgtttttcaaatgccagctctaggatctctcatcctgcacacgtgctctttctgtgacttttgctgttctctcactgggatttttttcttgtttagaggaaactgaaaatagatccagattttt

SEQ ID NO: 117857 - DNA, 1039 bp, Homo sapiens
aaatatcttgctattcatttaacacatttatttaggggactgccttgtaccaggcactctgcagtgctctagggacatggtggtgatccaaaacttacttgatatctactgtcacagcctacagtctagtggaggaaatagacaaaaggcaaataaatatataagataattgccaattatagtgatggtgagaaggaaacaaaatgggcagagctagagatttgcacaaggcttgatacaccttgaaggtattttgtaaatgatcttatgggttaggattttattcctgatgatttccacagttaaatgcaaataattttcattctttttgtctcttaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacaggtgtgtgtctctgaatatgtgggtgtgcagtcccgtgtcactaaaggaaatgtttgcatgttttctttggcagagaagaaattctttccagcctttgcaacttgtgcttgatgtccccaaagcttgatgatggcttagggtggattctcactcctgagaagaggcccaagtcagctctgcctgctacattcacacctcttgtcccctctggggctgatgacttcctggccaacgtgttttctgagggctaccctctagagcacttgggggtggggaaggaattagcagttgagtctttgctctgtagccagctttgtattttaggtttagtaattagcctcttgagtttattttatctgtcagcttgttgaccctcaagtcatcctcttgcccctgctactggggtttttcttttttttcttactaaatgttttcataattctatttaacctgccagttgagttttcaggaggctcttgagtccttcttgtgt

SEQ ID NO: 117858 - DNA, 1165 bp, Homo sapiens
gtttagaactttattgagtttgtttagaataagtgcttcctaggttcagtggactttgtccactgttcatgcagaaaatacagatttggtcatctttcttacctttcatgtaatttaagtattgatgtcagcctttttgatgaaaaataatttcttaattctttttagggttaaaaggctccttagttcagtgttaccaatcacgattgatttcacaaatgcagttgaaagctgtttaatatcctttcctatggatatacccaggaatttatttctctgtcattagcttgtgaattattaactgcccagatcctttctgcacccaaacatagcaggtagtgccaaatggtcaaattttgtcacctggggtccatgttctgtgaatgggactcttggaagaatgtagcctcactgagtgatgaaccctttagggacccattttattccttgctttggtattgcttgtgggattctcagtcagaattatgtgttctcatgctgtgtatctgagctctatatggaaatttaagctttttctttccagctgaatgattttagatttatctactactgtagatactctctccactcaagttcaagtgtgtggcatattatgttaatggatacataggtagaaatggtttctttttcaaaggagggaggatctcctttatccttaattggcgtctggtaattagttagggcttaataaaggtgtgatgaatggatgagcagggtcgggtagatggctaacctaagcagaaccttccttggtcatctgtttatgttttagaattcatgtgtcagagattgtagcaaaaaaacccaccttttgtttttttaagaagccaaccttttggaagccatgtgattggaagcagcaagtgcttgtaggaataaggtctcccagaagagcatacctgcagattatgtcaaggatctcctgggtggtttttaagaataacaactagtatttgttgagcaccatgcttggtgttagctttatgtaatcttcacaacaaccccatagtatcagtcccatgttataggagtggaatctgagactcagaaaggttgtttcagttatctgttgtataacatatcacccccaactcactggcttaaaacaacaatgatttattatttctcatgattctctgagttg

SEQ ID NO: 117859 - DNA, 1033 bp, Homo sapiens
tagagacagggtctcgctctgttacacaggctggtcttgagttcctgggctcaaaccatctgcccgcctcggcctcccaaagtactgggattacaggtgtgagccactgcacctggccttaattaaaattttaagtgagccattgcttttgaacccagtgaaggaaaaggtcttcctaataagcttcatgagcagctgaaaaatacatgactttttctgatggcctgctgagggagaaggttttggaaatttggaactataaagaactctctcctgactggacaggctgtgtttctgagcctctctgcagtctggggctagagaatctggatgtttggtaacaatttctagattaaaaccaccagaaccagaagagtttggggccagtggtttaagtttttaagtattaattattaaataataaatactagccaaataatagaaccagtatttgtctagtagttattatgtgtcaagcacttttgtatattagctcatctagtcctaagaacaatcctgcaaggtaggtcttcttatctccatcatatagatgaagaaactgaagcatggaaaggctaacttgttcatggtcacagagctaagaagtgatggagctgagattcaaacctagcaatctgattccagaggctatgcttgtcagcaactaccaccattttctgagcacctactgaaatccctgatacttggctgagagcattgtaaacacggcttccaagttttacaacagctcttcagggtagtggtatctcaaattttacatctgtggaaccagggtcttagagaagctataataacatcttgtctatgatcccccagatctctgacccagagcctgacatacttccatgtatcatgtggccttccatgcatgagtaaaaattgttttataacctactcttcccttttcccctggaacctcgtacagcaaatacctgttaaatcccttcagtggccaggtgcagtggctcacgcctgtaatcccagcactttgggaggccaaggtgggtggatc

SEQ ID NO: 117860 - DNA, 1055 bp, Homo sapiens
gataccttttcagcctggagaattttagagacagagacagcgcaagattatattgtgagttcttaatgggtaaaagtgactttttgcttttggagagaatgtatatcatgggtaatttgtttgtgaaggattaatatttctctctcctcctcctgagcctccaaaaaagccctttccaagtacctcaggcagctagtgggtaaccatgaactccccagggctgtgggcaagatgtcctggggctgcagatttgaagcctctgtgaaaaaggtgtatcctgtggctactaggcccactctccctggcctagctggactcaggaccctaagctccctctgcttgcttgattctcttccaagatcttctccaggcagattattccctttggaataaagtgatggccctgatatcaaggactaccctcagcccctttctagaaaattcagagtacgccaagatctcttctgaaggggttgacctgacagaagtggagtgactccctttcttaagaacttgagagcagttgggtctcatatttttccttatcagtgctttgcagttgcttcagagtgtcaccagctaagcccatatctgcagtttcttaataagacaggcttttccaactgaggtaaggagtacaagacaggttatttgtccatccactcattcatttagtgtgccaggcctactgagtgccctgtggtaggctgtgagcatacagtgataagtggcattgcagtcctcaacattttcatccagataaaattaggagctgagggtccccagagtttatcttggaggtcaaaaggaattgctaaataggaccatttccatttccctgttcaatcatgggagaaaagtggtgactgtgagagttggtagaaaggttcttggtgatagcccgctccagctagccgatatggtcggtgtggtaataaggatggctgtggttgtgaatatcattaggaggcagtacccctggccctcctggattatcactttagagcctagcatccacagggagttggactaaggcagtaccttagataaacaga

SEQ ID NO: 117861 - DNA, 1624 bp, Homo sapiens
gcacggctgacgagctggggtgaggggtgaggggacatccagaagggaaaacttcagccaggagcggtggctcacgcctgtaatcccagcattttgggaggccgaggcgggcagatcaactgaggttgggagttcgcaaccagactgaccaacatggagaaaccctgtctctactaaaaatacaaaattagcccggcctggtggtacatgcctgtaatcccagctactcaggaggctgaggcaggagaattgcttgaacccaggagggggaggttgtggtgagccgagatcacgccattgtcctccagcctgggcaacaagagtgaaactccatcatctcaaaaaaaaaaaaaaaaaaaaaaaaaaggaaaacctcttggctggccccatgtaattgtaggttcctgggtttccagggagcaggcctggaagccactccaggggcagcccctggttaccaaaaggccctttcctaggctctgggtaaaggcaggtgcaagatgtggcaaatgctcctccctgagcctatctctgagtgggactacggggagagtagcttggccgggagcccatgacccagctggagaacacctggccctcagaactggccgcctttgtagcaccctcactgtttgcatcaccaccagaataaaaaggtagattggctgctggtcatacattggatggtggccactagctgagatagatacccacattttataagcctcagtgagcagatgagtagttagttagacatggtaacagtccaggagacaagcacagactccaggtagcttagcttaggcctggaatcatttagacagacagttgagctttggacaaatttattgaaacatacaggcggctgttagcagagaaatcattccatgattgatgtgttacatttggccactaccttgaatgtataatttaaaaattatatttttcacaactaagcctttggccaaaaaagtcatttagcacatctttaaagatcaataagaaatggattttggacattaaaaagatcaagtcactgaattaaacagtagcaacccccattaatctagaatcccatagtgctgaaggtagaggtgtctgtgcaaagctagtcatttgttaacagcaatcagaagagatgggggcaggcacacctgtcagaggtggcagcagagctggcaggacaggacggctgggctggtctggtcaggtgagcatgtcccagagacagcagcaacagagagccgtccagcaggctgtgaggcaggtggatggtcctagctcatctcttctttggtcttctaccacatacactggagggagaagagggaagagggtgagaatggactggtgcaaaccccaggccctgcaaagttagcctcccaggaccacaggaaggctacaccaggggaaaactattgagcagactggtgaaaccgtgttcctgccattgctgctgctgaatggaaggagggtggctcagctcagctgctttctccctcctgccactccagactcaggacgccctcaccctcacagggacaagtactagagaacttgcagaatggccccatgccaaggcaaccagagttggccaaccctacttggtttgtaaaccaggtag

SEQ ID NO: 117862 - DNA, 1093 bp, Homo sapiens
ttctccctgctgcctgcccgtgatcacccatggttcggaggtgaggggagcactgtgggcaggtgtgtgtacctggcttgcagtatactcctgaaagttgcctgtcacaaaggaaaagccataaccattggacatcaaagctgtgtcttccagcccggcccattcactctggtcctaacctttgtctgtctctcatattgcagcagaaaaagtcctacctggagcgaagcgttaaggaagctgaggacaacatccgggagatgctgatggcacgaagggcccagtagggagcctctctgggaagctcttcctcctgcccctcccattcctggtgggggcagaggagtgtctgcagggaaacagcttctcctctgccccgatggatgctttatttggatggcctggcaacatcacattttctgcatcaccctgagccccatttgcttcccagccctggagtttttacccggctttgcctgccacctctgcccaggacactcttccctctcgggatgtgtgatgaactcccaggagagggaagatgggagccagggcaagataggaagctctgcctgagctttccactaggcacgccagccagaccaataaaaagcgtctgtcccactctgctaagcctggttttcttgagcagagggatggaacagagggtgagagaggcagtggccgtctccacctcagctcctgctccctctgcatcagagcccttcctttcttgggggatgggccttgccctcttctcttttcccttcctgtacctttgactaacgctcagcttccgggcctgcatgcagtagacagaagaggaagaaagaacagatgttcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattcaattttcaaga

SEQ ID NO: 117863 - DNA, 1059 bp, Homo sapiens
aaacaaaatgtaatgtatatttaaacaacacttgtgtagtggattgtggtggatgggcaggagagtgggtaataatgataaattttagaggatcttggtatagggtcttttttacacattgtaatttctttaacctaaattaggttctatataaggacaaagtagcaagctataaccaattaactatctgaaggatggtgctccaatgagaacaattttttctttttagctagggaaaaagatgataggtaacagtaagcaaatctttggaaatattactttattatttttattattataatttatttatacattaagacctttagtgagatattcttcttgggctttggtgaaaggcccatcctgtgtatagtaaaagttagactggacaaaaagctggttatttcttagggaccaagatttcccaacatgtgggtggatacattgacttcataggtcatttcatctaatttctgtaagtactatttgaggcagaggatcagaatctaactcagccctctgctgaatttgggagctacaacttgtagcctcctgaggatttcttaggggcactgaattggcctggcctgggagtatgcagtatcttaggttacttaggcttatttttaactactgatagttgaaacaaacttgataatagatttgcagcttagaaaagtgtattgtaaaaacaagacaaaaaagcaaaaaaaccaagtaaagaaaaaacagcctgtgataaccagattgttgttgtgtcctattttaacattttaatcagctcaactgttctaagaggttcagtttgatatctgtgttttcactcataagaaacaaaagtatctttaaaaacccaaacagaatcatttcatgtagataaaacaaaatgcatttttgcaactgtaggtaaatatatttaaaattatcctaatgaataataagtagcaaggtaatatgtatataattctctttatgaaaacaaaaaacaaacatttgtgtatgaatattgaagatgatatgtaaggatatatattaaattgttaatactgtttaccctaa

SEQ ID NO: 117864 - DNA, 1080 bp, Homo sapiens
tggccgcattaggatataagcttaataattagtggagtaaaagaagttcttcagattttattaatatgtgtggtaaggcttagttatgaagaagaggggacaaggcagtttccttccaggtgttggggcatagctaattgccctttttggtctgtttttacttgtcttatatctataataacggactctcttgataagaacccacctaggcacaatgatgtttttgtggggttggcagaggaaactgcatgttgctaccttgatgtgttttctcgtttgactttttgttaagagatgatgtttagttctttgttgctgaactctgttagtgcaaagagaagaaaaatcttgcttaattaattgcaatattaaattgaaatatattttagcttccttagacagtcctgaaagagatttgcataactggggtcttcccttggttccagtggaggggaaatatttcagttcacttacttggggctataaaagtttgttcttcctttccctgaagcaagaattgtgaacataaagtcataaaacagtttcagtgttaatttttaaaacttctccatatttccaccctcatcagtggtaaataatgtgcctgatgtaaaatggaaaaagttgaaaatttccacttgtacattttgagcttttcagaggtactatatacactctggaaataataataaaagatactaaggcttatacagtgctttttgtttgaggaactcatataaacactaatgcattgatcctaacacagtgcttgattgtgactttaaaaggtcatgagttactgctgttacaaaaaaaaaaaaaaaatggaggggcgctccactttacaaatatagtttaaaaaatatctagataaaaattgaaacagataactgaaaaaacaaaacttatagggtatttgtttgtatgttgacttttctcttagcgtatgatatatttttattcctttattattttttcttttacatatgaatctacttgaagcctgattttcttttctttttttttttttttttaatgtttttaagacaggatcttgctctgttacccaagctggagtgc

SEQ ID NO: 117865 - DNA, 1712 bp, Homo sapiens
gctaaaaattacgacgtaaaaattcagtaactttcctcaccagtggagttaggcaaagaagcaagataggctcattcttttttttttttttttgagatggagtctcgctctgttgcccaggctggagtgcagtggcgcgatctcggctcactgcaaactccacctcccgggttcacgccattctcctgaagataggctcattcttatgtcttttctatgctgcttaatttgtgaataccctgaaacctaaatgctaataggatacgtttttagacaccctctaaaaatttcccacccaaagtgaactcgtcataagcattttgttgtttctgaatagcatatgtctaggtgaccatactttggaaattgtgtccaaaatgcagcagtgcaagtgatctgggattgtgttttgggcaggtgaacaatggttttgattcatactgagttataagaaagtggaagttgtaccaaactgcaggatgatttagaaaacggagtctgatgtttctcaaataatcaaaaccgaaagtctcagaattatgttttcagatggcataattacaaataaatgaggaagtgaaatagcaggttacaagtccttgagagtggacagtgcagaggcacgtggcactgatttccaggtcaaagaagaggccttttgcaaagcatcaactcgaattcaggttatataatcctgagtattttaagcatgttatctgcatattatttgtcatgagagaatactttccctcttcatggtttatttttccttattggtacattttgaactccagaattctttatttactatttggctttccataaacaatcaggcagaatgactatgagattctctacattgagcaactgtgtacataatatttgcttatgataagacttatattatcatgataaatcctttctcttcacatagtatctgataatccaatgcccttttaaacaataagaaagatgttttccaaagactttttttcagaaatcagatgtttcttggagccttttccagtcttcatacaatatatctttgccattttttaaattgaggactaaaccaaactttccataagtttttgtgtttgaatttttactgtgtaactactctttgaggtagacatttgcatttacccaacattcatccttgttaaaacttgcgtggctgagatgtccttaggtttgtagtagtaagttggccagcttcggtggaatctctctggcctttgaagttggcacagtccagtatagctacctcaaaggatatgtggtcatggaaaaacgtgtttttgttgttgagtgttcttgctttctagtaattttattttctgctcaagagatttagtatctgttcagatactttatttttaaaggccacataagtaatgacttgacctctaatcttagctttgaaattttcccagacactaataaagatgatgtctgatgaccttttatttgagaatagtactcattggccagctatcagtgctacttaaaaatgtatattttactcaaaaaattatttccatggctaaaagactttctcagtaaaatcacacatgtcatgacataatttggtgactcttgcaccttgttttagaatagtttttacataacattactgagacttagtactgttcaaaacaactcttctcttcaaatacaaatatgagttagttctgagaaaaatattctgt

SEQ ID NO: 117866 - DNA, 1322 bp, Homo sapiens
atattacagtgaaaatagtttatattgttgctctcagcagaatcaaatttggatattttatttagtgcatactacaggggaaaaaataatgtgtgagattacttttggtgtgagagtcacattgcaaatgccaatttataaattcattttataccctctttaaaggtattaatctgtattttagagaaagtgaagcaaagatagttgtcaaaagtaagatgagattactttttagattttacttgaagaaagagaagttcttggtgttcagctgcttttactaatagaacatgacccacccttcttgtgtttttatacagagccatttaaagtcatggctttcattgcccagagttctaagggaaaacaacaacatcttttcctgttgtgcagggaaaaatgacttaagttttgttgacgctgaatatgtatataaccccagatgggcacacattcctcttgcacagatttagtactctggggagaggagatttttaagtcatattcttaatttccttaagttgtcagtgatttaaaaacttgatgttcattataactctgctctactgctgtctagaatgacatcactgtttttgtgccagagggagttaacaaacatttgcgtaagaattacatagtcctgtttcttctgcagacgagtactttttaataattatttccctgcttcccctcccatatgccccagtctaaagattctcaccaaaacacaggaaattaattttgaaaatgttatgctaattagatgtctattgttaaaaaagggaaaagtctgttatcttggagagtacaaacatactaaaataaacttgctatggggttacttattttaggctttggacctgttttaaaaacataaatgtaattgattcatttagctacttggtggactttgcttgcttctgcatttcctgacatcaaaagacctggcctttttttttttttttaactgacaaaggattaaacaaaatcagcctttgttgtatgaaaagtagcagtcatttgcgggatactacagtgttttccagtcaatgataagcaactgagcgaaaggtgaaaagtaccatttgcttgctgttcctatgtaaaaatattaaggtagcagcagtcttgaactgttaactttgtcactgaggaattgtgtgctgtaactgacttaattagctgaatttctctgaaaacagtcaattttaagccataccaagaattttctgattttagctgccacttatctcatagtgcaaagttaggaataacttactatctaatctgagagagaggactgaaatgttcatgtcaaggaa

SEQ ID NO: 117867 - DNA, 1105 bp, Homo sapiens
gaggttaggggtttgagaccagcctggccaacatggtgaaaccccatctctactaaaaatacaaaaattagcgaggcatggtggcgcacacctgtaatcccagttacgagactgaggcaggagaactgctcgaacccaggaggtggaggttgcagtgagccgagattgcgccattacactccagcctgggcaacaagagtgaaactctgcctcaaaaaaaaaaaaagtaaaaaatacactcattctaagtgtcatgcattgttctaataggaggacaactcacatgtgagaaatctagtaaattattttacttttgtttgttctaattaatacattattaacttcgtacatttcacttttttttcttttaaaagcatattgcccttgtgagagagaataggtctgcttcatattctgtaagcagaaaaaaaggaatggaaaagcccttaagtacaggtcacattccattacagtgagctaaaaggagaagactgattttttttttttttaagttggggggaggtacaggaggagggtttttctggaatttggtctttgagtattacttagtaagtagaccattacttcagatttggagatcttttagttagaatggaatttgacctcagtctcgggatgacttgttttgtgattgatttgaagaaagaataacatgtgtaaaatttaataatgactttggaatgacatcatgagaagtagacctgctcatcactgactaatccatatctttatggttcagaattagattatgttaaattgttcatctgatttgctttctcagaatgaataatgtagcacaagtaaattttatgtccaagctcatatatttcattttagtttaagaggataaggatcccaatttgagagtttgttactgggacacaaaagaattggaacaaagtagaacccttgaatatgtgtctgtgtagtatgaaatgcattgttggcattcactacaggataattttatccttaatgtgaatatccttaggtcttaaaacagtaatgccagctttattaacatgttgtacttggatttcacatcactgcgctagcctttgtttgcaatagctaaagaattcct

SEQ ID NO: 117868 - DNA, 1093 bp, Homo sapiens
tggaattactgagaggcataaatgagatatttattatatttcctcattaatattcttatattaatattcccatgttaatatttcaaactaatgtgagaaagtgctttgaaacctaattgtgcaatacaaatgtagtgagttattacttttatggttcttgttttgaatctctggatttcatccttgactattgcatttatttcttttactactccttgagtacttgctacttaatatggttattacttaatatgcatttgatttgcttcacactgattgtatcttctgatgattgtaaattcagtatttagtatggtgacttgattgtttacagttatgttgacttttattgatgtttggtaaatttcacagctttgtctctggctagcatattttgttttaatatatttggatttgaggtaaatgtttcctgtaaaatgttttacctactaaatcatggacttgtttttattaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtaagtaaaatgtgtccttaatggagttattttgggagtgcttttgtccgagttaaatagaatttgttcatcttaaaacttgggttaggccaggagtggtggctcatgcctgtaatcctggcactttgggaggtcgaggcgagtggatcacttgagggcagcctgttggccagtatggtggaaccctgtatctaccacaaatacaaagattagctgagcatggtggcacttgcctgtagtcttggctacttgggaggctgaggcaggagagtcgcttgaaccccggaggtggaggttgcagtgagccgaaatcatgccactgcactccagcctgggcagcagagctagactctgtctcaaaacaaaagaaactttggtttaaagtaagtatctttttctttttgagacggagttttcgctatatcgcccaggctggagtgcaatggcccga

SEQ ID NO: 117869 - DNA, 1038 bp, Homo sapiens
agtagagacggggtttcaccatgttagccaggatggtctcgatctcctgacctcgtgatctgcccgcctcggcctcccaaagtgctgggattacaggcatgagccaccgtgcctagctctatgcctgttttcaagcagtgtaactcatctgtcatgagacctggaacaagttactgtctttctgaggattgtaaccttgtagtgattgtaatgtttgtccatctacctcataaggatgttgtgaggatcacgtaaatgaggtgaaagctatttgtaaattgcatcctgctattagagacaggagttcctcggggcagttgggcctttgaccagagtttgggctgccctactgcctgggcttttccaagtagtagaggaaaccaccatggcagagttctttggaaggacctgctctggacctgcactttgtcatagcaggcagggcttattcacaaaacttatcttcctcaggtaccataggagaggaggttatgatgtggaaaatgaagagaaagtgaagttgggcatgactaattcccactgagagagacttgtgctcaaggtaacgctccatcctttgccccatgacatgattatcctttgtcccctttcctggctgtgcttcagtgggtgctgaattcttcatataggggttgggggccaggctactgtgacattaatatcccattgcagaattattttcaaaaagactcagtgcttcacttaaggtaaaagttgctagagagacacctaagagagatgcctgagaggacagcttctcccaccctcatcccctcccttcccctcccctctcctcccctgggagacagagtgaaaccctgtctcaaaaagtttaaaaataaaaaagactggaccaggaaaatcttaagacttctttagactggacctggctttacatgccttccttttgtgctttaggaatcggctggggactgctacctctgagaagacacaaggtgatttcagactgcagaggggaaagacttccatctagtcacaaagactccttcgtcccca

SEQ ID NO: 117870 - DNA, 1060 bp, Homo sapiens
tgtctccatctgacttgggtgccccattcctcaggccatgggcagtaacctctggagtctgattatgtaataactcacacaatgtgggacttggcctttataaagccctttcatttgtattacctcattttatcttttcacaatactctagtgaagtaggcatttcttatccctgtgttttacatgaggaaaccaatgtttagaaaggtaacgtgacttgcccaaaattacctggctagaaatagcagcagaaccagtctggaactcatgcactcagtctcctccatccagacgtgtcccctccacctcctggggtaaaggtggagaaatccagtttggaagatgtctctggaccctagagggttcttgcatctgttgtaatacaagttctgaaatgggtcacagacgtgggtgggaagaatgtgtcctagtctggtgggtggctggctctggacaagacacaaaattttgcccctaccctgggatgcttggaatgtactcatcccccctccttctctggggaagccaggagttgtctgcaaagggagggggaggtaggtaatattaggatgtttacattattatccttttgactcagggtgggggtggagggattatgtaactgaattgcgggactctgaggccaaactttatttctatcttctgagtaactacctgtggagtttgaatgatggactggaagtgaaaaacagactcaacttcagcttccctcctcccaggaaagcaaagtctctgaagtcatccagactgctgttgaatcctggctctacgactcactagctttgtaaccttgggcgaggtgtttaacaaaagctaagcctcagtccatctttaaaatggggctagtaacttctccttcacagagctggctttaaatgaaataattcttgtaaagcagttagcacaaagtacttggctcatggtaagccttcaatgattgctaattattattctttattattcaagttatgagtaataaataataataacatagtcagagagaagggtcagactgccccccaggagcctatcagatatg

SEQ ID NO: 117871 - DNA, 1029 bp, Homo sapiens
aagctctggtcactgggttcctctgaccacctgtatcaccttctgagctctgagggggcctgggactggatgagaggaaatgaaagactgtgggggctgctggcacctacttctcttcccttcttttggctttgctgggcaaggactatttttcaggtctggggatcctaccacctaaaataaatgactgctaccatttattaaattcctactgtgttctaggcacttgatatgttatcctggctaatgtaacacttatagcaaccttttgagatagttactttggctatccacattttactgagaacctgaggttcagaggagttaagtgactgcccacagtaaatagctgaaattggagcacaggtctatggacttcagagcccattcatgcctggatcagcatctcaggtgctctagacttgtgagagggaggagatgggagtgtgtgaggcagcttggtgtggtgaggaaggacattggagtgaagtccagagaacacagttctaatcccaatcctgcatgaccttgagtaagtcactctgcctgccatgagttttttctttttttcttttttttttttttaaacatagtctcactctgtcacccaggctggagtgcaatggcacgatctcagctcactgcaatctctgcctcccaggttcaagtgattctcctgcctcagcctcctgagtagctgcgataacaggcacacaccaccacgcccggctaatttttgtattttttgtagagatgagatttttgccatgttggcaaggctggtctcgaactcccgacctcaggtgatccacctgcctcagcctcccaaagtgttgggattacaggcgtgagccaccgtgcctggccacatggtattctttgaagtccctctagcttgagactctaagtctctagtctaacgtatcatgcttacccttctgtaagacacatggctgtagccatggatgtgggcacctttttcctgatgggggataaaagggtgggattgggctgataggcatagtccct

SEQ ID NO: 117872 - DNA, 1147 bp, Homo sapiens
ggctccgggaccctcgcctcccacacattgtgaggcgtgaattctctttgggtaggctctgggccggggccatcctcccgcttccctggtggagcccttctgtgacagcggtcggctccatggcggcggtggccgcggtgagggcctagtgagccctcggcttactctttagctcgagcgggacaggttcccgtcaccattcgtagacccacaatagggagtcctttggtctctgagcttcgcgcgggaacagggactcctcaggctgcctcccgcccaccctgctttggagttgggggtggggggcggggtcttgccagagtccctgcccttggtactgagagagacaaacagagacagagacagagctggtgcaaagatcgtttctcttctttgcctctcctcagagttgagggatacgtttatttgccttctgccttgtgtgtgtcttacctgtgtgcttaaggacggttcttattctccctcttcagtttgagacaggtttgagtattagggatctctcggcttttaccctgaaaaatcacgtgactcctccttctgggaccttttgtgaagttagacaggaaaaggaagttccagggcatccctgagcttcggaatagctgggtagctgaactcggaggttttaggcttggagaaagtggggcaacctgtggaaacctcttcttttttttttttttttttttttttttgagatggagtttcgctcttgttgtccacgctagaatacacgtgatctcagctcactgcaacctccgcctcccgggttcaagcgattctcctgcctcagcctcccgagtagctgggattacaggcgtgcgccaccacgcccgactaattttgtatttttattagatacggggtttcaccatgttggtcaggctggtctcgaactcctgacctcaggtgatccgcccgcctcggcctcccaaagtgctgggattacaggtatgagccaccgtgcccggctggacaccttcactctgcctttgcagtgaagtccttcatttctttaactcttctgtgtgtactctaatgtgtacacatttttaggtctgagcaacctgggatggtaggcattaacttcttttgggttctggggaaaaaggggcgggttttgtttttg

SEQ ID NO: 117873 - DNA, 1147 bp, Homo sapiens; identical to SEQ ID NO: 117872

SEQ ID NO: 117874 - DNA, 1147 bp, Homo sapiens; identical to SEQ ID NO: 117872

SEQ ID NO: 117875 - DNA, 1147 bp, Homo sapiens; identical to SEQ ID NO: 117872

SEQ ID NO: 117876 - DNA, 1013 bp, Homo sapiens
ttgtgatcccaaggggcggtattttatgtgtatacttttttctgttgactgtggcttgcgtagagtactgtaccgtgattgttttaagtgctcagagtatttcttctattttggttctgaggtgcctgagttgtcacctgtgaccagttattttaacctctggtcttggtgttaaagtacaggaatttctctgtgtgtactaacaatcccggctcttggatttgagaggaataaggagaaattatttgtgggttacagactgcagttagtatactgtcttatcattctaggtctgaacagggttttatttaatatttaaaaccttagtacattctgaccctaacattttgctttggaaaaaaaagtgtgtgggttataaggcgggtagtcccttgaatgtctacgtctttgaatttcacggtaagggaaataacttctaagccaaggtgagagaaatgttttatttgagtaggcagttatggggagagactctggagtatccctgctcttggtcttgtggaaggctttattttatcctttcagtgaaacgtgagagattaagctagaacacagtactttttagctaggaaatgaagtgtgggggatatccttagactaaagattagagcttattttctatgaaacttgtaaatgagaatctgaaagagtttgctttggtctaaatgtgatagaaaaaggggaccttgattttcttgaccatttttacataattgtcatgggtgagatgaaaggtcactcatttgcctttttttttaattttaattttttgttttttttgttttttttgagactgtgtcttgctcttgtcacccaggctggagtgcggtggctcgatcttggctcactgcaacccccgtctcccaggttcaagctattttcctgcctcagcctccctagtaactgggattccaggtgcctgctaccacgactggctaatttttttgtatttttagtagagacgaggttttaccatgttggccaggtgggtctca

SEQ ID NO: 117877 - DNA, 1013 bp, Homo sapiens; identical to SEQ ID NO: 117876

SEQ ID NO: 117878 - DNA, 1013 bp, Homo sapiens; identical to SEQ ID NO: 117876

SEQ ID NO: 117879 - DNA, 1013 bp, Homo sapiens; identical to SEQ ID NO: 117876

SEQ ID NO: 117880 - DNA, 1765 bp, Homo sapiens
aagcggatggatcatctgaggtcaggagtttgagaccagcctggccaacatggtgaaagcctgtctctactaaaaatacaaaaattagctgggtatggtggcaggcgcctgtaatcctagccacttgggaggctgaggcaggagaatctcttgaacccgggagacggaggctgcagtcagccaagatcataccagtgcactccagtctgggtaacagagcaagactccatctcaaaaaattagaaaataataaaattattacaaaatagttacttgttgaaaaactcaacaatatagatagtaggtataaggggaaaagtaaaagtgcttcttcccacccccattaattcttcaaattctacccttcaaggtaaccaatattaaaatttttcattcagtaaattttctaggcctatctttctatgtatatatgtatatatgttcatatacacatactttaaaggcatatcaaatttaaaagtgtagctttatatcacactgaggtttttttcttgaagcaggtgctgtatttacaattatataaaagcacgcagaaattgtatttagctctgaaaatatagcacaagctttgtagggattcctttttccctgaaaattacttttaacatcaaaagcaaaagtcatacagaaatcccatcctgattttctccagtaggtaaggagttgggtcatatcctttaagattgtttatgatctatatataatctgttttttaatttttaattaaattttttttaccgttatgtgttttgagagatgggggtctcgcttttttgcccaggctggctgttgccctggctacacagtgcggtggcatggtcataactctatgtggtctcccactcctgggctcaagcaatccttctgcttcagcctcccaagtagtcaggactacaggggactataggtgtgcaccacaatacttggctagtatgatctataatctagagcagtttctcaagagcaacatatagacattttgggacagagaattctttgttgtgaggggctctcctgtgcattagaagcatccctggcctctacccactagatgccagtagaacccgattatgatagccaaaaattgttcagacgttgccaaatgtctcctagggacaaaatcactcctggttgagagctaccggtctagaggccactcttgtcaggaatggtagttttgttatactctgtattcaaacttaaggtaaacaaggtgagtcactgcttttaatagcatttcaggacttatgcttataacctgaacaagggagaaatagaaggtactgaaaggtttaatataaaactagcatgcactgctgtaaattttctatggtaaatgtatcattttggggaactttcacttaaaatatattatttttcaaaaagttcagttgtccatgaaaatgaatttttaaaaaacttttatggggacttccagtttgttcaaagtagaaatgctttattccataaattatcatttgtagtgataacataggaaatataactttgtattctagtgggctaattttggagactttggaaatgcttattgaataaaaagaattatatgttattactgtaacaattttttttttttttttttgagtcagaggagccttgctctgtcacccaggctggagtgcagtggcaggatctcggctcactgcagcctccacctcctgggttcaagtgattctcctgcctcagcctcctgagtagctgggactacaggcccgtgccacca

SEQ ID NO: 117881 - DNA, 1765 bp, Homo sapiens; identical to SEQ ID NO: 117880

SEQ ID NO: 117882 - DNA, 1765 bp, Homo sapiens; identical to SEQ ID NO: 117880

SEQ ID NO: 117883 - DNA, 1765 bp, Homo sapiens; identical to SEQ ID NO: 117880

SEQ ID NO: 117884 - DNA, 1057 bp, Homo sapiens
ttattttttgagacagggtcttgctctttcgcccaggctggagtgcagtggtgcgatcatggctcactgcaaactctacctcctgggttcaagcaatcctcccacctcaaacctccccttccacaccccacccctgcagctgggactacaggcatccgcagccacactccacactcagctaattttaaaatattttttggtggaggtgaggtctcaatacctagggtagtttggaagttctggccttaagtgatcgtcctgccttggccttccaaactgctgggattacaggcatgagccaccatgcccagcctatttattcaaattatatttgtcattctaaactctttttagatattaataaattgtatttgagtgttctaggcattgtgcactttaattgcatcacctcatttaattttctcatggttctgtgacagtccaagataccaaattcaatgtgtggatcattgccctgtgttagttggatgatcactctaaagattgatatttgagtgtcttgcttcaggagattgatgggctctaagtggcaggtttaaaggggcagtaatttaaaatggaaggatgcatagtccatcagcataagattgtcttgtgcttatttttgagcaaaaccacaactgctccttattatgttctgtaaactcgccaagcctgtgatgcttcagggcctttggcacttctggttccctctgtcaggtacattctcttagatatccatgtggcttccctttcacttctattatgtttcatttaagagaccttccaactattaatacctactgtatgtatattgcataaacatctcaggctcattaattctaaaactgaactcatactttccccttgcactccactatgatgaatgtgtcccccaaagttcatgtgttagaaacttggttcctagttcaacagtgttaggaggttgggcctaataagaggtaactgagtcattaggacttctcacaggagctggttaactatcctgagtcgctttattgtaaagcacatttggccccctcttccattagctctc

SEQ ID NO: 117885 - DNA, 1057 bp, Homo sapiens; identical to SEQ ID NO: 117884

SEQ ID NO: 117886 - DNA, 1057 bp, Homo sapiens; identical to SEQ ID NO: 117884

SEQ ID NO: 117887 - DNA, 1057 bp, Homo sapiens; identical to SEQ ID NO: 117884

SEQ ID NO: 117888 - DNA, 1050 bp, Homo sapiens
tttaattttaattttatttgtaagaatgaatttaatttaaaatgttgccccagaagatggttgtgaccaaaggaagaaacaattgaattgtttgttacagtattacagactgtctcccctctgaagatactactgaaaatagtaaagacagatatcctgtactagagatcttatggtgtgactatgtattttgaaagaaatctcatttatttgatagacagcctcatatgaagttacatgtggattaggtagaggacaaattaatattatgtgcattgtaaaggtagaaagactaaaacataggtggttatgccatggccttttgacattagtggcagaattgaattgataagccttatcttctgtcaacctaacctatggattctataccatttctttttcctagataatagtgtttagaaatataattacaatttgcacttttatacttttttttttgttgttctgcactacctgattgattgatgcacactgaaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacacgtatgtgtttaatgacttttggatattagacattttcttgaatagattttggggaagtagccaattttggttaaatatatcttttggtggagcttataaactttagctgaaaggatattacattttaagtggatatataaatgtatatgtattatgtagctatacaaatggatatttttgtttcttcattcagctcttattcgttgagcattcttgtggaatgtattacactagagtctctgagaaatccaaactgaataagatctgttttccagttataaggaagttacttattctaaaagttattatagtaaactctaaaccgagtgcttgagtactaatacatgaaacgagttactaatgcagtagtgtagttgcttgctactcaaatatgg

SEQ ID NO: 117889 - DNA, 1081 bp, Homo sapiens
ctgccaacatggtgaaaccctgtctctcctaaaaatacaaaattagtggggcatggtggtgggcacctgtaatcccagctactcaggaggccgaggcaggaggatcacttaaagctgggaagcggaggtggtagtgagccaagatcgtgccattgcactccagcctgggcaacagaatgacactctgtctcaaagaaaaagaaaagaaaattaaggtgatgcttctaaccaatgataacgaaaaaaagttgagataatagttgtagtgatttgtgtaagggaattgaagaggtatacctagagcattagcataatcataattgtatctgttctgtcatgattgtatatttctttttaaatcttttatttatttttattttttaaatatatattctgctcatgtattatatttcttcttcttctttttaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggtacttaatacatgtatgaatatttataatgtttttcgtaaccactttgattatttgagtattgagtatttgagtttactttatattgcttatgttttccctgtgctataaaattatctagtttataagaaattatatagaaagtctattttagtctatattgcctgtaatatagttttctagtatatgtttattattttaattcagatttattgggttaactgtgaagttaacccaactacttagcttagatttagagggtttccattatttaataacttttgttttatatgatttttccaatgtttatttaaaaaatagtacatgccaaagtaataatacacacaatactgaaaacctgaaaaacacagagtaacacaaagaaaagaaattttttgtttttgagacagaatgtcgc

SEQ ID NO: 117890 - DNA, 1675 bp, Homo sapiens
acataatttgttgtgttattttttgccatgcctttgtttctgaaatagatgtaatacggtttctacatttgaatatgactcctgagtttgagggtatgactgtatttgacctggcagtagtataatcttgttattttgaggtagcattgactatagatttcacagttttttgaacttcaaaaaatggaaatttaaaattatttggatttgtgactgttatgtcaccaagtctcattcttttggagaattttgggcttgctcaaaagttggttaaaataatttgaaaattacttaaaagcaatattgatgaacttttgataaggctcagatgagcatgataatatatatgctgtctatgctgaatcttctaatcttgtcttttttcttcctttttccaatctcttgctttcttctctcccacttaaaaaaatctcaaaacaaaaaatttctctccttctttctttacttctgaaaatctgcaggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggtaaagcagttttacttcttttagaaaaatcagttttctttggatgttttgtgttagtactggtgaagtttactacagctagcatatatatatatatatatatatatatatatatatgcatatatatatatatgcatatatatatatatatatatatatatatatattgcattgatgataaattaccctggaggaaaccacagaagcagagaagacagagatgattatcacaattcagaaaattaatatctttattataagtctcttgcaactaattttatctgtttttatactttcctaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggtatgtggctttaagatgccttattgctcagaaagacaaatacaaataatagtttatatgtggaatctaaaaacgttgagctcctagtagataatagaatggtggttaccagagtgtgggcatgagggtgggaggagagtacacaaggagaggggaaatgttgatcaaagggtacaaagtttcacttagataggtggaataagttttaatgatatattgcatagcaaggtgactacagttaacaataatgtatatctcaaaattgctaagagtagatttaaatgttctcaccacaaatatgtgaggtgataaatatgttaattagcttgatctaatcattccacaacatatacatatatcataacatcacattgtaccccataaatatatacaattattatttgtcaattaaaaataaaattaaattaaataattaaaaatactgtttagaaaaagacttat

SEQ ID NO: 117891 - DNA, 1046 bp, Homo sapiens
ctgccatctgttagatatatcataaattcaatgatgtgttcacagaatagagtaacaagtcaagtcactttgagtgatttattattattttaattgacacatgataattgaacatattaatggggtacagagtgatatttcaatacatgtatataatgtgtaattatcaaatcagagtaattagtacatccatcatcattttgaatgatttctgttgtttctctgattagacatttcaaaacaaagctactattgttaatcatccttctagtacattcctacaaattctattctttttgtgttttctgttttggtttttcaaaatttcaaattaggtggcaggttcatatgtgtaataatctatataaaaataatattccatttaaatgttcatgcctcttgctgaaatgtgtgctttgcctagcttttattttgtgagagtgctttaaactgcttcctagagtttttcccagaattctctgatacatttcttaaaaacttatgtgtgacatacatagctgtaaatgttatagagaattagatttcttagttttgcttatttagaaaaaactatgcaagtattaccttttaaatcatccaagtagatacctgagaacattattggaaaataattattaaccaaaataaatgtgtagtatgattgttatttattatcatttctactaatacaaaatattgtaatgaaaacactatcattcattcttattaattaggaccttccctatcagttataatttttgggaggtatgcttttttgtctgagaattgtgacagcaatatatgttaagtacatcttagtcttttgacttctttctatatctttttccttttatagagttgctttgagtcgtctataaaaattaggaattgaagtttgtcattcaaaataaagaaatagagtagaacttaaaagcttagataatataagcaaaatttaatactcttatcctctaaattcttacctggattctctcttcattgtattttctacaacaaagtcactgtcttaacctgttgggagttct

SEQ ID NO: 117892 - DNA, 1046 bp, Homo sapiens; identical to SEQ ID NO: 117891

SEQ ID NO: 117893 - DNA, 1046 bp, Homo sapiens; identical to SEQ ID NO: 117891

SEQ ID NO: 117894 - DNA, 1046 bp, Homo sapiens; identical to SEQ ID NO: 117891

SEQ ID NO: 117895 - DNA, 1099 bp, Homo sapiens
ttatttgatgcttacattaacctgtatatatttattaatcttagtcttctagattttccattttaaaagtgatattgaatgaacgaactacagcttcatgcaacattgtggatgaatctcacaaatataatattgagtgaaagaagccagacgcaaaagagtacattgtatgattccgttcatataaagttcaaaaactaaaaccagtttggaagtcagggtagtggttaccattgggaggctgggtagtgactgaaagggagcacaagatggggcttttggtatgtggataatgttctgtttcttcctctgggtgctggttacacaggtgtgtgttcattttgtgaaaaaaattcaaactatacacttaatgatttgtatatttttttgtatctacattatacttcacaaaaaatttttaaatgatattgactatgaactagcttgatgtcaacctttgctaagattgcgatttatttttcttcaaaggtgccaatgttaacagggctacagccaataatgatcatacagtagtgtcgctggcatgtgcaggaggccacctggcagttgttgagcttctcttggctcatggggctgaccctactcatcgactcaaggtagtctacttaaaaataagtaaacaggctgtgtgcggtggctcatgtctatgatcccagcactttagaaagctgaggcgggtggatcacttgagcccaggagtttgagactagtctaggcaacataaggagaccccatctctattaaaacacacacacacacacacacacacacacacgtatgtatgtgtatatatatataaataatatgtgtatagttataaaaatatgtttgatctatcttagtgcttagtatttaatactgtttaaatgagttttgattttatatgagctgctaagaaactataaagaattaattatcatggcaattctttttcaggatggttcaacaatgctcattgaagctgcaaagggtggccatactaatgtagtttcttatctgttggattatccaaataatgttctgtcagttcccaccacagatgtgtctcagctccctccaccttctcaagatcagtctc

SEQ ID NO: 117896 - DNA, 1017 bp, Homo sapiens
attaattatcctagagatagtgacttttgtcaaccatgaaagtataggtaacataagcgctagaagttcattaaagtaacttttaaacccaccttaaattatggagcttttactagtatattaagttggtgaaatctaaattcttttctacaaagtcattctgaaaactgctagcataccccaattgaagaaatatattacatttttgttttcttttgatccatgtagaatttgaacaagggtaaattggctagtggatagtgaatatgtgacttgtacccctagctacaattggaaccagcaaggcgttctattcagcaagggagtaatgttatttccatttagcttaaaatcattgactatttgtagattccccgactgtctaatcattagtctcaaaaattattgcttggtgaaagctttttttaaaaaaagcttcaggaaacaaaagtgcatttggtggtatatgaagataacctaaaacaggatatctgtttcatttatgggcctttgtcttattctttggtctgagatgatttttttctgagttgactttttaggtgccacgtgtgccaacgcatacacttgccatggttgtacctccccaggaacctgacagaacttcacaggagaactctcctgcccttttaggagtgcaaaaaggttagttattgaattatttttcttaaaatgggtattttttcacctaattgataaatccagaaatgtactttaatgatacagagttactgtgtacccatggctaattgaggtagataattctgacaaatgcaaatagtcttactatctaaaaccaaaaagacgtgttaggaaaaatgactttttattattttcctgttaacatactgatagttgtagctttcatctggcacagatgaaaacacttaagaaacaagccaagttcttgattatatttaagtaaccacagtttatcagacattcatttttcatttgataattctttagctaaccaatagtaaatgaagagtaaaaatg

SEQ ID NO: 117897 - DNA, 1050 bp, Homo sapiens
acgttctgggcttatagtttgtctattcataaattactcttagtaatcttgtgttccacgcttcttgcatattatttgttaacaagatagacagggccattcctatctgttactgtcctcaaaattctactcttattttggattatactatgtataaagattttaaatctgtgaatgtccagtggggtcataacataattactaaccagtctggttagtgttgaactcttacctagttttcctgaatcttaaatacaaattgcttagtagctatacaagggtgttttgaaactaatggatgtttaaaggaccatggaccattcagtctttgtagaacttctaaatgtactcgagtgatgtcattgaatttattacatgactgaatatttctttgctattgctgtggatttgtacattgctatttgtgaccatttaccttccttttcttgttgattgtcattaggcactttaaacaaatactgtaaatcaaaacagggactcctatatggtcttaggaaagtaataataaaattagctcacaaatctaattgcttttgctctgaaagaataaagtctttttccatcatttttactcagaaagaaatataaattgaggaaggctgaggctggagaattactttaggccaggagttcaagaccaggctgagcaacatagcaagatcccatctcttaaaattatatatatataaattgaatatagacagtgtactttgcaatttaaggaataactaagcctctgaaagtgattgcagtgatattgaaattgtggtcatcttaccttattaaagacagtatgtaggtgaaaaacttagacttttttagtaatgacacatgttgcatatgtttgagctacctgcagttttgagatctctattctagcaaaaaagtagatgaatctctaatttttttttcttcagtagttttgtcacccctttgaaattcagaacatttcatgtctctaaatgatcttttttcctttggacttgagaatcatttttaatacaatggatgattttattttaaaaattc

SEQ ID NO: 117898 - DNA, 1050 bp, Homo sapiens; identical to SEQ ID NO: 117897

SEQ ID NO: 117899 - DNA, 1050 bp, Homo sapiens; identical to SEQ ID NO: 117897

SEQ ID NO: 117900 - DNA, 1050 bp, Homo sapiens; identical to SEQ ID NO: 117897

SEQ ID NO: 117901 - DNA, 1406 bp, Homo sapiens
cttgaagtgttcatttaaatgcaagttgtcctttgcatagtaagtttaacagtgttccagtacagatgtgttaaaggtatatttaatggagaattttagaaagacatgtcttgaaaaaactgatttcacattatatttcaatataagaagaaaaatattttgactgaaaaacactatcccctactttgatctgtaagttttggtcttttgcattaactctgcattgcttgcagagttgatattgctaaaagaatgattgttctaaatgggcagttaacatttctggtattttcaacgctattttgatactgctttagatttggtgttctttaaaaagtccaatctaatcagcagaattttgagattcttgcctcttggttttccttttccccgcccctgacttaatttccaaaatcctcctatcctaaagtagatttttaaaacttcacagtttttgaattagcaacatcctagtttgtgctgcttgaaatagatgagtataggctttaacctgcctaacactggtgtgactctgaacattcattctataacattagttataagggttttgggagggaggtccgtgtgtgtgggaggggaggctggttttcttttttttttttcttttctttttttttttttttttttttagcatggcactctttcaaacatttttcatgtgcttaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactcca

SEQ ID NO: 117902 - DNA, 1340 bp, Homo sapiens
gtataagattatacttaaaattttcctgctgttgattttcatgtctggaaatttaaaatcacacagcttttttaatttgtaattttattagatcaacttacgtatttccaattaaatgggatgttcagataaaactaagtattccatattataatatttgtggttagaagataaggtgcattaaaatgattgtcacttgatgatttgaagattgggatttttgcattaactttcttaatgaaagcacacaaccacaccacaccacacacacacacacacacacacacacacacacacacacacacagaaaaaaaggcctgataaccttgaagtatatgtttctgtttattgttgtgtggaaaattacaactagatatgaaatgaggtgcacaagtttactttccctttcattgtccttgcagcagtgggaaaacagtgcaattaatcatttaccttcctaaagatggctggtgaatgtatcacctccatgagagcccaattcagaaatgcagccagaatggctgttgacagtggatgaagaccaagaactaagatgtagctggagtgatattcaaaggcaggccagtcctctgtctcttgattgcaacatttttttccttactgttgtctgttgcctcttgtcatattctcctccccttctcccatcccaattatgctatctcagtttcctttcttcttttgtgagcctttagtcttcctgatctttactgaatctttttaaatgtggaataagattactgaaatcaggaattttattgggcatgtgtttgacttccaatggttatagaattgtgatattgcctttgaggctcctctgatatgtaataggtatcattgtgcagaggaggaatgtcttagttttcttaaagaaaattaaaattctgggaaatgttttaaggagttaggctctttgttctttaatttgggtttttatatcttcagttggtagacacaaattaactttgtattattagcattgaaagttgttataaattgtgaataaattcttgtagttcatttggaattctaattttaatctgggtaaaaacagattttagaatgtgaagtatgattacgaataataatgatgaaactgatgaactgggaataacatttttaacatgtagtgttctgtaactagcattataatgttcctaattaagtgcacagtttgcagttatgaaatctgtgttactgattagttcagttatgttagaacttttttttttttaaagaatgtagaaatagctctaaaaggaacttgtaagtgttaaggaacatcaagttttatttcactgaagtatttgttaaattagtct

SEQ ID NO: 117903 - DNA, 1340 bp, Homo sapiens; identical to SEQ ID NO: 117902

SEQ ID NO: 117904 - DNA, 1340 bp, Homo sapiens; identical to SEQ ID NO: 117902

SEQ ID NO: 117905 - DNA, 1340 bp, Homo sapiens; identical to SEQ ID NO: 117902

SEQ ID NO: 117906 - DNA, 1046 bp, Homo sapiens
atgtaggtctgtctgattccaaagcttgtgattttactattactacatattactgctatggaaatttctgtttttgtgtttttctatgtacaaataaccttactcttttaagtggaatttagcaatatgaatattgtttttcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatgtgagtagattgctttatttaaacttattttgcacattctgatcttctttggaaaggaaaattattctgcatttattgtgaaaagaaatattatttgctcttaaattgataacttctgttaaaaaaaattttaacttatttttttcttctcctagactgagagcaatcatgacacagcattaacactagcttgtgcaggtggtcatgaagaacttgtatctgtgctcattgcacgggatgccaaaattgaacacagagacaaaaaaggtaaatatcagtcagaaataaaatccaagtgtagttacatcagaaaataattaacttttttattattgataaatagttcctagactatctcagtgataagatggataagtatatttcagttaggaatatctggattcattattctgcggagccaaataattctcaaaacattcaaaaattagacgtagatcattagtgaaatagagcaagttgtggttgcctttgttaatccaaaggtagttcatacagaggcatcaaagttcattatgagtataaactttaataatttttaccgacttagttttttaattaggtgtttatgggttttttgtcactaacaaattagggtttagagcagttttatgttaactcattatcagtgtctgccctgaaggatttattttgctaaaatactagagaattgtaaacagtggctttaaaataaaataaaaaacataaatttgtttaagattttcattttctgattta

SEQ ID NO: 117907 - DNA, 1050 bp, Homo sapiens
tgagatggagtttcgctcttgttgcccaggctggaatgcaatggcgcgatcttggcttaccgcgaactctgcctccggggttcaagcgattcttatgcctcagcctcccaggtagctgggattacaggcatgcgccaccacacccagctaattttgtatttgtagtagagatggggtttctccatgttggtcaggctggtctcaaactcccgacctcaggtgatctgccctccttggcctcccaaagtgctgggattacaggcatgagccaccatgtctggccggaaattatgttttaaattgtgacattttcttattctttattattggtcgaaacaagtaaaatctattcattgatgttagaaacctctctttttagtgaaaccttttcatctttaatgcttttctaaaataataggcaacatattattttaattttctaagcacatttccccctttaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaaggtaagcattttttacttgtcaactatttcagatacatttctgtagaaagaacatggcattttaacgcaaattgaatataatattttaaattatcataaattaaaactgataccaatgcagagttgagggattatgctgtataatagtgagtgacatactgtcaccatcatgacttttattaaggacaatgaagaaaacagaattagtacttttcccaacctcagccttgagtagctttctattaatactgcagcttacaacttttgaatgtagtaagattattttgtattaactcttacactgtagacttttaaagaacacctttaatgaggtatgtgcttatcattgtaaaaatcccaagcaaaaatttaattc

SEQ ID NO: 117908 - DNA, 1063 bp, Homo sapiens
tgagtctttcctgtcattcaatttgtctttttctattacaagtattcattgtgtgccactcatccattaaaggtcctagagaaatctgtgttattttggatagtaccagtaggaaatgtcctttgaaaaaatgttggagactaacgtaccaaaggcacatatgcaaaaaatttataaagtgattttaatctacttatttttaatatctctattcattatgcaaagaaattatctgagtaaattcacaaaagtatagaagttacagaattgtttttagcatgagataacatgttttaagttcattctagcacgtctgaatctaacaatttctactgctgtttagtaaaattcaaggcaaaatattgcttagctcttttatgagagctaatcagaactagaattgtcttaaaagttaattgcctcaggtttttaaagaaattatgtagcttagttttggtctacggaatagttaaaaaaagaaatgtaacttagttgcataatttattggtttaaacagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggtgagtacttttctattatatgtagaacttctcatggtcattttcacttttcagagcttttaaagttaataacattgttttactttattgatattgttaagaaaagattatttgcaagttattttgtaaaagaagaagatagagaaaactagaaaaagccagcctcttcttacaggaaacaaactattaatatgccttgtttacaggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaagg

SEQ ID NO: 117909 - DNA, 1121 bp, Homo sapiens
gagtgcggtgccatgatctcggctcattgcaacctctgtctcccaggttcaagtgattgtcctgcctcagcctctcgagtagctgagactgcaagtccgtgccaccacacccagttaatttttgtatttttagtagagatgaggtttcgccatgttggctacattagtctcgaactcctgacctcaggtaatccaccgacctcggcctctcaaagtgctgggattataggtgtgagccaccacgcccagctgattttttactttcttgatgattcctttgaagtataaaagtttttaattttgatggtgtccagtttattttttcttgttggcatttataaatgtgttttgagagtaacatccatggaaatccctgtgtatcataaaaatatcatttcattctttattttacattactgccttattggtaaaattatatacctgctttatttccagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatggtgagaaacaaaccatctgaattaacgataaaattctcctttgtttatcaacttcattttgagtgctctttgctctagttaactctagttaaacatttgattactttattaatctgaaatggacaatgacttttatagtaaatatttgtaagtgttttgcattgtaaattaatgcagagaaacaagagggaaaacaagcgcataatttgaataaattcagttgtaatttaagtcaccttgtaaaacactgcatatatactaaaagcaatacagtgagaagtttgccacctttttttgagattcttctctaactcttcctctcctgattagaagtaaaatttctcagtttacttttagctgagattcaggctcaaggatatagaggcctgaaatgtcagtagagatgggtttagtactctcaaagagttatttattgtactgtctggcagtgcttgtagtaggcaaataattttgttctacttggattcta

SEQ ID NO: 117910 - DNA, 1040 bp, Homo sapiens
tgatggatgtgaattcctctaaatacccctcactgctccttcattcccaagaagaaaagacaagtactgctacttccaaaactcagacacggtaaatttttctgatttgttaactctacctgcacctttccttcttcatgcctggtacaagaatttgaagtatattaatccaagtacaagttgtgttaaacaattgaagtctaccacattatctatcttcaatattcaaaactgaaattcacccatgtcctctttatcatttgctagttaggaaatgagattattagaaatttttataggattcatagtctgaagttgaaaatatttgcatgctttgattttatctatgtcatttttattgattatagtctaatttttggcatctgaatccattttaatactaaaataaatgatgggttctttgctctatttctgtttttctgactcattgattatttgatgtgccaaagtttaatacgaatatttcagcgtaactctggctataaaggaatagtctcttgagtttctatcttaaaacttatcttttattgtacttgctatttgtctcttcttagacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtaaatagaattagttccatctttttagctttcatatattttccctttctcatgtgagatggctacctagttaattaatgaataatttgaatgtggttattattttaaactgcattgccacactaaatccagaatatgctaaagcaaaattagaagcagtatgtaaattttgcatgcatattttatatgacacaagaaattttggcttttttggataacctcagttgctttttatgtagttcaaatgtaaaggctttctcttgctttttttctttctcatgtctcagtaattctagaactaaagtactaataatcaac

SEQ ID NO: 117911 - DNA, 1043 bp, Homo sapiens
tttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctc

SEQ ID NO: 117912 - DNA, 1095 bp, Homo sapiens
tctttgtgaggaaggaaacattggtagattttgttacttatcttctatagaaaatgactatagttatacagatgaaaagctgtactttgactacaaaagggaatgcaggagttattgttgggtgctacttagttacagcatactcccatttcatatcccctccagttaaaagctttgagattcatctagaacattactccaggtgactgacactcttaaacattgagcccattttcctgtatctagtgctgtttggcgatattcttctggactgtaaggaaaaaatggatttggccatacagtatcacatagatggattgtttttgctgtggtctatgaaaatgagccacatgctatcttttatttatttgtttggttatttttacagcttatctcactttggtggaagtcttcttgggctttcaattttaaagttttagctaattggatgtcttggacctgttttatttcagggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtaggaatcctggaggaactcttcccaaagagttttgaataagttattaaatcatttatttcagttacaacaccatgttgtaactttagtaaactaagtggtatacagatgcccaaggtttgttctgtggtcatgtgaaaaaattgtcagtcatttttagcatagaaaacttgagaattattctttcaagccaaaaatgttttacagtagaacttggatcaagaaaagaggtactaggctgggtgcagtggctgacacctgtaatcccagcactttgggaggcctaggcaagaggatcgcttgagcccagcagttggagaccagcctgggcaacagcaagaccctgtctctattaaaaaaaaaaaaaaaaaaaaaagtaccgcaagtagttttacaaaaggaccctttggaagcagtgttgtaaaattatttcttaaatctggaa

SEQ ID NO: 117913 - DNA, 1032 bp, Homo sapiens
ctgaggatgagagggtattatggtgcctccatacatggaaattggcagaccctaaaacagcaggaaaaaagatttaatcttaaaattactataaattataaaattactataaatcccataataccagcttagacttctctaatattcctcatttaaagaactccaaaagatcctataagtacagtatggcagtgttgagaaaacaaaatgtttatctgcatctgcaaagcttttcaacaaaaaacaagagagagaaagaaactaaatccaatatgaaatcatcaggaaatttctcatatttgataaaaataacctcaactttcccatattttagtttcatgaataagcttgagctaagaagaaaatgggaactctacataattgattgccgacataaagctgtcagagcagacaagaaagcatcagtgaactcatggccagcttttaagaggggtagaggcctccctcaaagctgtagtagcagagcacaaagtggcaaaacccaaatccctcaggtgttttcgggggatggggacatcttcaggacaaactactgtggacaactctgtgcactcctgaaattaagcaaaagatctagcaaagccacagaaacaaaagggagcattatttcaatacaaggtattccttaatgtgactacattggctgacaaagtgtcaatcaagttacagtgatgtttgtcaactcactttagaaaaatccacaaaaccacttgccataggctgatgaaaaatgttagagggggctaccattccagaatcatctctctccattggctgatgttgggagaatgtgcttgggtctgataattgttgatgcattggatggttccccatcacagattgcgaccaacctgataagccttctggaaagaataattgaaaacaaagttttaaatttatttggataaaacaacaaaacattaccattgttattaccaaacatgaccaaatgttactgaaatctttcctctgaagagctcaaagcgtatttatcacagtcttgctagccaa

SEQ ID NO: 117914 - DNA, 1547 bp, Homo sapiens
tcaattatgtagagttcccattttcttcttagctcaagcttattcatgaaactaaaatatgggaaagttgaggttatttttatcaaatatgagaaatttcctgatgatttcatattggatttagtttctttctctctcttgttttttgttgaaaagctttgcagatgcagataaacattttgttttctcaacactgccatactgtacttataggatcttttggagttctttaaatgaggaatattagagaagtctaagctggtattatgggatttatagtaattttataatttatagtaattttaagattaaatcttttttcctgctgttttagggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggcca

SEQ ID NO: 117915 - DNA, 1080 bp, Homo sapiens
gaaaagtgaaacccagaaaggtgagatgatttgcctaaggccataaagcttcaagcggcagaaatgaaaatagaatttaggctctgactactgactactgctccactgtatccatgctgtctcctcccatatcccttgtatattttgaaagtaattaagttcttacctgagctaggttttatccaaatgttcaggttggtaaaatagcagtaaagtagtgccaggaagaggcaggcagaggaagaagagatttagcaggtgaaatgaggttgggagcaggctactgggatccaaatagtcagaaagaaaggaaggaagtgctggtaagaaggaagggaggagcgtatcctaaagaactactcccaactatacaactgttgttttcctcccaattttcctagggattcctcataattatctcctttctcttcataaattctacttactgacctgaaataaaatttctcatttggttgtcctcaaggtgcagaatatggacttaaggctcctccagacaattcaaatgtattgtagacagttaagatagaataaaactcacctttttgtcccactgaataatttatttaatattatttctcactagtatatatttcatcaagagtagtttcattcatttcaccaattttaggtgatttttcttgttgctgttaatggtaagtggaaacagcaagatacacaggtgatccaaggagtcttttgtgccccacccaactgcccccacaaaggtcaaggggccccttaatgatacttgatgtggttatcaatcactacaaagtagtagcttcaataaacaacactttcaaaatccattcaaaacaaaacataagacataagcttaattaaggaagctttctcatatgtaagatgatatagaagattaaagaagcaggtatatctgacacagaacaaacatggtgtgtctgatgtggtcctggctttaggacctgggcagagaaaattaagaattcctgttggcataagcgtagaaaggtgctgctaatatagttctgtccctagttactactctttctctgtgcatccttctttgccttgatatga

SEQ ID NO: 117916 - DNA, 1273 bp, Homo sapiens
gtctgctgagaacctagctgggcttcagagccgatgtcctttgatacacagggaaatttgacaccaccctcacctccaggccccaaaaggcctgagtctgggaccccagtcacctcggtacccaagctcctgactcttacctcagtcccaaccccttgacaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccggtaaggaaagcaggaattaagaattgtcccagcctttgagttcaaatgccactgtgacacagtgcgggggttcagttccaagaggggtttctgcactgatgctgagcctgcagatcctcagaccagcaacctgtcttcctgccttttctctctccagatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatgccttggctccagtgttctcctcaatgctgattttctcatctcagccacacagctgaaggccctggcaggcctggttaagctcagaggcctcagatcattcccagctcccaccaggcccacttccagcagcaattagaacctgaggcacgctacagtggcaggttacatgagcctccaaaccataaacagcaatagcttggccactgccaagggctgttcctgtcttcccaggaagcagccttcctggaaccagggccccccagcagcccctcccctatccattccaaagcaggactcttggaaaagaggtgctgtcccagcctatagccatcctgtctctccctgtgccttttctgcttcccacctctaagcaccagttcctctattccaacaccaaaaaccttgtacccttctcacagcatgatagtccaccaagta

SEQ ID NO: 117917 - DNA, 1073 bp, Homo sapiens
cagttagggagaaagaaacctcttctagctatagtgttttcttagttcttagaaaaagagatctgaagaatgtcttaaaagaaagggaaagtagcatggtcatttcacctctttggcgcttagttttctttttgtgaagtaacgctacaggatgagcttctgagagtctgagaagcccctgaaattttagaattctagtcatagtaggaggtgggttaggaagactggtggtgggaagatgagagaattcctgtttaatgacctctacttttcaatgaaacatcaggcagtgtcagaagaagacagcagggaaaggaaggtttcatcagtttctcagtggggcctctaatctttgggtaaagaaccagaattctaaagtgtgggccagagaaagcaggtgcttcctatgtggtgctgtcttcccctctcctcccctcattgggctggcagcactgaattggaggggggcttctgtctcttagaagcaggtatgtgatgacatcagccgacgcctggcactgctgcaggaacagtgggctggaggaaagttgtcaatacctgtaaagaagagaatggctctactggtgcaaggtatgggtgggttctttggtatagcctaaatccctttcctgctgtggttggctatgctggagcaggtgctgagattttgattgactgggaggggaggcatggaagctcttgtaccacaggctgcttgctcaacccccgtctctcttcagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagactcaccggacaccatctcctatgccttggagaccttctgtcacttggctcccttcttaccaccaccaagactgtcccactgggcctgacccacctatgagggaag

SEQ ID NO: 117918 - DNA, 1045 bp, Homo sapiens
gtaggcatcctcaccggcccttggagctccccacgccccacacacggatgtgcaccagaggctggcagtggatcagactgtggtccaggggattcactaggctcatggcatccttcttcaggatcatcagcatgttctggccctgccaaggacagaggtcagcccagagctcagataaaggtcattgccatgagaaataggaaattcagggacagctacctctgctgggccctgggcccaaaccattaaagggcccagccaactcacctcaccccaggcaccatctggaggctggctccggctgcgggtctgggccagctgctggatacagttattgactgcaatactgctcttccccggtgccaggtcctcttcaggtacctctacccagcccagagagcggactgcaaagcactgacaggttgggggaagggacaggaattaataaggatggagtagggtggcaggtgccacaatacatactccctgtcttcacccttgatcacctctgttcagtccaatcccacccttgtctttcccttgggacctcccaatgccctcaggcccaagtcactaccttagcccctggctccatgctctggatgtaggattccccaccataccaggacagagagttactgaaacagagcagagctgttaagaggaccacatttcctacagtagggacactggtgaggcctagacaacttgataagcacaggatgaggggcaagacccagaatatagcaccagaaatataaaaccagagcagggtagagcccaggacatattaacgtaacataaagtgtgactcagaatttgagggaaaattcaggacataggacccagacacaggacatagaataaaagtcacaaggctaggtgcagtggtggctcacgcctgtaatcccaacactttgggaggctgagacgggtggatcatgaggtcaggatatcgagaccatcctggccaacatggtgaaaccccatatctactaaaaatacaaacattagctgggcatggtggcatgtgcctgtagtttca

SEQ ID NO: 117919 - DNA, 2642 bp, Homo sapiens
caggagccgcagaagaaacaagggacatcctcactcctgagccgctccagagtcgcttctccccggaactaaaaaggtcaaggagagtgaagaccacgcccggctgcagatcacccccacggccactcaccttgtcatccgccatcttccccgccgaacttgttgcgcaggcgcatccccgcctccctcgtgccgactgccccggccatctttacggagggcgaaggcacttccggagcatttttggaaagggggaggtgctttcctagtggccaagtacgcctctctcagatacttccacgtgaccccctcccgtcgagtctcaggctgcgtgtgagcgcactcacgaccggggcgcgatgatctcactcgtgcgcgagtgcgcgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgatggtgtgcacggaggggcccggtgggaagaccaggagctgagggaggacgagggaatccgaaaggctactctggggctcaaagacggtgggggatacctctctgtgtagggaccagggggcgaatgaacccggtctttacatgtgatgtcttcaagattgaggagcctggatcttcagcctaagaactgacccattttggggatggagaggggattatgacagcatgttattctgaactcacaaatcatatgctccctcctctctaatccggtgttcctgtagatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacggtaggtagagtgtgaggaggaggtctgagcccatgtgtggacctaggtctgctgttaaactgactaactcccactctacagggaacggaggggatctggggactgcggccccccaaagggagatccttctccagcctggagagttcactggaccggaggtaacgggtggcccaggcaaaatgaaaggcttggggttccatggtgttcaaaaatgcagctggacccatggtctgctttccagcccaggttctggattctgtcacatgttttgggttctgttacgttcttggctctgtcccaggttcttaactgtcagtattttgagttttatcccttgttctaagctcttgtttgtagctacatgtttttcatattcttggtcctaacctatcatgttctagaccttggccattaagtcctctgttctagggtctcttgtcccactttggggttctggtccacatattggaccctgttctattttgtgacttttattttttattttttgagatggagtctcactctgtcatccaggctggagtgcagtggcacgatcttggctcactgcaacctccgcctcccaggttcaagtcattctcctgcctcagcctcctgagtagctgaaactacaggcacatgccaccatgcccagctaatgtttgtatttttagtagatatggggtttcaccatgttggccaggatggtctcgatatcctgacctcatgatccacccgtctcagcctcccaaagtgttgggattacaggcgtgagccaccactgcacctagccttgtgacttttattctatgtcctgtgtctgggtcctatgtcctgaattttccctcaaattctgagtcacactttatgttacgttaatatgtcctgggctctaccctgctctggttttatatttctggtgctatattctgggtcttgcccctcatcctgtgcttatcaagttgtctaggcctcaccagtgtccctactgtaggaaatgtggtcctcttaacagctctgctctgtttcagtaactctctgtcctggtatggtggggaatcctacatccagagcatggagccaggggctaaggtagtgacttgggcctgagggcattgggaggtcccaagggaaagacaagggtgggattggactgaacagaggtgatcaagggtgaagacagggagtatgtattgtggcacctgccaccctactccatccttattaattcctgtcccttcccccaacctgtcagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgaggtgagt

SEQ ID NO: 117920 - DNA, 3606 bp, Homo sapiens
cccagatgtcccctcctgggaaccatcacgaacccgttactagcacagactcaaaaacattcacccttaaacactcctcactttaccccattccctagctcccgaaattttcttcccagtgacacgatgtttccaatcacacggacactcacaccaccctcattcaaacactcctttgcatacattctgaatttcatacttatatgcgatcaaaatcactcagtccatttacttacacacttgccgacagtcttttttgtcattctcagtcacatccagtcactcacattcagtttgggatgtccttgggaagaaagaggtaaagcccatccaggaaccaagacaataaaattgtccaggaaactgcctcggtccattactcaccattggtctagaagctcagcattacccacacatttactaaatgtcaggcactagaacatagtagccaagacagactggtcacgactttcaaggagctcataatggagtcagtagtggtttcctgatggacctaattaaaggtccctagctgtccctcctgcctttcctacatactgcttgctatataaaattcttgtcaaggttgatgtaagttactggttcagatcccatctgtcagtcccttcctggccctcatttgaattctgtgcttttcaatgcttgtctttctttgccactgccatctcaggaagcttttataggaaaaggtctttctggctcaccccatcccctcccaattcccagcttctgatggaattgagcaaggggtggggcttagtcagactgctggagccagcctctcgcttgtcctaggattctctgcctaagcttaaggacctggcatttctcaagaaccagctggaaagcctgcagcggcgtgtagaagacgaagtcaacagtggagtgggccaggtaaggactgtcccaccccacccctgccttaggctttattgcccaacatgctcttgagagtgttaaatggatggtagagatttcttcagcaagtgattattgagggcctattctcagtcaccctaaggacaatttttctgaatggcacatgaactaatatcttaagtagtggttaagtaggtgaagaggggaggaaagaacattccaggcagaacagcatatgtaaaggccttgtggtaggaagtagcattataaacatgaggggtgaaaggaggtccatttggctacagtagttggggagcatgctaggaaatgaggctggagaaaccggcagggctaggggcatctctgaccttgtgtggcggtggagttctatggttggagctttctgaccccagggttctgagattgtgtgatcagaactgcttggttctttttctggccccagaaccttgggaaaaatctggagaaaataccacggttgtccagggtgaggaggagctggtggtggaatgctctaatcccagcttgagtagcccctggacagtcaggaaggagcctagctaagtttccttctgcatttttctctgcaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccatt

SEQ ID NO: 117921 - DNA, 1185 bp, Homo sapiens
aaattagccgggtgtggtggcgggcacctgtaatcccagctactcaggaggctgaggcaggagaattgcttgaacccaggaggtggaggttgcagtgagtggagatcgtgccaccacactccagcctgggtgacagagcgagactccgtctcaaaaaaaaaaaaaaaaaaagagagagaatgggctcccagctgaggctggacccatgcaatacattgctcaccgtagttaataataaatgcctacagtgcccccgaaagcttccctgaaacaacccattgcggccatccagaatcagccaaaattctatttggacttgggcttcctagatgtgtttgagacctattgtattaattctaggcataccaaatgtattttgatcatatctctttaatactcttcctgtcttaacaagactaagataaagacaaagatcttttattttactttggtagcctccagggtgcagaatagttaaagacacctccctctctctcttcagcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaagctaccagctgctgaagcaaacatgaagggtggcgggggggcagggattctagggccccagagtaagtagaccacactgagtcccttttggtcctcctgcctggatagtgctgagtggaaggggaggagctgggacccaaaggtcttggcttaggtgtgggagcagagaacatgagacctcattatggtcctaaatctccaaaggctctactggacaaacaagcttgatgttaagagagaggggaatgagtgacattgagaaacaagatcacccttgaagagctgtctgctggagagcatacacacgatcctggagctgggcctcttcctgatgcctttccagggcttgcagccctgactgctgcaggaag

SEQ ID NO: 117922 - DNA, 1036 bp, Homo sapiens
gcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcaggtgaggcgcggcgtggtgaggcgggcgggcttcgggacgccagggtcacgacctcgacctccctgaagttgagggaagcccccgcccacagcacgcgcggcgctctctccggccccgcagggacttcattgagaaacgctacgtggagctgaagaaggcgaatcccgacctacccatcctaatccgcgaatgctccgatgtgcagcccaagctctgggcccgctacggtgagtgcgggacgccaggggtctggggctccggtaggggaacaagggtttgagaagagaagggaccgcccaaggtcgtgcagaaacccgtggagaaactagaactcggactttagccttgctgttgatcttgtttccatgaagaaatttatattcgcagggttatatgatgcgttgtattccgggcaacataagtatgcaggctgaccgaatcctgcgtagggaccaggagctgacgtttttgtagttaagaatgggcttcagacaggagagaagttagtcaatatagtttctccaaataacgtgtagccagtgtcagtccaggtagtgtgtgagaatctcagtaattttgcacatagagctgggccctgtgctgagtgcttccctgcctaactcatttaatcttcattagttaggaggaagcgtgttcttcttttctcactgtagagattagaaaacgg

SEQ ID NO: 117923 - DNA, 1050 bp, Homo sapiens
agcgccgcgcgtgctgtgggcgggggcttccctcaacttcagggaggtcgaggtcgtgaccctggcgtcccgaagcccgcccgcctcaccacgccgcgcctcacctgacgccctggctgccgggcgagcgctgacataagtggatgcgaatctcacgcaggcccagctttgccccgactcctcgacttgctgcggccgccgccatccttgttaatatcgaagtcgccaattccaggtcttcaggccaagtgctccggtctgaccaaccgcggaccctaaagcctagcccataggctgcatgaggcaggggcggggtaaagcttggccaatgatataaaagtattgtaggaccgctgcgaggtcaatttctttgcgctcggggttggtcggagggaaaaacaggaagcggaaaggctgcgaacgcaaagcagtgtgggttgattctgaggtgcactgtgggaaagagcttgtcgctgcggtgttgctgttggagactcgattgttggtgacagcgaaagaacgataacaaaatgccggagcgagatagtaaggctcaggccatccgttatttcttccccatggcacttggggcacttggcgcattattgtagcttctgagcttaagccgggtgtgtgtgtgtgtgtgtgtgtgtgtgtgtgtgtgtgtatgtatgtatgtgtgacgcttgagcccggagaagccacagggtcctaagtgaggccgacagctccaaactccgtccccagtcctcactcctactccaagtgatgatgggcggcttttgtgcgtggatcgctttcccccagtcctgtccccatacttaatcctgggttgcgcgtatttatcttttacgtagtattttagacgtgatcttccggaagtcttctctgatcctccagcgcaggattagggtcctctgctttgtgctcccacagcttcttgtagtttcctatttcagcacttattacattgtgttgacactgtcgctgttctaacttttgttctgtattgttcactactatatctcaaatttttgcataggatctgac

SEQ ID NO: 117924 - DNA, 1088 bp, Homo sapiens
tgacggccatcatcattattatatcatcatcgttatttatatgatacgaaagtttcaggacctggtacttggcttttcctttattctgagagtggaccagcaaataatacgttcttttcagctgaaatttagaaggtggtaaaaattcagaagattttctgatttttgtgtggaaaagtcttatatctatagagaattggtagagttgggtggtattaaaaagttctgaagtgacagatggagtgtcccaagttggcactggaaaagtatatctataagctggaagaagttgtagttctgattttgagtaactacgaagaggtggccagcagttctatcaggacagacatgagcttttccccatagagagtaggttggagatgtagggaagcaagcaggaacagttctgttgaccttgaggtagcagctgatgagccttatacatttgcctttctctggtcacagttattatgccaagctacgccaacaagaaattgagagagagagagagctagcagagaagtaccgggatcgtgccaaggaacggagagatggagtgaacaaagattatgaagaaaccgagcttatcagcaccacagctaactatagggctgttggccccactgctgaggcgtgagtactgagggaacagggcatggttccctcagcatccgagagtcatgcaaatacaatgtgaactcttcctcttactttcctgccctggagcctacaataagcgatttcagaggcatttgccacccacaaagggctgttcttttttttttttttttttgagatggagtctcgctctgtcacccaggctggactgcagtggcacgatcttggctcatggcaagctccgcctcccaggttcatgccattctcctgcctcagcctcccgagtagctgggactacaggcgcccgccaccacgcccggctaattttttgtatttttagtagagacagggtttcaccgtgttagccaggctggtctcgatctgacctcatgatccacccgcctcggcctgctgaagtgctgggattacaggcgtgagccaccgcacctggccccccaaccccctttccc

SEQ ID NO: 117925 - DNA, 1105 bp, Homo sapiens
catatgtcatttatgtctcctcaggtagattgaaagatttttcagtttggggcttatgagttaaaagaagtaacatggttagtgattaaaagttcaaaacttggagtcagagagacctgagtttaaaccttgatgatgaaacagcactaagtgtatgattttaggcaactgactttgctgtttgttcatctgtaaaaattgggttactatttaccacatgactttattgtagggatgaagaaaaatgaaatctataacatgcctatcatattgagcaggtagtagagctgttttttccatcatcatcaatattaccttaaacttcatccttcttcctcacaggacttaatacaatacaggtgcatagtgcccttgaagaggcaatgtagaagagtggacaggagcccaggctttggagttacatggcctggttccattctttgctccattacttagtagatacatgactttaggtaaattacttaaatctcagccatagtattcttatcagtaaaaaggataataatatccacttcatagggctgttgcaaagattaaatgacgcaaagcttgcatagcacttggcatggtggctagcacagagtaagcacataagtgacagctgttcttgtagatcctggctacttgctgctcttctccttattgtaggccgcaatgtttaccgaatgctttttaagagcaaagcatatgagcggaatgagttgttcctgccgggccgcatggcctatgtggtagacctggatgatgagtatgctgacacagatatccccaccactcttatccgcagcaaggctgattgccccaccatggaggtgagtgaatggaatcctgagagcctatcatgtgagcctcaagcctgggaatcagcctggcctctgccccgtgtcccttgtccaccatgtcaccaagtgctgttcacttttacctcctaaatctcaactgaatccattcacttttccactttttcaccaataacattccagtctaagctataatcatttgctggaactattaacttactatttttttagagaccaagtctcactctgtcacccaggatggagtgcagtggtgctatcttggc

SEQ ID NO: 117926 - DNA, 1184 bp, Homo sapiens
cacacccggctaatttttttgtacttttagtagagatggggtttcaccatgttagccaggctggtctcaaactcctgacctcaagtgatccgcccgccttggcctcccgaagtgctgggattacaggcgtgagccaccgcacccagccttgacccacgttttaaacagaagatgtttaaaagggcattaagagctggagaggatggtgaagttcagtggaaattaactgaggagtatgttcctgactcctctctttaaatttcagggaagctggaagagaagaaacctcctgaggctgacatgaagtatgtatcctagcccctggcatctgatcagagggagggggtctgtacatttcttgtgtctggcattttggggaggtgctgacatgagaatctggagaaatggtcagggggagtgaaggtgtatgtgtgaatttggccagctagtgatctccattttcccagtatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgaggtgagatgtgggcccttagtaccaggtgatggagttgcccctctctggaaatgtgagcaaggttgggtaaggaattgtttcaaacttgggggagggatgagtaggaatctctcatggtaacactaacttcacattttgtgttctttccagcccatggacgttgacaaaggtgagttgtacacacagcatctcacagttgctctagcagtcctgctttcccctggtagggctcagagctggcaacggtgggattgggggacctcctggttctgggttcttgtaagaactgtgtcttgctttattgaataggtggagttccctccaccttcctgggccatggcagggcatatttgctcttagatataattcctgtggccctggggttctgaggaggtgaggtagaggtcaagtatggaatgttctggataccctaccctcatctcaaccagagtgactcattaattggagtttgtttaaaactttgttagaca

SEQ ID NO: 117927 - DNA, 1255 bp, Homo sapiens
tctgggctgatgatcagaaaatgaaagagaaattctatgcttgagtgcaaccaggccttcctagaggacagagctcccagagtccccccttcagaaaggtgaatccctgaagaccgctggctaaccctctccctgcaggattttgacattgctgggaactttgatcccatgatccctgatgcagagtgcctgaagatcatgtgcgagatcctgagttcacttcagataggcgacttcctggtcaaggtcagagctgacaaggctgggagggcaaagttgggcctggcctctcacaagagaagatccttgtgcagagggaccagtagcctaagtgaccatgactattgcaggtcatgtaagaaaagagattcccccctcactatgcattggttccttgcaggtaaacgatcgacgcattctagatgggatgtttgctatctgtggtgtttctgacagcaagttccgtaccatctgctcctcagtagacaagctggacaaggtaacaacccaagtacttgacttcttttcccagatcccaccctgccttgggaaatggaaaacaagattgagagagagagaggtgcatgcctctatacccaccagaggaaggttagccccaggatgtaggctcatgggcagctactgctctaaaacggttccccgaggacagtacacacttgctctgtggtgcggaagctgcccaggggtccctgactggtgtctgtctgcctaggtgtcctgggaagaggtgaagaatgagatggtgggagagaagggccttgcacctgaggtggctgaccgcattggggactatgtccagcaacatggtgaggaacagaaccaagcctccccagcagccgtcccactgccctcagtcctaaagttgaaactgttctgtgttatgtatgtaggggagtgagtgtgtctatgcatatgtacacacacatgcatgggcgactagagtccaggcaagaaggtcaaccctccttaccttttttgtttccttgtcagcctcactcacaagtctgtctccccaggtggggtatccctggtggaacagctgctccaggatcctaaactatcccaaaacaagcaggccttggagggcctgggagacctgaagttgctctttgagtacctgaccctatttggcattgatgacaaagtgagtcaagttggggacgggatcccttctgagctctggggcttcaggtccctgatcttaatctggcactgaccattttcttatctccac

SEQ ID NO: 117928 - DNA, 1088 bp, Homo sapiens
gtgcaatcttggctcactgcaacctccgcctcccaggttcaagtgattctccctgccttgagcctcctgagtagctgggattacaggcacctgccaccaccatttgtttgttttattgagacagtctcactctgttgcccaggctggagtgcagtggcacaatctcggctcactgcaacctccacctcccaggttcaaggatcctcatgcatcagcctcccaagtagctgggactacaaggggcgtgtcgtcgcacccggctaatttctgtatttttagtagagacgaggtttcaccatgttggccaggctggtctcgaacccctgacctcaggcaatccatctgccttggcctcccgaagtgctgggattacaggcgtgagccactgtgcctggcctcaggtaggtgtttgttattaggccaggaaatgttctgttatctgagagagagtgtttagaaaaatggcttaaagaaaagagttctaagaattttagaaaatagacccaaacttaaaagggaatggagtttggaaggcagatagcaaatgggtgtgggaattaatagggaattatttgtacttgttttaaaactcagtggcctgtaggaaaatctgtttagagcaggatttgctttttcattattgaggtcatccttttatatttccaaaacatattgttcttggttttcaaacctcatttctggttctctggctgatttcaactccaagggcacaagagactatagtccccggcagatggcagttcgcgagaaggtgtttgacgtaatcatccgttgcttcaagcgccacggtgcagaagtcattgatacacctgtatttgaactaaaggtgaggaatgggcaagaagaaactacatggtagatgagtgggcatttgaataacaaagaagatgacaacaagagagtgagggtccaaagggcccactcctgttgtggacacagaccagtctttgctccaataagaagggggacaagaatggcttggagggagaggccctgtcttttattatcttggttgtggccagcagattccaaaagagagccattctttggaatggtaattgttctgg

SEQ ID NO: 117929 - DNA, 1010 bp, Homo sapiens
ggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctggtgagatttaggcagcaggggagagggccaaggcaaagcctgggaggacgtaaagccagggtgttcgggacatagggtagagatgtgagggaagcgaccagtcttgtagggaggagagtgggctgcgtggggagacatccggggtgggtcccgagagaaacaaagctaggcctgagcagagagatgtgatgagggaggaatattgaatgaatggcgggggagggaggagagtgacagatggatagctcagcgccttctttccctccacagatcgaggaggaggtggcgaaactcctgaaactgaaggcacagctgggtcctgatgaaagcaaacagaaatttgtgctcaaaacccccaaggtaatatcattcctgtagggagccactgagaaagtctctaactctactcacggggcgcttatgtctgcctccctaaaccaggtcattgaggaggatctgaaatgctgcagaggagaggacagtcgctctgggcgctgggctggactggactctacctgagtcattctgggatggcaaagtgatggcagaaactaggccagctgggtgatcaggggagtcagcctgctgctgctactccttcgttcattcaataaatgtgtatttagcgctatgtctctagcactatacaaagcactgaatatataccatggtggacaatatagcctaccctcatggagcttacattctactgaaggagagagacttagaacaaataatcccacacagatttttttgttttttttttaaacagagtatcct

SEQ ID NO: 117930 - DNA, 1050 bp, Homo sapiens
aatggtgctttggcttcctgttgctcagggtgaagagtctttgcaggttggtggtcaacagggtcagagatgccacaggtctggccagtgtccagagaagccacatctcacattcattcttctgccaggttgcagaggcagtgttaacatcccaactgaaagcacatcaagagaaaccaaattttattatcaagaccccaaaggtaatactttttgcctaccctatcccattagagtgccttggaggactgacctctgccttgcatgtctctctgaccccttttaatgttctttacagtaaattttaaaaatatatactattcttgagatactaggtgcggctcagagtcatttgaactcagtagatttcagctccagacctgagattacataataagtgtagtttaactccttgtctgaaatggacttattttttgtttttgttttcactatggctgcttttggtttccagggtaccagggatcttagtcctcagcatatggttgtgagggagaaaattcttgatttggttatcagctgctttaaacgtcatggagcaaaggggatggacaccccagcatttgagctgaaggtaaggggagaagaaagagtacgtgcaacctcactcacttcttcaatggcgttcagtgtcccaaagggcttctcatctgtgttttggagtcatgctttcaactgtggctcattctgtttgacccctataggaaaccctgactgagaagtatggagaggactctgggctcatgtatgatctgaaggatcaaggtggagagctgttgtccctccgctatgaccttactgtatccttttgagtactggagcctgacctgtctctttccaaatccagcgggctttctctgacaaaagtggagaacgtgactttgggatcttagaggtccattgcctatacttctagtttctcccagaaggcagttctgctacggaagcctggcctggagccctgtcatttaactctagtgtgtatcataatcctttgggggagcttgcagaagcacagacatttggctgcag

SEQ ID NO: 117931 - DNA, 1082 bp, Homo sapiens
ttggcctaatactgtttatgcaagtcccaaacttgggtgactccaacccttaagcctgcaactgtaggactttcctagtaaagctgttgtatttcctatatgtctgtactcttcctgtgaaatttccatcctttttgtgtgtcaggaaagtaggtactgccattgttttgagtggaagggcattgacaagcacttgggtcactgacattgagttctcaggtaaatgaccggcggattgtggatgggatgtttgctgtctgtggtgttcctgaaagcaagttccgtgccatctgctcctccatagataaactagacaaggtaacaaagaagacatacttcagtagaccctatctagcttctgccctgccctcaaatccataccactagtgaaaaataaggagattgtggctggaagtgggctattttggggtggaaggtaaggaggcatactctgaaggaagatctgagtcatgctatacagtggggattgtgactggatttcttaagctgtctctgactttgctgagtatacagttagctacttgtgatgtatatactgaatggaagttgagttgtcctttttcagtttgagaaagaaagatcttggggctgggctaatgtttgggtgtttatgcagatggcttggaaagatgtgagacatgagatggtggtgaagaaaggcctggctcctgaggtggctgatcgaattggggactatgtccagtgtcatggtaagaaccagggttttcagagctgtgatagaaccaggctgaaggtgacatgtgctcaaattctacctctgaaacaactcttttctgtagatatgctaagctccagggcctgtcctgaatttaatttctcttttacttattgtaacgactttgtgtcttcagatggcaaagctagaggcaaaggaggagggtcttgtcatgtgagactgggatcttttttttttttttttttttttaaagaaaatgaggaagactagctagagcacattagggataattttgaatgaaacacatgtgagtgaacagcagagactttatttctctccaggtggggtatccctagtagagcaa

SEQ ID NO: 117932 - DNA, 1047 bp, Homo sapiens
ttgctggctttaaagtggagaaaagctgtagagttgaggattgcttatgatttcttcctgtgttgagattctccccagctgctactttaagtgtctgttgtgtcctttcaggaatgattttgaaatgagtaagacctgaattttggatttcatgcattttttttcctttctggttgaggaactataatattgaagggacttccttccccattatgtttcaggaaaaccagtgcagcctgtcaagcgagagcttttacggcatagggactacaaggtggacttggaatccaagcttgggaagacaattgtcattaccaagacaacccctcaatctgagatgggagggtgagttgcttatcatttttcctctgcagccaagaatgcatctaataagccacctattttggttttaggaagtgttaaggaaggtccttggccccaggattacgtccttcttgcctgtaattctatctttatatttgtttttctgtgtctcccaaggtctcaagttgacatgatagtgtctctaggagtggtcactcagtgggtttcttcatgttattagcattggctgggcacagtggctcacgcctgtattcccagcactttgggaggccaaggcaggaggattgcttgagcccaggaattcaagaccagcctgggtaacacagtgagaccctgtctcaattaaaaaaaccaaaacaaacaaaaatcatactatgagcactacagctactactcaatatagtttttaaattttttattgccattgtacttgttatcaattctgatttactattaatattttaaaagggattatttgatctgtcagaagaagaaatgaaggaaaggactactgaggagatttctaggagagaaattaggtggagctagaatagagcctaggagttgttaatggtgaagaagaggggtttgaggttccagactagctgcaaaggctgtagttgttatggatgcctgattgtacaccttcttccaagactataacctataggaagaagggtcctacaagagcttgtcaccctt

SEQ ID NO: 117933 - DNA, 1576 bp, Homo sapiens
gtgttggtcaggctagtctcgaactcccgacctcaggtgatccgcccgcctcggcctcccaaagtgctgggattacaggcgtgagccaccatgcccggccaccccatagacctttctataagactgctcacaataaagcaactggcttccccagagcaagtaacccaaacaaagacagaaggcatggtttttaaaataacctaattttggaagatactacttttgacatattctattggccaaacagaccaactctggtacaaattgggaagagactacacagagtaggaataccaagagggtggggctcatcctggggctgtcttggaagatgactgctatactctctcgaaagctaaggctttatagaaatgaaggcttaacacttctaaaaagaagtttacctaaaaatttgagtttcttggttgaaaatgataagatccttaaaaccatatttgactcaggtgctgtttcttcctgttagatattactgcaatgtctgtgactgtgtggtgaaggactccatcaactttctggatcacattaatggaaagaaacgtaaggcttggaggtagcttgtgactagggctggaattgggttttggaggtggggtggaatggaagggtagctttttttttcttctttttactcatcaaaagatggctggagtaagaagggtagtttctactgggctcttttttgatgcccctattagaactctccagttgtttcagcacaggccgtcttttacttcattatgtaatatttctggaggccgtgaggtaagaggcctcattctggaggccatgaggctttcaacagcacccaaaccatgtgctgctcctggacccagctggccaagggagtttcttttagccataattatttttgctgtgtgttttatgagatgtcagagaagtcaggaaaataatttttgaggggctgaggatgttgtaatgaacttgccttcttcactgttgaccctatgcagatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggtaagggtctcctatccttcccctctcccccagatttgagttttatgttatgaatcatgggagaccctgtcctcatcccactcctactcccacccccagagttgtatctcctgagttctgtatattagcggaaacatttgttgcctttgtttaggattctcatgatctgaaggaaatggctctgaaactacttttttctcctagactctctgggccttatttttttttttgtaatttaaaaaaaaattttttttttttttggtcatacagatatttctcaacttctgatggggttacctactgataaacctatcatcaagttaaaaatatcataagtcaaaaatacataatacacctaacctactgtagtttagcctagcctaccttaatgtgctcagaacacattagcctacaattgacccaaattatctaacacaa

SEQ ID NO: 117934 - DNA, 2401 bp, Homo sapiens
cccatattagagatcttaatatacatgaagtactcagagcaatttctggcatgtactgcatgccccagaatgttagttgttgttacaaacaacatttggctgaggagtctaaactgattctgagtgatttttccctccaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcatgtttcattttcctgaagatttatgtttttgtctaccttgtgagcaggcttttggaagaacctgtttgatgcaaaaaagaaaatgaaaaacaaaacaaaaaatccccaaaaccttattatgggagcccgtcggtcttagaagctgtttgacatgtataataaatggcattgactgggcctgttttacatttggtgagaacattccataatcttccctgtgaatatttgtttttccttctcatgctgaggatttccatatagagtattttattcttccattttaaatcttatttttgcctaggtttttttttagcatgagttatgttttcgtctgataagggatctatgtccagagaagtctgaaccaaaacgattcctatcatttcagactcctttgatcttttgtttttggaacagcagagctcaggattgaacataatgttttttcttttttttttttcttttttttgagacagtcttgctctatcgcccagtctggagtgcagtggcgtaatcttggctcactgcaacctccgcctcctggcttcaagtggctaatattgtatttttagtagagatggggtttcaccatgttggctaggctggtctcaaacccctgacctcaggtgatccacctgcctcggcctcccaaagtgctgggattacaggcgtgagccactgcacctggcccttagtgtttttcttactgtctgctagacacagaattacttaattttggcactgttgagattttgggccagattatcatttgttgtagaaaccaatgctggcattgtaggatgtttattattttgattttgatttaggattaacttcatccctggactctacctgctagatgccagtagcaccctcttccacaattgtgacaactaaaaatgtctatgcctctgagaaaggcaaaatccctccctacccacattgaagaccactaagaagaagctagctgtcttccctaccttggtctgatttgagaattagatggcacagactggcaaactcaaaacagaaactcacaaaactttgatatccactggatcaagtactatgccaagtcaaggggatgcagaagaaaaaaatagccatacatacacgaagaactacagtcacattaacttcaagcagatgaagcctgtaacttgctggttctataccctgaaaaaatggacctgtaaatgaatctgtttgggttaacaaggctgccaccatatagctggttttcattctctgccccatcaagctcctcaactttctgtattatctgaaccacaaagcaccatacacctccctttggacttttgtacaaaattcccttactgtaagacatgccctttgtctaatttctgatgctgaatcttgccactgggaacactga

SEQ ID NO: 117935 - DNA, 1106 bp, Homo sapiens
taacaggaagtttcactgggcgggggttggaatgtttatctagtttagcagcgaagttctaagataaggtctgaaatacaatttacaccttgtaaagactccactcccctggcccaagcactagttgtaaaagtcgatttgatcacgaagtgaccctgtgtggttgttttgggagcgcagagtctggaagcgaaggaggtgggggcgtttcgagagttgtggaccaggtgactgctgagaaggagacagtaaaccggggacacacctgcggaagagctcttcagggattaggaaaggctacgtccttgtcactgctgtgtgtccccagatggacaactcctcaattgtctggaggtcgggggcgtgttggacagtcctggtcgctgagtcatgctgaagcactctctttttgactcactctttgtgacgtaggtctttctcaccagtcaataaaatataatccgaaagcaacctccgggctggctttagctcagcggttacttcgacagttctttaattgaaacaagcaacctgtctgggttgttcgagacccgcgggcgctctccagtccttttacctctctgggcggttcgagacccgcgggagctctccagtccttttcactgctgaagttcagctccctttccatggtaaaaggaatcagggctcctcggagaaatggctgattttagtactgggcaggaaatatagaaatggacgtggagcatctcatagagctagaaagtaaggaaatgcttaaaaaccaagaacaaccaaactcaacttttaaagttttttcaatgtttagtatgttcatgtgtttgttctaacagttgcctgtatacttgtatcttctcgcccttttttactgaggcccacaggatttttttctttcaaatctaatggatgttctaagatataccttagacttgatcattccatataagttttcctaggtttcctttcgatatgtagacccaatttttttttattatagttttgaagattacatcggttccattattttattcttcttcagggactgcaatgtatgttggatctttgcctctataccactttctctctgatcctttgaattgctttct

SEQ ID NO: 117936 - DNA, 1044 bp, Homo sapiens
tctaggaccatagactgtgaggtctggaaaagatgctctaacttaaagatttctgaaaatacaaaatttacttttacactttaaatgcaattaaattgcaatgaaactaaccaacaattagaatacaaagaaaatttacatttattataccgcaaaaaaactcatacatttataaataccagtaacatgcatagaattggaataagatggttactttctaataaaaggagacacctccaatgggcaaagcagtaaaaaaggactttccacaaattaaacgagactagcctcagtagatccttattaacacttaagtgaattcaaagctcttcctgaaactgggatttgcctcgctaaccctctctgcaccctgagcaacgaagttggggataattggcttcaggaacttgaactcatttgtcccggagcctccagtcagacacacctcgtactggtagctctgggacagggtcccggtgccgctcacgtccaccatctgccctggaaaggggccctcgggcaccgagcagcgacccaccgaggccgccctgctcctcctgcacagccgcaccgccacgaacaggagcaccgagaagaggaagagcgaagacaccgaggccaacgccaccaccaggtagacggtgagcaagtcggcctgggcctgggccggtgccgcctccgggagcagcaggtagggctgggagaagccgtccaccaggagcacgtgcagcgtggcggtggccgagcgcggaggctcgccattgtccttgaccagcaccaccagcctctgcttggcagcgtcgcgctccctcagcagcctggcggtgcgcacctcgccattgtgcgcccacacgccgaacagcccgggctccgtggccttgagcagctggtacgacagccaggcgttctggcccgagtcgccgtccaccgccaccaccttggtcaccaggtagcccggctcggccgcccggggcaccagctcggtgcagggcgcggagccgttctgcagcgggtacagcacgaagggcgagttgtcgttggcgt

SEQ ID NO: 117937 - DNA, 1037 bp, Homo sapiens
ggcctcggtgtcttcgctcttcctcttctcggtgttcctgttcgtggcagtgcggctgtgcaggaggagcagggcggcctcagtgggtcgctgctcggtgcccgagggcccctttccagggcatctggtggacgtgagcggcaccgggaccctttcccagagctaccagtacgaggtgtgtctgacgggaggctctgaaagtaatgatttcaagttcttgaagcctatattcccaaatattgtaagccaggactctaggaggaaatcagaatttctagaataatgtaggtatctgtagctttccgaccgtctgttaattttgtcttcctcacttttcaccttagttttttttaaccctttagtaatcttgaattctacttttttttaaatttctactgttgtctttagtaatgttactcatttcctttgtctgattgttagttttcaaattattgtattattataaatattttatatcaggaaagttcatatttctgaataaattaatagtattcattcctgaagggtgatatgaaagttaaccccacctaataaacataactctaattctgaaattacctttcacactatatgacactacataagaatgtatgatttttgaagtcatattttaagttttttttatagtttttcttattcacacagcttgactttttgacaaaagtttggggtgtaatcatttcatatttatccatgtgtaatttcttccaagcttcatatttggagttttgttttttccaataaggagcaacatggataagtttaagctactcttttcaaggtcacacttgtaagcattagattttcattctaaaacacatatgtcatctcataaaaatatatctgcgtaatgtattctgtctcatgtaaattaacatagaaaagactaatgggttcttccttatctctatctaatgttatgatcctattggggggactggacaggctttctaatacccagatttactgtgtttaaggtgttcgtataaggccaatagacactaggaccaagtaat

SEQ ID NO: 117938 - DNA, 1033 bp, Homo sapiens
ggcgatagaaccctcaaatgtctttaaacacagtatttcaaattactatatttttgcttagagatctgaaatgatacaagttgtacccaaatattgaacactgaattaagcaaataggacaggaaaaaaattctcctgacttagatttctattcctcactcccactatccttacttgcctcatactatttttttgaaggtattgagttaaatctttaatgaatgacacgtaagaaggtatgctgacaacaaagctaacttagactacctcatgggtgccaggcagcgggacggtggactctgaaatgatccacttcctgttaaacgccagtcccgttttatatttaatacaggcctgctccgatgaagcaccactccatagctactgaccatttaagtatggaatatataacttaaatctataaataactttaaagtataaacatgattttcttttaaagtaaaagtaaataaatggaagatcagccatagctctggggcacaccaggcctgacactgagcctcccctcccctaaatgtccgcagcaacccttactggtcagtatctcatttccctgaccatcttgcttctgacactaaggctagagttaccacagagatttcatagatagcaaaaagcttaaggaaacaaagtttcccacaggaattacattctgtcaaataataaacccacatggtacagactattattaagactggtagcctgcttcttttcagctttagaggctgcttaagaaaacctgatactgaaagagaccctgctggtggtcttggagcaacacagaatgatggggcttactttagtggtgacaagaatgacatggccaaagaacagttgcttatctccaagtctgtggggatcagataaatgaactacgttttggggttgggggtttttctttgttttggaggggttttgacagtgtacatatacatacatatggtatatagttcaataaaattacttttcttctgtttcattccttagtcacaccccatacgtagttatcatt

SEQ ID NO: 117939 - DNA, 1068 bp, Homo sapiens
ctcagacgagtgagcgaacatgaagtccggtcctggcatccaagccgccatcgacctcacagcgggggccgcaggggggacagcgtgtgtactgactgggcagcccttcgacacaataaaagtgaagatgcagacgttccctgacctgtacaagggcctcaccgactgcttcctgaagacatacgcccaagtgggtctccggggcttctacaagggcaccggcccggcacttatggcctacgtcgccgaaaactcggtcctcttcatgtgctacgggttctgccagcagtttgtcaggaaagtggctggaatggacaagcaggcaaagctgagtgatctccagactgcagccgcggggtccttcgcctctgcatttgctgcactggctctctgccccactgagcttgtgaagtgccggctacagaccatgtatgaaatggagatgtcagggaagatagcaaaaagccataatacaatttggtctgtcgtgaagggtatccttaaaaaggatggccccttgggcttctaccatggactctcgagtactctacttcaagaagtaccgggttatttctttttctttggtggctatgaactgagccgatcgttttttgcgtcagggagatcaaaagatgaactaggccctgtccatttgatgttaagtggtggagttgctggaatttgcctgtggcttgtcgtgttcccagtggattgtattaaatccagaattcaagttctttccatgtatgggaaacaggcaggatttattggtaccctcttaagtgttgtgagaaatgaaggaatagtagccttatattctggactgaaagctactatgattcgagcaatccctgccaatggggcactgtttgtggcctacgaatacagcaggaagatgatgatgaaacagttggaagcatactgaagtgtcttggtgaacctggatccgagtccatgagtttgaggactacagttcatcacagggttcagcagagtacaagaccactgtctaattttgacttcatgggaattttggttttatcttcccttcttctaccctaaatctta

SEQ ID NO: 117940 - DNA, 1581 bp, Homo sapiens
ccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagt

SEQ ID NO: 117941 - DNA, 1041 bp, Homo sapiens
tcttaagtctgcagtagattttgaacaccggcagtaactgtacaaatatatcagattagttttaatagccatctccccttcccctacaagtaaaggagagtactacagcagtatgtactctgaattgctgctattgaagaacccctgagcctgtgcagcgtggcactcctgtggtccccattactcaggaggctgaggcaggaggattgcttgatgccagctagaggctgcagtgcactatgagaacacctgtgaatagccactgcattccagcctgagtaacatggccagaccccatctcttaagaaaagaaaagaaaccctgaaccagaggagcagagctgccaccacttagtggtggggatggggcagaacagctcagggcaagacacaggccttggatgccaatgccagccgtcagatattgagcaatgtgtaagtggggttagcctgcaggagaacctgctcgccacctcctcctcttcattctttaggtgatccccattgacctagacaatatctttaatatagagttctcctgatttttctacacaattttacagggcatacagaatatatttcctgtccaataatgacagaaatacttgattttgaagagtaacagttatagcttggaatagaagactggaggcagtttgagggccgacttcagagtcctggttgaaatgaaggttgagaagtataatgcagtcagtgcaggtgactttcagctgggtatctagtcctatcagaggtaaaaactgtggttgccctaaccaaaacaataggactaagagaccttaaatgaaagatgaaagttattatagagagaaatgatcatactggcaaacaattcacctccaagaattatgatgtgactctttgtcagatactcacagatggaattctaaactggtagcagaccctgaaggacaatgtcaccatcagaaccaccaacaaggacaaactgtccctctcctgcatcaccctgcataccatctgcatccacaaaaatgctcattcttcaacaagcctcctattt

SEQ ID NO: 117942 - DNA, 2001 bp, Homo sapiens
cctgaatagcaaacttggaaagcagataacatgggaatacttggattctcctgtatatttcaatttggtgacatttaggcacatttaaagaagtgaacatatagtttctctttttcatacatatattgtagaattatttccttgacaatagactaaaacttaagaaaataacaagttaatgagaaggttttcagtatttgctaggaatgcagtaactggttaggactgtgggcgccgctgttcactaatctggtagatacaggcagtacacacaggtcaggaggaggaaaaaaaaaaaaaagaaaaagaaaaaagctctcgtgcctcttagaacctccataaccgccagattgaaaactgactgtccaagactgcctaaatcctacttctggatgactctccagtcagaattctcctgaaaattgggttaatttcagctcagaaaagcagaaacgatacccttggtactggactggaagaaaactacgaagtgagagagccatgaagattcagaaaaagctgactggctgcagcaggctgatgcttctgtgtctttctctggagctgctgttggaagctggggctgggaatattcactactcagtgccggaagagacagacaaaggttccttcgtaggcaacatcgccaaggacctagggctgcaaccccaggagctggcagatggcggagtccgcatcgtctccagaggtaggatgccgcttttcgctctgaatcctagaagtggcagcttgatcaccgcgcgcaggatagaccgggaggagctctgcgctcagagcatgccgtgtctcgtgagttttaatatccttgttgaggataaaatgaagctttttcctgttgaagtagaaataattgatattaatgacaacactccccaattccagttagaggaactggagtttaaaatgaatgaaataacgactccaggtaccagagtctcattgccttttgggcaagaccttgatgtgggtatgaactcactccagagctaccaactcagctctaaccctcatttctccctggatgtgcaacagggagccgatgggcctcaacatccagagatggtgctgcagagtcccttagacagagaagaagaagctgtccaccacctcatcctcacagcttctgatgggggtgaaccagtccgttcagggaccctcagaatttacattcaggtggtggatgcaaatgacaatcctccagcatttactcaggcacaataccatataaatgtccccgaaaacgtgccgctgggtactcagctgctcatggtaaatgccactgaccctgatgagggagccaatggggaagtaacgtactcctttcacaatgtagaccacagagtggcccaaatatttcgtttagattcttacacaggagaaatatcaaataaagaaccactagatttcgaagaatacaaaatgtattcaatggaagttcaagcccaggatggtgcggggctcatggctaaagttaaggtactgatcaaagttttggatgtaaatgataatgccccagaagtgaccatcacctctgtcaccactgcagttccagaaaactttcctcctgggaccataattgctcttatcagtgtgcatgaccaggactcaggagacaatggctacaccacatgtttcattcctggaaatttaccctttaaattggaaaagttagttgataattattaccgtttagtgactgaaagaacactggacagagaacttatctctgggtacaacatcacaataacagcaatagaccaaggaactccagctctatctactgaaactcacatttcactactagtgacagatatcaatgacaactccccagtcttccatcaggactcctactctgcctacattcccgaaaacaaccccagaggagcctccatcttctctgtgagggcccacgacttggacagcaatgagaatgcacaaatcacttactccctaatagaggacactatccagggggcaccc

SEQ ID NO: 117943 - DNA, 1036 bp, Homo sapiens
tgcggactcgcggaagagccacctgattttcccccagcccaactatgcggacacgctcatcagccaggagagctgtgagaaaaaggattttttatcagcgcctcaatctctactcgaagaagaaagagaagaaacgttttctcaggtaatctatcttttcacaacatacgtactagctagtttgctgaagtaattcacttacttgtttactatatctattttgttccccatatttccttgagggtagagtcaagttttaggaagtgagtcttggtgaattatttcttggtaggtcttagtgttcacaggctgtaagaggaagaagagacgtgagaatctttgtgcaatgaatgtaaaccaggagttaatagataagattatccaaagagcactgcattaggaactagggtgtctggtttcttatactttcttctccatccctgggcaaatcatctcatccacccagatcaacaattttttctttgttaaaaatataaagattggagtttatgtttactcaagtcctttcttcttttaagttatgactcttactctatatttgaatctgtatatgaacagtgaaacatgttagttggctagttctttctcattcagtcttaatacatttctttcagtttggcagcaaaattgttttccttaacttgcatgcccttccctgttaaaaatatggaaatttagaaatatacattccttacagtgtttcaggaaggtatgtcatattattttggcttagttttaaaaatcacattaacctctaagctatatgcttcttgaagaagtgactgacttatcatctgctctataataaagctgtagagtggtaataaacaggtttctcctttttttttatctttctcatacgtgggaaccatactgtattttaatctttaaaataatatatatcctcaatatagttttgcttaaagaaaagatacaaaagattcatatcatacaattgcccagaaccaacttctttatacatctctcttctcaaggtttctactcacaatagctg

SEQ ID NO: 117944 - DNA, 1585 bp, Homo sapiens
ttcgtttcttgagaaaataagattggagtccgtcgtaggaaactggaaccgaattcagagaaagcgattcaccgaaaaggaaatgaccaattgcctgagtttccgaaatggcagaggactggccctgctgtgcgcgctcctggggacgctgtgcgaaacaggatccggtcagatccgctactcggtgtctgaggagctagataaaggttccttcgtgggcaacatcgctaacgacctggggctagagccccgggagctggcggagcgcggagtccgcatcgtctccagaggtaggacgcagcttttctctctgaatccgcaaagcggcagcttggtcaccgcggagaggatagaccgggaggagctctgcgctcagatcccgctgtgtctggtaaaaattaacattctggttgaggataaattgaaaatttttgaagtagaaatagaaattaaagatattaatgataatgctcctaatttcccaacagaggaattggaaataaaaattggtgaactaacggttcctggaacccgatttccaattaaaactgcttttgacccagatgtaggcattaactccctgcagaactacaagcttagccccaatgactacttctctctggctgtgaatagcgtctctgagggggccaagtatccagagctggtgctggagcgggccctggaccgtgagaaaaaagaaattcaccagcttgtcctggttgcctctgatggtggcgaccctgtccactctggcaacttgcacatccaagtgatagtcctggatgcaaatgacaacccaccaatgtttactcagcctgagtaccgtgtgagtgtttgggagaacgtgcctgtgggtacccggctgctcacggtgaatgccactgaccctgacgagggattcaatgctcaagtgtcttatattctagataaaatgcctgggaaaatcgctgagattttccatcttaactcagtgagtggagaagtatcaatattaaaaagtctagattatgaggatgccatgttctatgaaattaaaattgaagcacaggatggaccaggtcttctttcaagagccaagattctagtcacggttctggatgtgaatgacaatgctccagaaattacaatcacgtctctcacaagctcagtcccagaagagggcaccgttggaagagaaattgctcttatcgacgtgcatgaccgagattctgggcagaatgggcaggttgaagtttttgtcctgggaaatctgccatttaagttagaaaaatcaatagatcaatattaccgcttagtgacggccacatccctggaccgcgaacaaatatcagaatataacattagtctgagagcctcagatgggggaagcccgccactgtccacagaaactcacatcaccctgcatgtgattgacatcaatgacaacccacccaccttccctcatttatcctactccgcctacattccagaaaacaaccccagaggagcctccatcttctcagtgacagcccaggacccagatagcaacaacaacgcccgcatcacttatgcattgaccgaggacactctccagggggcgcccctg

SEQ ID NO: 117945 - DNA, 1013 bp, Homo sapiens
gcttctcaattctgcaggagcgtcaggcagggtgccttcctgctttgtccggtgcactgagcacagacgctgctcctgttcaccctcgagcgcctaactaataagtcctaagctcaaatcacagaagtccagggtgctgccatttctttttgaaaaacatcccagaggaaagaagctccgcggagagttcctgaaatgcagagagccagagaagccgaaatgatgaaaagtcaggtactgtttcccttcctgctgtctttgttctgcggggccatctcccagcagatccgatacacgattccagaggagctagccaacggctcacgggtggggaaacttgccaaggatctggggctcagtgtccgggagttgccaactcgaaaactgcgggttagtgcagaggattatttcaacgttagtttggagagcggggatttgttagtgaacggtaggatagatcgagagaagatttgcggaaggaaacttgagtgtgcactagaattcgaaacggtcgctgaaaacccaatgaatgttttccacgtggttgttgtaatccaagatattaatgacaatgcaccacgtttcgttgcaaaaggcattgacttagaaatttgtgagtcagccttacccggggtaaaattctctctggattctgctcaagatgcagatgtggaaggcaattcactgaagttatacaccatcaaccccaatcaatacttctctctgtcaacgaaggaaagtcctgatggaagtaaatatccggtattactgctggaaaaacctctagacagggaacatcagagctctcatcgcttaatcctgactgccatggatggcggggacccgcctctaagcggcaccacccatatctggatccgagttacggatgccaatgataatgctcccgtgtttagccaggaggtatacagggttagcctccaagaaaacgtaccgtggggaacctccgtgctgcgggtgatggccacagaccaggatgagggcattaatgcaga

SEQ ID NO: 117946 - DNA, 1044 bp, Homo sapiens
tcgacagagggaaaaccgaagcacaggcgactccgcggcggggttgtaatggcggcgcctcctgctcgcccagaccacacccggctgctccagatctgccttctcctgggggttctggtggaaatcagggccgaacagattctctactcggtgtttgaggagcaggaagaaggctcagtggtgggcaacatcgccaaggacctggggttggcgccccgggagctggcggagcgcggagtccgcatcgtctccagaggtaggacgcagcttttcgccctgaacccgcgcagcggcaccttggtcaccgcgggtaggatagacagggaggagctctgcgacagatctccaaactgtgtgacaaacctggagattcttctagaagatacagtgaagattttgcgggtagaggtggaaataatcgatgttaatgataacccacccagttttgggacagaacagagggaaataaaagttgctgaaaatgaaaatcctggggcaagatttcctcttcctgaagcttttgatccggatgtaggtgtaaactccctgcagggttaccagctcaactcaaacggttacttttccctggacgtgcaaagtggggccgatgggattaagtacccagagctggtgctggaacgcgctctagatcgcgaggaagaggcggttcaccacctcgttctcacggccttcgatggaggtgacccggttcgctctggcactgccaggattctcataatacttgtggataccaacgataatgctcccgtgttcactcagcccgagtaccacgtaagtgttcgtgagaacgttcctgtaggcactcggctactcaccgtaaaagccactgatccagatgaaggagccaatggagacgtgacgtattctttccggaaagtaagagacaaaatatcacagctatttcagttgaattctctgagtggggatataacaatattggggggtctagattatgaggactctggattctatgacatagatgtagaagcccatgatgggcctggtctccgagctagaagcaag

SEQ ID NO: 117947 - DNA, 1048 bp, Homo sapiens
ctattccagataatctgccattcacacttgaaaagacctatggaaattattatcggttgttgacacacagaacactggacagggaagaagtctcagaatataacatcactgtaactgccactgaccagggaactcctccactgtctacagaaactcatatttcactgcaagtgatggacatcaatgacaacccacccactttccctcatgcttcctactctgcttacattcctgaaaacaaccccagaggagcctccatcttatctatgactgctcaagaccctgacagtggtgacaatgcccgaatcacttactccctggccgaagacaccttccagggtgcacctctgtcctcctatgtctccatcaactccaatacagggatcctatatgctctttgctccttcgactatgagcagtttagagacctgcagctgctgatgacagccagtgacagtggagaccctccactcagcagcaatgtgtcactgagcctctttgtgctggaccagaacgacaatgtccctgagatcctgtaccccaccttccctactgatggctccactggtgtggagctggcaccccgctccgcagattccggctacctggtgaccaaagtggtggcagtggacagagactcaggtcagaatgcctggctgtcctacagcctactcaagtccagcgagccgggactatttgcagtggggctgcacacaggcgaggtgcgcaccgcacgggccctgctggacagagacgcgctcaagcagaggcttgtagtggtcgtccaggaccatggccagccccctctctcggccaccgtcacactcactgtggctgtggccgacagcatcccagatgtcctggctgacttgggcagcctcaagccttcagcagacccagacgactcgggcctcacactctatctcgtggtggcagtggccgctgtctcctgcgtcttcctggcttttgtcacggtgctgctagcactcaagctgagacgctggcacaagtcacgcctgcttcacgctgaaggcagcaggttggcagg

SEQ ID NO: 117948 - DNA, 1075 bp, Homo sapiens
gcagtagataatttataacctaaaatcaaattttttaaaaaatgtgtttttgttagaatgggcagtgggtttcttttagcaaataacaattttgattaaacaaattgttgtatattcatattacggactactagataactatattatgggccactagataactataagaaataaataggaaagctctctatgtactgatatgatctttaagatataacaactaaaaaagcaatgtgcagaatatggtatgttgtatgcttacatttgtgtaaagaaggagacagaatatttataaaaatccgttgccctatacaagacatatctccggaaggatacctaagaaactttaacactcatttcccctgtgaaagcatttctcctcatctaaagcagagatgaaaggaagaacctatgctgaatgcatcttttgaatttggaactatatgaatatttcacatattttaaaacaaatgaagactttataaattaaaaaagaaaagaaaagaaaaaagttcttagcaaatattgacaagccattagtgcagtttcctgagaaaacctctgagcgtcgctgttggtcaaaagaacgaagagaagcgtttgggagcctcttagaggggaacttcctgcacaaaccaaccacacagagaaggccagtatagattcggaaacagaaaacaaaagcaggaaaagtgaccttagcccggattctgccatccccggaaggcttattcctcctatgggcaaaggagcaaagggagccagaagatgaaagcgagctcagggaggtgcgggctggtgcggtggctgcaggtactgttgcccttcctgttgtctttgttccccggggctctcccagtccagatccgctattcaattccagaggagctggccaaaaactcggtcgtaggaaacctcgccaaggatctggggctcagcgtccgggacttgccagcccggaagctgcgggttagcgcggagaaggaatatttcacagtaaacccagaaagcggagacttacttgtgagtgacagaatagaccgagaacagatatgcgggaagcagcctctgtgtg

SEQ ID NO: 117949 - DNA, 1013 bp, Homo sapiens
ctgagggaggacgtgccgccgggcttctttgtgcttcaagtgacagccaccgaccgggatgaaggcataaacgcagagatcacctactcctttcataatgtggacgaacaagtgaaacactttttcaacttaaatgaaaaaacaggagaaatcacgacaaaggatgatttggattttgagattgcaagtagttacactctgagtatcgaagcaaaagatcctggagatctagcagcccactgcagtatccaagttgaaattcttgatgacaacgattgtgcacctgaagttattgtgacttcagtatctactcccctaccggaggattcgccaccaggaacagtgatcgccttgataaaaacgagagacagagactctggagaaaatggagaagtttactgccaagtgttgggaaatgccaagtttattttgaaatcttcctcaaagaactattacaaactagtgacagacggcgctctggaccgggaggagatcccagaatacaatctcaccatcacagccaccgacgggggcaagccgcccctctcctccagcataattgtcaccctgcacatctccgacgtcaacgataatgccccagttttccaacagacttcctacatggttcacgtggcagagaacaatcctcctggcgcctctatcgctcaaatcagtgcctctgaccctgacttgggccccagtggccaagtttcctactccatcgtagcgagcgacctgaagccgcgggagattttatcctacgtgtccgtgagcgcgcagagcggggtggtgttcgcgcagcgcgccttcgatcatgagcagctgcgcgccttcgagctcacactgcaggcccgcgaccagggctcgcccgcgctcagcgccaacgtgagcctgcgcgtgttagtgggcgacctcaatgacaatgcgccacgggtgctgtaccccgcgctggggcctgatggctccgccctcttcgatatggtgccacgcgccgcagagcccggctacctggt

SEQ ID NO: 117950 - DNA, 1050 bp, Homo sapiens
gagatagtggagagactttctcaaagtcctcacaagtaacaaagatctttatttcttctgcatatgacagctaatataacttacataaatcagtaggcctgtttggaaaggtgcatggagaactgggtttgtttccttggtattcttatatgcaaataagcacgttttcctaaatttatcctaataaggagatgaaatcttgaatcctacaaaggtaagaatttgaatgtcctaatttaatggactaaatatagataagaggtaaataaaggacataggctcccccgatgacgcattaaataaaatttttgtaaggtattgagatctaataatcatattgatctcagggattgtggaagtcttgctattcagaattaaagctgaattaacggtcataaacaacgctacacagttaaacattaaggatatggcaacattattagaaataaaattataactaaacttaggagaaataaaaatggaatttgatgcagtcactggttaggactctgagtgtcgctgttgaccaaagtgggaaagaagctgccgcagaggcgacccgactctgctccctccatactaaacacacagaccagacaagctcctacgaaaagccaacgctccacgcccattttcgtcagggaatatgtacccatcggctttagataaataaggaaacagcaggctgaaccagaactaagagaaaattgggcagagagaaggcaatggcgagtccacctaggggctggggctgcggagagctgctgctgcccttcatgctcctggggacgctgtgcgagccaggatccgggcagatccgctactcgatgccggaggagctggacaaaggctccttcgtcggcaacatagccaaggaccttgggctggagccccaggagctggcggagcgcggagtccgcatcgtctccagaggtaggacgcagctttttgccctgaacccgcgaagcggcagcttggtcaccgcgggcaggatagaccgggaggagctctgcgctcagagcccactgtgtgtggtgaactttaacatct

SEQ ID NO: 117951 - DNA, 1035 bp, Homo sapiens
accagggctcgcctacgctcagcgccaacgtgagcctgcgcgtgttggtggacgaccgcaacgacaatgcaccgctggtgctgtacccagctctggggcccgaaggctctgcgctcttcgatatggtgccgcgctctgcagagcctggctacctggtgaccaaggtggtggcggtggacgcagactcgggatacaacgcctggctgtcctaccacattgtgcaggccagcgagcccgggctgttcagcctgggcctgcgcacgggtgaggtgcgcacggcgcgtaccttgggcgacagggaggccgcccgccagcgcctgctggtcactgtgcgtgatggaggacagcagcctctttcagccaccgtcatgctgcacctaatcttcgcagatagcttgcaagagatacaacctgaccttagcgaccgccccactccctctgaccctcaggcggagctacagtttcacctagtagtggcgttggccttgatctcagtgctcttcctcctcgcggtgattctggcaatctccctgcgcctgcgatgctcctccagacccgccactgagggctactttcagcctggtgtctgcttcaagactgtacctggagttctccccacctacagcgaaaggactttgccttattcctacaatccgtgtgctgcctcacattcctcaaacaccgagtttaaatttctcaatataaaggctgaaaatgctgcaccacaagatcttctatgtgatgaagcctcttggtttgaaagtaatgacaatccagaaatgccttctaattcaggcaatttgcaaaaggtgagtttcttcaaacctttccttccataaatataattgggtttcaattcattgatttagagataaaaagaatacagattaaatattccctgattacattattttattgattttctggtgtagagtagggtgtctaggaaattctttgtagaatttcctgtagaatatctgtgttgcagttgttctttcatagaaagcctccttttgatagtcttgaaacttttct

SEQ ID NO: 117952 - DNA, 1702 bp, Homo sapiens
gacagagattctggaaagaatggtgaggtgacctgcaccattccagaaaacctaccttttaaattagaaaaatcaatagataattattatagattggtcacaaccaaaaacttggaccgggaaacactctctttgtataacatcacactgaaagccacagatggtggaactcctcccttgtccagggaaactcacatattcatgcaggtggcagacaccaacgataacccacccaccttcccccactcatcctactcagtctacatcgctgagaacaaccccagaggggcctccattttcttagtgactgcacaggaccacgacagtgaggataatgcccagatcacttattccttggccgaagacaccatccagggggctccagtgtcctcctatgtctccataaactctgacactggagtcctgtacgcgctgcaatcctttgattatgagcagttgagagaactacaactaagagtgactgcacatgacagcggggacccgcctctcagcagcaacatgtcactgagcctgttcgtgctggaccagaatgacaacccgcccgagatcctgtacccggccctccccacagatggttctactggcatggagctggcaccccgctccgcagagcccggctacctggtgaccaaggtggtggcggtggacaaagattcaggccagaacgcctggctgtcatacctcctgcttaaggccagcgagccaggactctttgcggttgggctgtacacgggcgaggtgcgcacggctcgggccctgctggacagagatgccctcaagcagagcctcgtggtggccgtccaggaccacggtcagcctcctctgtcagccaccgtcacactcaccgtggctgtggctgacagcatccccgaagtcttggccgacctgggcagccttgagccctccgacggtccttacaactatgacctcacgttgtacctggtggtggcggtggccacagtctcctgcgtcttcctagccttcgtcctcgtactgctggcgctcaggctgcggcgctggcacaagtcacgcctgctgcaggcttcagaaggtggcttggcgaacgtgcccacctcgcactttgtgggcatggacggggtgcaggctttcctgcagacctattcccatgaggtctccctcaccgcggactctcggaagagtcacctgatcttcccccagcccaactatgtagacatgctcatcagccaggagagctgtgagaaaaatgattctttgctaacatccgtagattttcaggaatgtaaagaaaacctgccaagtattcaggtgagcccagcccttcctttatttccatgaggaatttatttgcatgatatttctctattattttgcaaaacaaatgttttgaaaatagggatttaaaaaactttatagaggtaaaaatgagtttaccagtttccttcagtggtgacactttaatatagaacacataggatatagtatttctttagtgaaagcctatggacaagattatgaatatgtggactatcacattttataatttccacctactttccaatctatgttccaacctactttcttaactcatatattttatacattggaatgaatcgagtctttcatattgcacaaggttagcaggaataaaacacacctcagctgtcttctcaggattctctttagcattcaaatatgtaaa

SEQ ID NO: 117953 - DNA, 1013 bp, Homo sapiens
cgccagcgctcagcgcgaacgtgagcctgcgcgtgttagtggacgaccgcaacgacaatgcgccacgggtgctgtaccccgcgctgggtcccgacggctctgcgctcttcgatatggtgccgcacgctgcagagcctggctacttggtgaccaaggtagtggcggtggacgcagactcaggacacaacgcctggctgtcctaccacgtgctgcaggctagcgagcccgggctcttcagcctggggctgcgcacgggcgaagtgcgcacagcgcgtgccttaggcgacagggacgccgtccgccagcgccttctggtcgccgtgcgtgacggtggacagccaccactctcggccactgccacgttgcacctggtcttcgccgacagcttgcaggaggtgctgccggatatcactgaccgccccgacccctctgacctccaggctgagctgcagttttacctagtggtggccttggccttgatctcagtgctcttcctcgtggccatgattctggccattgccttgcgcctgcgacgctcctccagccccgcctcctggagctgcttccagcctggtctctgtgttaaatccgaatccgtggttccccccaactacagcgaggggactttgccttattcctacaatctatgtgttgcacatacaggaaagacggagtttaatttcctaaaatgtagtgagcagttgagttcaggacaagacatactttgcggtgattcatctggggccttatttccactttgtaattccagtgaattgacttcccatcaggtgagtttcctttaagtataatttaatgctcattgcctacccatttctccatattcacaagaaaatatacatatttgcaggaaaatatataatttttagatgtcatggatcattttaggaaagttgtagtcagttaaaaagctgtcatatcattctacaaaggaggagtaaagtaggagcaattgtgtggcccaacatttgtttgttttttagccaagcttagat

SEQ ID NO: 117954 - DNA, 1026 bp, Homo sapiens
tggggctcaggctgaggcgctggcacaagtcacgcctgctccaggattccggtggcagattggtaggcgtgcctgcctcacattttgtgggtgttgaggaggtacaggctttcctgcagacctattcccaggaagtctccctcaccgccgactcgcggaagagtcacctgatctttccccagcccaactacgcagacatgctcatcagtcaggagggctgtgagaaaaatgattctttgttaacatccgtagattttcatgaatataagaatgaagctgatcatggtcaggtgagtttagttctttgcttgcttttaatttccagatgaattttatttggcataaattatgttttgaaaaacattgtgaagatagttgaaaataatttttaaggtgtatcacagagttttgggtttattttggtggtgttactataaaattgaactctaatagtcataggttattgtttcatttgcttttaaacgacttggaaaagattgttcaaccattttaagccttccagtattttattcctattatcactcattcacttaagaagtagctacccgtccatactggtaattttgctattgtttgtgtgtgtgtgtgtgtgtgtgtgtgtgtgtgtgtgtgtgtgtgtgtgtatcccaaactagaacttcagaaaattatcaagaagtctaaagccttgttattagcttagcaaaagtaaaatatatctcagaatttttagggttatgtttagcatttgaacctgtaactaggctcttgtagatttcttcactttaaacctcttttctgagccctgtttctgtaccagtgcccttcaaaactttaatacttcttaccatccttcaaaacatgaacaaactttaaagatggatcttggtgggagatgagactggttactaaatattaagtatgtgagtcagtggtcacctgggctccatgcccatggagacatgaaatctaaagcctagaatgtccattgctcccccaaacaaaaaacaaaagcaaaaacattag

SEQ ID NO: 117955 - DNA, 1209 bp, Homo sapiens
cttatgagcttcatttatccaattccaaagtcatttcagataggataataatgcaatccactagaatatccctttgtaccttgtattgcagaatagataagcatttccccaataactcttaagaatgaatttatgtactgtaaaagatatgacataagagaagtattttgagatatgaagaagagcaacgtagtagggtatatcatttcttagctacatcatatgggcagtatacttgaatgaatatttcctgaagtagaagagtaaagaaaaattatttttataaagaatgttaatatagtcaggaagaggagatgtttggggattggtataaaattgccacaactttacaaaatagttttaaatagtatagatttccctaatatgtgtaatataaaacactagaaatattggggagttggaaatcatagaaatgaacagaagaatgataaaattgtttccatagctaataaaaaatgaatttttgaaatcagtatagtatgaaggctctgagagcaagaactgtatcatattaattattatattgccagtgacaagggcaatacttagttctagctaagagttcaaggtatgtttgcagaatggtgaaagaatggaccaatgtatgcaggtttgtataaaaacccaacgtgatatttctaacaatttggaaaacagagaaagataccttaaagaagttgttataattttttattaagtatatggacgtaaaaacttggcttgttaagttaggcacacaaaaacaattactgcactggttaacttgaagccgcagaggctgtagtttcctagtgctgactctgggcgccgctgttggccaaagtgcagagcttggcgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggtgagcaagctgaggagagcaagagggatggggagcggcgccggggagctgggccgggctgagaggctgccagtgctctttctcttcctgctgtctttgttctgcccggcgctctgtgagcagatccgctacaggattcccgaggaaatgcccaaggg

SEQ ID NO: 117956 - DNA, 1025 bp, Homo sapiens
gctgtaccccgcgctgggtcccgacggctctgcgctcttcgatatggtgccgcgcgctgcagagcccggctacctggtgaccaaggtagtggccgtggacgcagactcaggacacaacgcctggctgtcctaccacgtgctgcaggctagcgagcccgggctcttcagcctggggctgcgcacaggagaggtgcgcacagcgcgtgccttgggcgacagggacgcggcccgccagcgcctgctggttgctgtgcgtgatggtggacagccgccactctccgccaccgccacgctgcacttggtctttgctgacagcttgcaggaggtgctgccggatatcactgaccgccctgtaccctctgacccccaggctgagctgcagttttacctagtggtggccttggccttgatctcagtgctcttcctcctggccgtgattctggccgttgccttgcgcctgcgacgctcctccagccctgccgcctggagctgcttccaacctggtctctgtgtcaagtctggacctgtggttccccccaactacagtcaggggactttgccttattcctacaacctatgtgttgcacatacaggaaagacggagtttaatttcctaaaatgtagtgagcaattgagttcaggacaagacatactttgtggtgattcatctggggccttatttccactttgtaattccagcgagtcgacttcccatcctgagttggtgagtttcatttatgtctattctttttcattacccacccaattttctgtatttacatgaaactatcgtacattttcaagtccaatgagttgtcttagggaagtcagagctgctcagaaagctgtcctaccattctttaagaggagcagtaaattgtgagtttttatgtcgcataaaagaagtagccttatagatttacaaagtagtgagagtttgctcttagcttcctctctagcaaaaacatttggtgcgtttttttgtcctctttctcaaagctaatgaattttacctattcgttgtc

SEQ ID NO: 117957 - DNA, 1033 bp, Homo sapiens
ctactaaaaatacaaaaattagctgggtgtggtggcgggcgcctgtaatcccagctactcaggaggctaagacaggagaattgcttgaacctggcaggtggaggttgcggtgagccgagatcactccattgcattccagcctgggcaacaagagcaaaactccatctcaaaaaaaaggaaggagaaggagaggaagaagaagaaaaatactacatgttatgtgtatgagagagaaagagagagactgattcactgaacttagaaggtccaaatcatccaaataattttctaagtttatccaggttttcttggatgcaaaatccttttccacctctatataattaccagaagaaacttacaaaaaaaaggaaatgctattgcctgaatttctcttgctcggaatcctgacatattcttgaagaaggggaaaaagacaccggatttgtcttatcgtttggagctttaaatataaatgactggatgttttctcaacatccttgtaggatggaaggtgaatacaggattattccatttttaagacaaaaactactagtcttgtgtacatacaaagctcccattacatggtataagtcttttgcttggtttcccttagtatgtgattcagtaaatgggttccttacaaagtgctgagatttcttataataccacttacttttaacctttcagtagttttctttgttgtatattttgtgttctttttcccaaattattatataagtttaagtgatgcttagaataatgtttaagaccactttaaaattgcataatttattgatgaaggattaaaatagaaacttgcttttcagtgtatatgcatttgaatcattgaaacacagtctgtgcatgcattacatattcacattaaaaaactaagcatttttgaaatagcagaaaagtttaagcaattacaaaaatgtgaaaatttccaactttaatcctgttaatatttagcaatattaggcgagaacatctgtaactattgctgaattaatattacttttataatacaaaa

SEQ ID NO: 117958 - DNA, 1158 bp, Homo sapiens
tacaaatgataatgccccggtttttgctcaacggatttaccgagttaaagtccttgagaacgtgcccccaggcacctggctgcttactgcaacagccagcgacctggatgagggaatcaacggaaaagtggcatacaaattctggaaaattaatgaaaaacaatctctgctattccagcttaatgaaaatactggggaaatatcaacagcaaaaagtctagattatgaagaatgttcattttatgaaatggaaatacaagctgaagatggtgggggattgaaagggtggacaaaagtgctcatttcggtggaagatgtaaatgacaatagacctgaagtgaccattacatctctgtttagcccagtgagagaagacgcacctcagggaacagtaattcttcttttcaatgctcatgaccgagactccgggaagaatggtcaagttgtctgttctatccaggagaatctatcttttacattagaaaattcagaagaagattattacagattgttgacggcccaaattcttgaccgagaaaaagcctcagaatataatatcacggtgactgcaacagacagaggaactccgcccctgtccacagaaattcacatcaccctgcaagtgactgacatcaatgataatccacctgctttctctcaagcctcctactcagtctacctcccggaaaacaacgccagaggtacttccatcttctccgtgattgcctatgaccctgatagcaatgagaattctagagttatttactccttggcagaggataccatccaagggtctcctctctccacctatgtctctattaactcagacactggtgtgctgtatgctctgtgctcctttgactatgagcagtttagagatttgcaaatgcaggtgacggcaagtgacagtggaagcccaccacttagcagcaatgtgtcattgagactgtttgttttggaccagaatgacaatgccccagaaatcctgtaccctgccctccccactgatggttctactggtgtggagctggcaccccgctctgcagagcctggctacctggtgaccaaggtggtggcagtggacagagactcaggccagaatgcttggctctcctaccgcctattcaaggccagtgagccagggctcttctcggtggg

SEQ ID NO: 117959 - DNA, 1036 bp, Homo sapiens
gtagcggtggacgccgactcgggacacaacgcctggctgtcctaccacgtgctgcaggccagtgagcccggactcttcagcctggggctgcgcactggggaggtgcgcacggctcgagccttaggcgacagggacgcagcccgccagcgcctgctggtcgctgtgcgtgacggtggacagccgccactctctgccaccgccacgcttcatctggtcttcgcagacaacttgcaagagatactgccagacctcagcgaccgccctgtactctctgacccccaggctgaactgcagttttacctggtggtggccttggccttaatctcagtgctcttcctcctcgccgtgattctggccattgccttgcgcctgcgacgctctctcagccctgctacttgggactgcttccatcctggtctctgtgtcaagtctggacctgtagttccccccaactacagtgaggggactttgccttattcttataatctgtgcattgcacatacgggtacaaaagagtttaatttcctaaaatgcagtgtgcccctacattccaatgaagacatggtttgcagtgtttctcctggagccttaattccacctcatggtggggaggatttgacttcacatcctgagactctgacttcggtgagtttctcttttttgtgtgtgatttatctaatagtctactagtttctcatattttaggcatactactttattttcatatctagaatcatatgtttaaaatccatagctttttacaatattttctcaatgttttttcaattatagttttcactatgtatttggttcataagttgctctatctttttgtaaaataatgtcaccagactgaagatattttgtctttgtcttttttttttttttttttttttgagatggagtctcgcactgttgcctaggctggagtgcagtggcgtgatctctgctcactgcaacctccgccttctgggttcaagcgattctcctgcctcagcctcccaagtagctgggattactggtgcccctcaccaca

SEQ ID NO: 117960 - DNA, 1049 bp, Homo sapiens
aggaaccttgtaagaattatagttaggcatcctacctgatgattttatcgggaccgtattatttccacttccagaaatgtcgttcctttcagtcggttaaaatcaattggaaccaactacaacctacaagttttcagctccagtaatattttgaaaactttttaaaaattaagcaagcccttttaataattactcctttcgcaggtgttcttggtaaagttttaacgtcacataatgtaagtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcg

SEQ ID NO: 117961 - DNA, 1052 bp, Homo sapiens
atggtgttttatttttatcctctatttaatgggactatatgttataccttaacagaactttatcactacctccgaatcaacataaccctcttaatatcacatttcaaagccaacccttcctttttgttctccacgatcttgggaagttagtttagatgaggttttataatatggaacaatctccttttcccagccaaatacctcatatcctttttatttaactaattccagtcaaagtacaatgccttacatcatttttctcagtttggaattccacaagtataaatcctatccctagatgctcaaaatacctgaacatttttcttgacttcaagaaaaatgtaggcatctgttggaagacttgcctttcctacagttgaaattatttttgtccgagccctagatagtcagtttacaactaatgacataaggtaaattcctaaatgagaaaactaaacttgaaagggaacataaatatccaagtaatttggggcaaatacctagaagtgatgtgagagtgttgactgaattgattatggaaatgattcctgtgatcaaaaaccctagataagtctcctttcctcatttggctttcctagacattgcttcagataacatgtatgtcaggcaactatcaagcttcaataacaagttggtctgaataaaagaactgaatgtactatttgccataagaatgaccttataaagaaagaaagaaggaatctatgactcccaactacactgaaaatgaacaaaaaaatagccagaaggatactagctaaatcagtttaattaaagtccaaataccttcaatctatttatatattcacaaactactctatttgaataaatctgtagacatctttagcacatttgaaaataggtttttgagaagcactgaatcaaaatcaagttatttctatatatggatttactacattaaaaaaccttccatacatacaaacacagacaccaaagtaaaagaataaaaggaaataataccagttcaataattcaattatttcctcagaacagtcaatgtaacttcacca

SEQ ID NO: 117962 - DNA, 1070 bp, Homo sapiens
cactgcgaggaagaagagcatagaaatcaaggccaaggccacgaccaggtaaatctgcagctttgcttgggaatcagagggcacaggactgtcactgaagtctggcagtgcctcctgcaggctgtctgcgaagactaggtgaagcgtagcggcgcagagagcggcggctgtcctccgtcacgcacagcaaccagcaggttcccgtgtgcagccccaggctgaaaagcccgggctcgatggcctgcagcacgtggtaggacagccaagcgttgtgtcccgaatctgcgtccaccgccaccaccttggtcaccaggtagccggactctgcggcgcgtggcactatatcgaagagtgcggagccatcgggccccagcgcggggtacagcacccgcggcacattgtcattgaggtcgcccaccaacatgcgccggctcatgttggcgctgagcgcgggcgagccctggtcgtgggcctgcatcgtgagctcgaaggcgcacagctgctcgtggtcgaaggcacgctgcgcgaccaccaccccgctctgtgcgctcacggacacgtaggacgacagtgcccgcagctccaagtcagtggtaacgatggagtaggagacttggccattcagccctaggtccaggtcagaggcgctgacttgtgggatggaggctccgggaaggttgttttcggccacgtggaccacgtaggagacttggtggaaaaccggagcattgtcgttgacttcaccaatgcgtagggtgaggcttgtgctggatgagagcggaggcttgcccttgtcagtggcagtgatggtgacgttgtactccgggatccgctcccaatccagggtcccatctgttacaagcttatagtcattattggcggaagattcgattctaaaaggaactctttcgtttatgaggcatgtaacctccccattttctctcgaatctttatcatgtgttttgaacagagtgatcaccgtccagggttctgcgtcctcagttacagaactggacactgaagtaaaaaccacgtctggggcattgtcattctcatctaggatttctagt

SEQ ID NO: 117963 - DNA, 1071 bp, Homo sapiens
cgcagagtccggctacctggtgaccaaggtggtggcggtggacgcagattcgggacacaacgcttggctgtcctaccacgtgctgcaggccatcgagcccgggcttttcagcctggggctgcacacgggaacctgctggttgctgtgcgtgacggaggacagccgccgctctctgcgccgctacgcttcacctagtcttcgcagacagcctgcaggaggcactgccagacttcagtgacagtcctgtgccctctgattcccaagcaaagctgcagatttacctggtcgtggccttggccttgatttctatgctcttcttcctcgcagtgattttggcggtcgccttgcacctgcgatgctcttccagcccctctgcctggggttgctttcaccctggtctctgttctaagactagaccaggggtttttcccaactacaatgagggaactttgctttattcctgcaatctgtatgttccctcggattctagaaaaagaagatttaattttctcaccatgacaccagaaacagtccccccacaagatctttctaatgaagtttctctggtagcaagcttcactgaagagaataacaagataagctctaactctgttgctcctactcacgtgagttccaatgaatgtctttcatttacaaatggatgaggtttaattttcaaaccaatattttggcaagaaaatcttaaacatattatatctactattgcttcaggtttgtttgcccactcttaatatttcctgttcctttctgtgtgggccagtaacttcattattagctttcatgtatttttgaaacattttcaccatttttacgggagactttttttttttttggacggagtctcgctctgtggtccaggctggagtgcagtggcatgatctcggctcactgcaagctctgccttccgggttctggccattctcccgcctcagcctcccgggtagctgggactacaggcgcccgccaccacgcccggctaattttttgcatttttagtacagacggggtttcaccgtgttagccaggatggtctcgatttcctgacctcgt

SEQ ID NO: 117964 - DNA, 1027 bp, Homo sapiens
aattttttccctatattttgatgggcttccaaaagtattaccagtaattctcagtaattacaattaggtcagttacccaggaaaaggtaagtctgtaacattctttggactaccaattttcttttactaagtttcctgaacaataaatatttttgaaatataatgtattaatagaattctggagtacttccattatttccagtcaatgcaagttggaatgcttctactttatgctaaaaatattaatgtttctttttcacttgggttcttgttaagtgtgattctgataatgtatacaatcacatatcatttttaggtttccataatatcatgaaaatttgatttttaagcgttacatgtcaacaacctggtaaagtaatccttccattcaggatcattcaaggaatctatttaaaaatattttccccaaattatagctgaatcagaaagtttaaattattatattatatgatttgtcaaaaagagaaactcctagggagacatctccataataggtgtgttgggggaacagtaatctcaaagcagatgcactaacattataagattaaaatcattgtttatagaaacttccaattcatttaaaagctcattggggaaaaaaaagctcattgggaaaaaaaaaaaaagctcactaaagtttctattaaagcgaatacggtagatttccatccccttttgaagaacagtaggtggagctatttaagatataaaaacgaaatatcctttctgggagttcaagattgtgcagtaattggttaggactctgagcgccgctgttcaccaatcggggagagaaaagcggagatcctgctcgccttgcacgcgcctgaagcacaaagcagatagctaggaatgaaccatccctgggagtatgtggaaacaacggaggagctctgacttcccaactgtcccattctatgggcgaaggaactgctcctgacttcagtggttaagggcagaattgaaaataattctggaggaagataagaatgattcctgcgcgact

SEQ ID NO: 117965 - DNA, 1012 bp, Homo sapiens
ccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgtagaccgtctgataacaactgatctgtttatctaggggggagaaatctaattcaatggaaaatataaataaaattgtgataaacttttgtaaatagagtggcttttaactacacttgagatggctagcaaattcataaagtgaatttactttctttcaaagttcagtaattctttctggccattagggatatgtccatttatactttctcagtatcccaagtcatttcatggttttaaatcattcatgaacttccaaatatagtgaatttatttcttctgcatttaaaattttatcacttaaatatacaatataccgtattgccatgacgaaaaatggtaaagactatttttcacttctgttatgcatttcattaatacgatatctgtatgtgtttccaagttagacatttcttttgcccatttcctacactaatgatactaatgatgactttgtggaatattcagaattaacaaaatgtgttttgagtgctttttttagtactggggcaaatttgcagtaatatcgcctgctttttacattaaattccccataacttttacaactatgggaaaatttctgaaacgtgcacagattccaagtgttttctgagaactttatgcttattgtagagtggttacagacactgaatgctaaagtgtattactctttgaaaagcattgcttgatttcttttggtgaattctgtaaaggtgcagggaaacataacgtcccaattattttttctttcttctttgtttgctgcctatctactttgaaagatacaatagttaaaacccagaaaagagattggaaaccccttagagaatgaaagacatcc

SEQ ID NO: 117966 - DNA, 1050 bp, Homo sapiens
aaaacagaatgtggtatatgaaatgttcttataatcaggtgattgtaaaaattgatccagataatgttagcatagcattttactgaactagtagtttacaaacacttcaaaaattatagaataacatttgcatataaaattcctcatacatttccctatcagtgaattggaagcttacaatatacaatattaccaaaaagacaaaaaaaatgaaaaggaaacagttacctttggaaaacataattaggtaaaatgggtaatatggaaagtctgaaaactgaaaaaattactgataagtcaagagaaaaggaatattagtaggaaaattcataaaagtgtgtctgactactcacagcaggtttccttattggtatgtattctgtggtccatctaagctatgttaattttattttaaatgctacctgggtattggcttctaaaaggaattcagtaaatcagataatttggcatcttcaatctagattctgatgctcacctgaaaagtctgctaaggattggaaaccaagaaaagtgaagtatctcaacagatatgtgtcacttgtgtgtactggattttttttttttttttttttttttttttttttttttgagatggagtttcactcttgttgcccaggctggagtgcaatggcatgctctcggctcactgcaacctccgcctcccaggttcaagtgattctcctgcctcagcctccctagtagctaggattacaggcatgtgccaccacgcccagctaattttgtatttttagtagagacggggtttctccatgttggtcaggctagtcttgaactcccaacctcaggtgatcttccctccttggcctcccaaagtgctgggattacaggcatgagtcactgcgcccggtcgcgtactggatttatattgtgtaatactttgctctagcagtatagtaggtgagacagtgactgtgtctagtgagcaaaaggcacttatttgacacttttgactcttcctttctacttaccttatttaaaattgatttttgcatgtggcatgatgcacca

SEQ ID NO: 117967 - DNA, 1097 bp, Homo sapiens
gaaagtgatatttagagagatgaatagattaataggatgagtagaagttatctaggtaacaaggaaagtaaaaaagaaattgtcaggcagaggaaatagcatgtgtaaagatctttttaaaaaataaaaggtgtgactcaagcaatttaaaagggctagggaggctagaaacagaaaataaatagatgaaactaataaggcagggagagccttgtaaatcacacttaaaattctggattttgttctaaatacccttgtacttaggagctattaaaatattttaaacaaggcagtgacaagatatttgaattattaagcttactctggctgctatatggagaattgatttatgagggttataaatagaaataggaagataagataggagactatggcaatattcctggtaagaaatggaagaagagctggcttggattaaaggggaggcagtggatgtagaaataaatggatgaattatagatatatttaggaaatgggttcaataagacttaataatggaataggtggaatataaatttcatgagggcagggggtgttttgtttattattatattcctaggtgtctgaaaatattgttgtgttgcctggcaagtggtagatcttcagtgaaatattattaactgaataaatacaatggataaatggggagcagggattaagagtgattcctgggtttccacattaaggaactggatggacaaagctaccatttgatgagaatggaagactaaagaatgatagatttaagagaaatcgagttgagttccagccatgttcatttgaaggatctgagaaacagtgcagatattcagtgtgtgattagacatatggtcatcattcttttttttttttgagatggagtctcgctctgtcacccaggctggagtgcagtggccctatctctgctcactgcaatctctgcctcccaggttcaagtgattcttctgcctcagcctcctgagtagctgggactacaggcgtgcaccaccacgcctggctaatttttgtatttttagtacaagacagcatttcaccatattggccaggctggtctcgaactctgatctgcccgcctc

SEQ ID NO: 117968 - DNA, 1112 bp, Homo sapiens
agcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaac

SEQ ID NO: 117969 - DNA, 1022 bp, Homo sapiens
ctgcaggtcgctggagaggtgaaccaaagacacttccgtgtggatttggacagcggagccctgctcatcaagaacccaatcgaccgagaggcactgtgtgggctcagtgccagctgcatcgtgcccctggagtttgtcaccgaaggtcctttggaaatgtaccgagcagaggtagagatcgtagatgtgaatgatcacgccccccgttttccgcggcagcagctggacttggaaattggggaggcagctcctccaggacagcgtttcccgttggaaaaggctcaggatgcagatgtggggagcaattcgattagcagctataggctgagctccaatgaacactttgcactggatgtgaagaagcgcagcgacggcagcctggtcccagagctgctcctggagaagcctttggatcgagagaagcaatcggactaccgcctggtgctgactgctgtcgatggagggaacccgccgagatctggcaccgcagagctccgggtatccgtgctggacgtaaacgacaacgccccagccttccagcaatccagctacaggattagtgtgttggagagcgcaccagcgggcatggtgctcatccagctcaatgcctcagacccggacctgggtcccagtggtaacgtcaccttttatttcagtggtcatacccctgatcgtgtaagaaacctctttagcctgcaccccactactggaaagcttactcttttggggcccctagactttgagagtgagaattactatgaatttgatgtgcgggctcgcgatgggggttctccagccatggagcaacattgcagccttcgagtggatctgctggacgtaaatgacaatgccccttacatcacagtgacctcagagcttggaaccctccccgagagtgcagaacctggcactgtggtggcacttatcagtgtgcaggatccagactcagggtcaaacggagatgtgagcctccgcattcctgaccacttgccatttgccctcaagtctgccttcaggaacca

SEQ ID NO: 117970 - DNA, 1108 bp, Homo sapiens
ttacactctaagccccaacagccacttctctctgaatgtgaagaccctaaaagatgggaagccattcccagagctggtgctagagcagcagctggatcgtgaagcccaggcaagacatcagctggtgcttactgctgtggatggggggaccccagcccgctcagggaccacccttatctctgtcatcgtgctggacatcaatgataatgctccaaccttccaatcctcagttctacgtgtgggaatcccagagaatgcacccattggtactctgctgctccgcctcaatgccactgatccagacgagggcaccaacggccaactagactattcttttggagaccacacatctgaggcagtgcggaacctctttggcctagaccctagcagtggggcaatccatgtgttgggtcccatagactttgaggagtcacgtttctatgaaattcatgcaagagcccgtgaccagggacagcctgccatggagggccactgtgtgattcaagtggatgtgggggatgtcaatgacaatgccccagaggtgctattggcctctttggccaaccctgtcctagagagcacaccagtgggcacagtagtggggttgtttaatgtgcgagaccgggactcaggtagaaatggtgaagtgagccttgatatctctccggacctgccatttcagattaagccttctgagaaccactactcgctgctaaccagccagcctttggaccgggaggccacatcccactatatcatcgagctgctggccagcgatgctggttcaccttccctacacaaacatctcaccatcaggctcaacatttcagatgtcaatgacaatgcaccccgcttcaaccagcagctttacactgcttacatcctagaaaaccggcctccgggctcccttctttgcactgtggctgcctcagatccagacactggggataatgcccgcctcacctactccattgtaggaaatcaggttcagggagccccagcctcctcctttgtgtatgtcaacccagaggatggacggatctttgcccagcgtacctttgactatgaattgctgcagatgctgcagattgtggtgggggttcgagac

SEQ ID NO: 117971 - DNA, 1034 bp, Homo sapiens
ttaccattatcatccccattttgcagatgagaaaactgaagtggcataaggaggttaggtagacttgcccaggatcacagtgagtaaggaaaggagctaggaatcaaacctagactttctcactccagagcctcttaacctctaccctcaactcttgtgaagagagactaccttggtgacccctatattcccagtgctcagcgtggtcaaggcccagggtgctgtataggcattcattaactgctggggatataagacagtgactgttgaggaccctaagtttagctcccacctgatcttcctctgtctctgcagaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattct

SEQ ID NO: 117972 - DNA, 1050 bp, Homo sapiens
gggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactttgtgtcattgcgcgtctagatgtttccgaattgcgtgtgtgtgtgtgactgtgcaatatggttgtgtatgcttgcaatgccgttgtgcctatgagacagtgtgcgattgtgtgcctatggatctgtgtaccgtgtgccattgtgtgatcggtccgctgtgggggtggggatctgagtgcggcgtgtcagtgtgcagtggagtgtgcagtctaagcttgcggctgtctccaggcagaagaggagaccccggcgcgggcgggggcgggttggcgccgggcaaacgccttgggtagaggggagaggacgtttcgttagttcccgcccctt

SEQ ID NO: 117973 - DNA, 1038 bp, Homo sapiens
tttggaagaatcacctcccgcattccctcccactcccgcggctttcccaaaacccctaggcagcgggggtgggggtgcgggggcaaaggagagtctaccctcctcccgtgaagccctccggggcgcttcgggtaggcaattttagtcaggaaggggcgggaactaacgaaacgtcctctcccctctacccaaggcgtttgcccggcgccaacccgcccccgcccgcgccggggtctcctcttctgcctggagacagccgcaagcttagactgcacactccactgcacactgacacgccgcactcagatccccacccccacagcggaccgatcacacaatggcacacggtacacagatccataggcacacaatcgcacactgtctcataggcacaacggcattgcaagcatacacaaccatattgcacagtcacacacacacacgcaattcggaaacatctagacgcgcaatgacacaaagtggcctcccgattccgcccttcttccagcacccacctcagctcatcacttcatgcacacatgccaggagcttccatcgcttatacagaaacgttcagcttttcagaagaaacgttttattatttttttgtcgaagaaaaaaagccatataaatattagagtataaaacttgcgtgagacacaggaagagggtggggtgggagctacgtgactatgcgaagagaagcgcttataggagaagtcagtacgggggagggggtcgccttagcgcgtggacacagcacaaaacacaacacgggccgccgcgggcagatcaaggacagacggctgcgcggagcccgccgcccgctgcccacccgccatcacgtaaaagcacaccgcactacactactggctattctacaccagccgaaagagggagggggcgctacactactgtaagggcaggtctggggttctctggcagccccgctggatggccggggacccaggggcagaagggggtgggagaagaaggtctatgcacaaggaggcactggggaactttaaccaggctatg

SEQ ID NO: 117974 - DNA, 3665 bp, Homo sapiens
ggacgtttcatcatccccagaagaaaaacttcataatccccattagcagtcactactgattctcccctccccttgcctctggcaaccaccagtctattttctatctctgggtttgcctgtgctggacatttcgcagaagctgacccataacatatggcctttcgtgtcaggcttctttcgtcccagacagctgtttgtgtatacacagttgctctgtgctgttctggggcatgggaggaggaaacatcatgagatgggcatggtctcaaggagtggccttcctgctgcagatactggggccataagcctagataccataaatgaatatgagagtcttggggatgaaacccagcagttagaacagaaactcgtggattgatttggttcttcttttctaatctggtatgacagccggaacttgaccatctcttagccacctgggctgagatttcttggtaggggtcctctcctgtccatctttatcccagttctgcttccctggcatagtttttattactacctcccccccgccatgccacccccacatactctacacaccttgtagggcccttggcatttgtattacggctgctacctttgaaggggtgggaaagagctaaggcatgtgggcatctgttgttggaggaacacgtgggagtgcggtgtcagtgcgtggctgctgttcctctttgcgggagtctctccagccacttacggaaggttgccttctgctagggacaaccctcccagggctgactgagaagtgttttggcctaggagtttcctgggacctgtcaagaaaacaaaaataatactatgtactaaactttagtctatttaattccaacatccctattacgagaaaatagactttgaatacttcatctctccttaagtcacatagctaacacttcagcccagttctgtctgtctgtgttcaaacttttgtgctgttttcacacagggaagcaagggggcaaggcttgctttcctgttgcaccacactctcttacattctttgccacccaacaatatattccacatgctggatctctgcccctttcttcaaagtaagggcctctgtgaagtggccaaggtagtcatgtctgcatggcttacgctgattatctgctgtagagtttgaaagaaattagaaatgaggccttccatagacagaatctctcgtcttctcttgcagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagtactgccttacagcttcctgtgtgaatttctgagctgttttcttttcactctagtccaggctcctctagtctttcctgcctcaaatccctggttgacctgacaaatcactgtgaaaaagctaaaggtgccagacactttacttgggcacagggctagagatgattaatacatggtggctgctgccccaccagagctcacctcagggccgtttggccacagtaaaggagtgggcgcctggttcagctccctgactcttccacattgctgctacttggtttggagcccttttttggaactcacttggaacctttcatgttcccagatgtcacgcaaggtttcctggcagtacctgtgtctcttgctgagggaagcatctggctcccattttctcatcccctctgctctgttggtggccacagaccacattccagagtagaggggtttaccctggggtggaaacctgagcctgcccagcagagg

SEQ ID NO: 117975 - DNA, 1104 bp, Homo sapiens
agttatactttgagattattgtaaacagaaggagttaacacagcttgctttggccagtgcttagctattaatacagtggtatctgtagggcctgtagtacctgccacagcctggaaagggggaccttagagcatgctagcctatgtaaactcagtattctggcccaacaacagccatcactgtgagtttcatctgtaatggctggctgcccatttctacctatactctgaataaccagagtgatactcccttctgagggttctcttgtatgacttcagaatgttccccaaactgaaagctcccgagtcaaagttcttacccattttctggcattctctgagtacaggctttctaaagcgtggggagaagtggatatgaagagctgagtactctctgggctcgagcatttagtcttatagataggtgtttgcaaggagagtacagctagaggtactattactcctgtattttgtctttataggttcttacaacattatttcctactgaccacacaaggtgatgtggccttaacattaagcatttctagccttacaaaaatacattgcatcttattgttttttttttttttttttttgaccccgtcggctaagtgcctgcatcagaattttggtggggaattcccttttaagcctcttcctgtggaactatactagaatcccagatgcttcctgtccacaggtagccagacatcagtggcttccctctgctggggaagccccattcttcacttctttccaagtagaaaatcagaactcacaggtggaggaaggaggaattttgttggaaactaaccttccagcagaggacctgaattagtcaaagtactctctcccatgcaagagggaataggaggagacttatactaggagatactaaattggaaagtaggtgaaatgacaattacatatattttaagtggctctagcctataagcttatctttctaggctctgggtccactaaatacacttgaatatatctgggagaatctcaagggagacatttgtagttattctggtaactctttagaccctggtgcattcacatcatgtaaagtgatgtgatgcggtctcacattaaacag

SEQ ID NO: 117976 - DNA, 1119 bp, Homo sapiens
ttataggtgtaccatagttcatggtttactattcccctatttaggggtacctacatggctttggtttttgctgttataaacagtgctgtattgaacatccctttgcatgccagtactcatctttgagtaattccttgggctagagaagtgggtctgcttcttggtcttggtcttggtcctttactccttggctgcacagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttggtgagcaagggatacttgctgactgaatcttttgtgggcatttctcactttcccctgggttcctgttggctggtagtaggtatacaatgcccatgtgttccttcctcctcttccctgccccagcaagcagtcaaggagaaccagaagcggcgggagacagaagaaaagatgaggcgagcaaaactagccaaggagaaggcagagaaggagcggctagagaagcagcagaagagagagcaactcatagacatgaatgcaggtgaggagtgaagacgggttgatgggctgagataggaatgttgggaagacttctctgcctagagtctagaggcagagtctcatgtctgagctcacctcctggcaaatgatttttggcagtcttcactccgagatcctgatgccggactttaaccccaattctgatacatgcgcattccaacttgccctggttaaactattaccttttctctcctttgctcgctcttgcattctctctcattcccctgtgattgtggtattgctgtgatatatactgttttccttctgtccatccaaaggttcctctggcctgttctcattccctccactaaatctttcgggtttttttctgtaaaatattttcctgacgctcctcccatcttttaattgtggcgtgtcttccctttctgcttatttcacaaagtactatgtccctagtaccttagcacagttgtatgcacaattagattttaaatggattgaacttttggagcgggtg

SEQ ID NO: 117977 - DNA, 1081 bp, Homo sapiens
aacatagactacattaacaaaaattaggcctcactgtcctggaactagacaaagaaaaagcagcattcactggaaattggaacagatttctgcccccgcctctatatttctatgtatatctccttcctcccaaaccctgttctctaaaataaatgagaccaagatctcaggggatttcatagattcatgttaaattaaatgaagtctctcttctgttcctagtactgcataccttgtgaaggctggaggttcaatgatcaaataatttatagtttcactggaaagatgaaaacttaagtatgtgacacaactaaagtacataaggaactaaaattattaagtaccagaatgtgtgtatagactgaagctatgctctgaaaggtgaaactaaggggtgttgaggctgggattattagtaagctcttgctgtctgtttttatggtttttttttttttttttttttttagtttctgctgaaaacttgcaaaagaacctagatcagatgaagaaacaaatttctgatgtggaacgtgatgttcagaatttcccagctgccacagatgaaaaagacaagtttgttgaaaaaatgaccatatcctctcttgaaaggagggagttgttccctaggaagggaaagaaaacttcctgtagtgggggaaaaacaggatagatagggcagtatgcaatttttttctcttaaaaaactctttttctttaaatacatagttttttgggtttgttagtattttgagacaggctctctctgtgtcacccaggctggagtgcagtggtgccatcacgcctcactgcagccttgacctcttggactcaaacgatccttaccccctcagcctccttggtagctgggactacaggcatgtgccaccaggccctgctaaactttttgtaacctttttttctttagagatggggtctcactttgttgcccaggctgcatagttcctgagagcattccattgttgtggagtagaagcacaccatgcagatcaaccataaaagtcccaccaactcccctgcctgtaccccgtctccactacacacgctcacacatgcttccctc

SEQ ID NO: 117978 - DNA, 1074 bp, Homo sapiens
acaatatgttgggattacagatgtaagctaccatgcccagctttcactttctgataagtaaaggtactagcttggcttcaattaaatttaaaattactttgtgatttaaaataactaaggtaaattttgtacttctcagagtaggatcagtaactccagagaagggttctgttctgaagtttccacgtatactcgtaactctttggtagcaaaatttcaaatgagaaattcctctgcaaagttgatataggtagtacttatttgatgatcaggacaaatgttaaatttttgttctttttaattactcatctacctacttcataccaagaaatatagacttaaatatttatttgacaaatatttcagggtctgctatgttataggctctattaggcatgtgttccagagatgaaagggtattttccgtaaaacccactcatagtcttgtgatgcagttattgtccctgtttatccaaatgagaaaaccaaagtttaaatgatgcgaagtgcccagatcacacagccaataagtacacatacccataagtaaagtcagtgatacaatgagaccagtaaactgtcacattattcttgattatataatcttaaattattgtcaataactattactacatagtgtctgtggtgaagtcttatggagattaaagtattgtgagtcagttcctcttcccaagagtatctctaggaacataagacatgagtaattggtttaaaaaatgatacaagaaagacaatggtgtagtacattatgatttctagtgttatgatattgatatggaaaacagaatttaagaaaagaaaattgagagtagtataggataggatggtctggaagatggaatttagtgattaaatgtctctcatgtgctaatgatacaaagctgaataagacaatagtccctgtctgcatgagccacgtatttggtaaagacagaaaggcagatgataacagtgcagattaataaatgctatgatggaggtatgctagaatgtttatgagagtactaggaagggagggatctaaatcaagtgggggcagtgttggaggggcaa

SEQ ID NO: 117979 - DNA, 1047 bp, Homo sapiens
aacatggtggaaggggactgctgaactactactaaccaactgttcttgtgaatcaagttttaatggaacacaaccatgcccattcatttatgtattgtctgtgcctgctttcatgctacagtggcagagttgaataattgagaccatatggcctgcaaagcctaaaatagttactatctggtcctttacaggcagcttgctgatccctgcaagtagataggatgtaggtaggaaagcattactgataaatattgaagaaatgaaaatgagatatttattagagttgggggaggttcagtaataaaagggtggttggttgaagaggaggttagttttgaaggaatacaatagaccattataatagagaggaagtgaggggccatttcacgctggacagtagttgcttggtaaagcacagaggtggcttacttttaatcatgcttttctaatcttttccctgctagccaagaaggatcaagaaggtggagaagaaaagaaatctgtgcaaaagaaaaaagtaaaagagttaaaggtgttggattcaaagacagcccagaatctctgtgagtatctcttggtcccaactattcaaaatgtgaaggaattcttttaagaatttttaattctcttgaatctatggtcccttgatatggaactttaattgttcaattcctgctatataccaaccattgcacagtgaattttcagtatcatgtttaatttcttcaatagcactgcaagatttttaagtatccagttttatgtcaaggaaacaagctaagacttttaggaatttgcttagacataaagctagtaagaaggaggtctgggatttgagccttttttttttttttttttttttttgagacacagtctcaccactctgttgcccatgctggggtgtaataatgcgatcacagctcactgccacctcagcttcctgggctcagttgattcttccaccccagcctcccaagtagctgagactacaggtgtgcaccaccatgctcagctaattttttgtagagatggggttttgccatgttg

SEQ ID NO: 117980 - DNA, 1045 bp, Homo sapiens
taaataaataaataaaaagaagatctctcaggttgggactgagaagatacaaagccagacttcccttcttgccagagcagagcctcttctttaggatttcccacagaggctattggtgaccaagtgaaggagcaatgccctgccaccttcagagggagaaagggctggactcttacttttctcctgacgtgataatctgttacccaaagtcttgagaaaagtttgcacactgccgtcaacggagaacatggtcatagaagtgggcctcacccgttctaagaattaaaggagagcttttaagctttgggacaactgtgtttggccactgtgtaatagctgcatccctatggtgattctagagtatcagctttttttttcccgaatactttttttacttaagtagcagctttctccctggtaagactcaatgaattaacagcacttcatggacttttacagaaagaaaaaatataatactgtgttggggccgggggggatgtggtgaaaagtcctttatggcttcaggattataatatcgctagtccttcccttgacctttttggagatactccctgagactgacttagatgcaaatgatcagatgaaagttcttgcttaatattcttctcccacttctgaaatgggtcagtgactctgactttcagcagccacagcaagcagtctattcccttgcccaagggaagggcacaggtgatagaagggaattagcagggtctggcttcttggcaaggctggcaggacactcgtagagtctggtctgtggagactagattggccccatgtctagtttggaaactatagttcccactagcaaaaggtttagaatctgctgaataggtcaggattgcagcagctagaaatacggatcctggcacggccactttttaaccacatagctaggtgtaagggtctctcttttctactattgtttgttgagagtcacagcctttgcagaaaaaattttcctcttttcctttgtgctaaggtgctatctatacccacctattttggtcccttatttcac

SEQ ID NO: 117981 - DNA, 1073 bp, Homo sapiens
atctggttcttcctttgggattctgtgtggctttgttcttgtcctttaggtttgttcattaatgccagtttgccctgtccctccttacagcttgcacatctgtaatggtctagttctgtgggattttgcagatagttgtatattttggccaaggtatcagtgatacggttacctttgggcagggataactgctattcggttggcatgatattttttccttctataatgtataccttagtgattgttttaaagtgctgaatttatcccttatgtatattacaaccatgaagaatataaatcagaagtcctccatttgggcagcttcttatattaacacttatattaacattaagaccctcttactgtctcctcttcccagaattagagagttgatgtagtgcttaatagacatggcttattgtatgctaggtgaacttggcaattccatagctatgttaccctcacagaaagttatttcctggagagattattaagtgttctgatctttcatatatgcctgagagatctaagattcttccacaaagaccctatttcttcagagaaaactatagtgatgccagagtctttttttttttttttttaacaacttgtgatttttgtgcacctgtgttgtatgtgttgccattatctcactttagggacgttggataaactggcgtatttgtgcagcctcatttaagtagtggcaaccattaatgacttgtacccacaagtttttccagataatttctgttttttccacctttcttacatgttcttttttagtcataggtacttggcttactcaagggaggtgtagcgtaagataaagataatggagggtgttccctgtagaataggtacaaatgctgcaggctttatcttgggcagagcaagtagggttttggtcctgagtaagtgagtgaggttaggtggagctgcctgtcttccagccgtgcggatacaactgactcagtccgtgttctcaacagtttttgaaaagcccatttttctatcccacttactcccacctgcagttctttaagaacgtagtttccaggatgtcaggcaac

SEQ ID NO: 117982 - DNA, 1224 bp, Homo sapiens
cctttcctggcttccacctcaggaacaaagaagggaaaaaaacagcagtatgacgaaaaccagcagctgtctctgcaggctcaggctgggggctgggagtttattccatctgttctctttgttctgctcttaccctgttacttcccttcccaaccctgaataaaacagaatatttctagaatcctttgttatggagaatggtttagaattctgcagtttactcagtatttatttaggttagcgtgggtgagatacagcagagattaaaactgatctggagcacctaaaaaaaagatgaaggtactttgccttctcattcagtcttaaattatgaatacctatttaatgtcagatttgtgacaggggattatcaactattatttccaattatcaaaacattatttccataatgcctaattggtattatctttgttttataattgagagatataaaagagaattaatatgtcctttgcttgttaagattttatagcaagtaaacaccaagccagaatttgagcctagatatattgggctcaaatccagcacttagtgaaagggagtggcaagaatgcaggcatgttgagagaaacctcaggtgcttgcttccagtgactgacagtgtaaagtaactgtgctagtgcttcttgatttttaccagtgattagtgtcctgatttcttcaacaaataaatttcaggggaaaaaatgagatggagaggaacatatagattaagagggaattttaaattttatcaaccagtacagtatatggaacttatttagatcttgatccaaatgaactatacaaaacacttgacagttgagacagctggaaattagtgtgataatggtttcatggcattttttaaaaagtcatcatcttttagagatgtgtacagaaataattgcggatcattatgggatttagaagtggggtgtagatgaaacagaattggtcacgagtggataactgttgaaactgagtgatgtatgcatggggattaataattgtgtttttgaatgtttaatttttcccataataaaacattttttaatccaggaaaagagttttatttctagtaccttattttaatgccttttcttctgccctctagcctattgtttccttgcataaacctgtcctctttgctgacatacctgagtccttgtttgggatagtgcctgtccttccagtccttccccacccacatcctagaagcag

SEQ ID NO: 117983 - DNA, 1054 bp, Homo sapiens
gctcaaagagaggtttgtattttatcagcttggtagctcattgtagcctcattatatacacactcataatcccatctctgtctcagtttctgctgaaaaactactttaagcgcataatagaacctacccacattatatatggataactagcttgagataacatactgaatccatttcttcagggaattcccctggtctaacttggatagaatatgctggtgcagaaagattttcacggtcaaagtcaaccctttgtgtcatatgttaactcctaattatccccagctagtctcatttttagagcctctttctagccatcccagctttagtgtgtgcctgtattactcttttctagaaacatatagactgaaatggtatcttttaagtccaaggtaccatctgccattatctgtggattccagattttatttctaaccaaatgtccttttaaatgtcattgtctgagacttagaccatctagttggggggtcagtattacttaaacttctaacatcttggtacagtcagttcctagccttaaatgtctgttgataccagtaaatctcaaactttagtataaggattacatgaggagcatgtttgtaacatgtaacatgtttacatgttaatggtgtgaattaagccactcttcacctgttctcttaataatattttggtatctgtatctgaataggtattatataagtattatccctgttcttatggaggtcatatgagattgattaggaaacaattcaacattttctgttgacttggcagtcaattttggagtcactgtttcagaggcacttttcttgccatcttccaaacttctcagtagccatcttagaaggacattttgaagaagtcctctgtggtcagtgaactagctcggaaccacttagagattgactctgctggagaggatggatggagggcagagtgattagggcagagtattgtgctggactggggcttgtacaacacggaaggagttgtgagaaactggaggagatagaaatcaagatgaagaatgttacagttatacagacat

SEQ ID NO: 117984 - DNA, 1053 bp, Homo sapiens
actcttctatactccaatactacctctgacttaattcttaggaatttttatacgaaaaggtcatgatcctaccaatattctggcctttcagttccttgaattcttctactgattttgtcctctatcctacctcaaccattcccccgttctaggatctcatgtcataccacccaggttctatctttttaccttactccctttgctatcctgaccccaacaggcctccagccccgctaatccatttgtcctaccagcatttcactgtccttcactttctgatgacttcactctttccctgagctaaaatttcttggttaatcattataatcattcgcttgggttttgttcttccattatctctctcatttcatactcgattggcaaaaccacaatcccggttaattccttttctgtctttgtcctgctcctgtagctgtgcaactgaacatggctggagaataccacaaaactgggccctcctttgacagactttcttctcttagctttcaggacaggaaacacttacttttcctgctaactcactggctgatctttctcccaactctcctctgcttaatttgtgaagttgcttggcccttgatactgccaggcactcatatttgaagcattacaaattcattgaatttcctgctctcctaaaggttatttcacacctttttttcctcctcaacagcccaaacctccctcatcctcattctcagttggggatgttttctttctacttcactgacaaaattgaagcaatcagaaaaaggaacttctaaagacttccatcattacttttacctagcagaattctgtcttcctctgttaccatggtcctgtctaaagccagttcctggactaatttgttatcatcattttaacaaatatgtagaatacactggaaatacagggtaaaaaggtgtcctcccccagagtgactgtggttaaatcatactttttatatacatatgttattctaataaaggaatgggaaaatccttttcttctttagttcaagtgagaaaggtaaatttttgaataaaactt

SEQ ID NO: 117985 - DNA, 1047 bp, Homo sapiens
atactgaattgaatattgaaccagttcagtttgaatgctgaagccagtgtcagttaccaagtctctcattcatagtcttgatattgatgatataattaaatgatagataactactcattatcaaccttgtaaatatttcatcttccagatgaagtagtgacatagattagataactttttccaaactgtataaaaagtgtcagaattcagactccaaacagtgactccaaagtccttgctctagccttctacttcttaggaagtgtgtatgtacttgccctaagagcctctgaaagcttagatccagacaaaagctgcaagaaaggggatatgccgccttcaggaaccacttcattcattcagacgcaaatgtccttgaattggcagtgactgagtagaaaaaagggaacaataatagattaaaaaaagtaagtgagatactagatatttagggttataaaagagaaggcatattctgactgtattcaactctagcaaaactaatccagttgaagaaataagacatgtttatctagtagaagcactgcttaggtgatttcagtccaggtggttgccagtattgatgaagaagttatttggacactgggttttcatcatattgcattatttcctctcttgcttgctaaacacaactctgctatttgttaagcatgcctgtatcccccttatgttttattgatacctaaaaccttcggtatacctactggcccctccaagaatgggcattgaagaaagcacctgcctcactctgcacatttgcctcctgtagtgaaaagtctcctgttacacatattctgaagcagaatatgtgtgcctttttacaagagaagagctgagagacaggaactggtcctagaatattatactccagattcttttacacattatttctcttttaaggattagtgtcttgtttctgaaggctttgtttcccataaatgaggtatttacttactcagttaacttattccctgccagagaatattttgaatttacttttgataggcagtgccataaaacttctgg

SEQ ID NO: 117986 - DNA, 1634 bp, Homo sapiens
acataggccatatttgcatgcacagtattgttcccatgatgtgtttgagatgcctgtgattctgagtgagttagcctttttcttctagaaaccaagttaatataaaggaccttagggatttgctcataaaatgagcaaatttggcacagttagccaaactggtgggagaaatttaatgatgagcaagacttctctgaaataaagccttaatggttatgaagctagaggatttggagttaggaggaggatacgtagtatatatatgaatctagttcttgaataatcaccaattaacagatgaactggaagtattctctcctaatcccactgcagctattctgtgcctcaagttagtcttattctagtaagacattgctgataatcagccagccacctattttacagcctcatccgttttctaggacggaaagtacagggctcagtttactaattcttaacaccctgcctttatccacagcttgtggctgaggacctctcccaggactgcttctggacaaaggtgaaggaggaccgctttgagaacaatgaacttttcgccaaacttacccttaccttctctgcccagaccaagagtgagtaccttcctctttgatgcaaaggtccagtgtagggcttagaatattttttcattaggtttcctattcccttcccttccctgggtgaagatagaaagggtatgttggatggaagactgatggattttcccattcaaaagaaagaaaagatgtttttgtattaaatattatggagttacttggtttgggaaagagaactgttgtatgtaggtattttgtatcagtataacttgttagggatatgagattaaagtgacagagcttgatttgggcccattttgatacttttgaacagattctggcactgccttaaggtgcagtttccagttctaagtacataattaataagggttggaaagagtctttaacagtttgggtgactgagtgactgtctacagtaacaagaaccatatgtgattccttttcttccttccatttctttccaatattggatgccttctccctcctggcactttgctcctgaagcttccaaaggtaagaatacaaaagagccttttagtttggtctcttgaatattagagaaaaagatgaaatagatataaaggaatttctcattagaaaactgagaccagagattgagggttgacttgtctttgctaggtgttttttgtttttgtttcctcccctggagttcaaaatgaccaatagctttggcattaactaatagggaggaaagtttgcttcccgttaaactaccacatacttaatctctttagaaggtgagggacaacgtaagcaataatactattaccttacatttgtgctgttttacaattttcatagtgccttaacatatatgaccctatttgatatgcagagaagccttatgagacaggcaggatgtgtatcatctccattctgtagcatatatagactctgaacagttaggtagctttcccaaggttatgtgatcagaaccaggagtcttgacttctggtccattttttctatataaattcttgattttcttttttagccttcatatggttccttttattttacaagagctgatctact

SEQ ID NO: 117987 - DNA, 1606 bp, Homo sapiens
cgatctcggctcactgcaacctctgtctcctgggttcaagcagttctcctgcctcagcctcccaagtagctgggattacaggtgcccaccaccatgcccggctaatttttgtatttttggtagaggctagggttcaccatgttggacaggttggtctcgaacttctgacctcaggtgatccacctgcctcggcctcccgaagtgctgggattacaggtgtgagccactccgcccagccaaaccttgattttaaggtcagaatcatggtgcttttttcccccgagcatggcctggatttatgagctctgtaaatcaagtactggcccagaacaggaggcagtggggggattccagcacccccaggcaaaagaggaggtagggagaattatgggtaataatacttgtgcttcttactgagatggagagcttgctgggagcctgattcgttttttctctagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggtaatgcctgagcagggaaggcagaatgacctgtaacctcaggatgcacatggcttggaacaggagtcagtcatctcgctcctagggagggttcagctactaataggtaatctagttacatggtgcatattttaaaaataatatactggtttttggtttgtgttgggggtaagtaatacataagacagaaaatctggaaaatacagaaaaacattaagaataaagtaagtttcattaccacccagaaataaaagtaataagtctcctaataaattaggaataaaaactaaactgttaaaaattgactaatttcctgttattttagtcacctctgcacagatttatccttacacactctctctgcagtagtaaatacttaaatgatctttgatgtctgataacttgattacttatgtggttatataatcatctgtgtagcacatatattagttatataactagaacatttaatttacttgacctttacattttctaatcaagggagggtttaacataaaggttgaaattgtcttcttaatacaaagcatgctgaactaagaacatgaaaacctgaattctagttttggctctgctgccaagccgtgtgactttaggtgatcatgtcatctctctgactcctctcagttcctccatttgtaacatgagaagtttggattaagtagtttattaggttccttccagtcccagtagtccctgaagtggggtgagaagtactcacattgatgttatttctgtaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcct

SEQ ID NO: 117988 - DNA, 2025 bp, Homo sapiens
tttttaaagcagatttcactatctgttctaggtgatcatttttacaaatgatactgcagtgaacatccttgtgcatatcttctttcacatttatgcccatatgttggatacatttctagaagtagactatatgttacatgcatgagaaattgattagtactgttaaatgcccctccaaaagttgtatcaatttatacttcattgaataggggacttgatttggtatttatggacaggagcctagggatggattgtagggaatgcatttccctgaagagatggtccttagctttcagcagtttctggaaactgagtggtgagaataataatgtgagaaatccggaacactgataatgtcctgtttcctaatcggtctgtgcccctgtgtaatttactcattatacgtgtccgtgtcacagtacctggaaagttctctccgtttcctttctcttgggcaggaatgaaagggttttggaggcaatgacagaaagagctgagatggatgaagtggaacgtttccagccgctgctggatggattaaaaagtggaaccactattgcactgaaggcatgtatatcccctgaaactgggcccaagaatagaattcaagatggacagacttaaattcatttgaccttttaataaaatacatggagtgcctcccaactatatattttacatttcagaatctgttatgaagggaaaatgattaaccttctttctaagaaggtaaagaatgaactgttttcctcattatgagatggaaaaaggcatgatatctatttacaatctaggaaaaccaagacctacaataacatatactctcaaatccttgaaaccatttagagtttaggctctccggatctgtactcaaaccaggtctcattgctatagtagaaaagtcatctttagagtttttgtattgtatctttcaggttgtattggggacctaagaatgcatgtaaagaaaatggattcttgatctccaggagttagcattgacatagctgctgaattttcttattttaggttggatgcctacagctgatcaatgctctcatcacaccagcggaggaacttgacttccgagttcacatcagaagtgaactgatgcgtttggggctacatcaggtgttgcaggtaagatattacacttcattagaaaggctagactggttccttcttgctctacagccccaataatcccggggataattctggttttcaattaaaaaccaggttgaaaagcttaggtttctaaccacagaggatacttttgggttccctgacttctacttttgttgttgacaggaccttcgagagattgaaaatgaagatatgagagtgcaactaaatgtgtttgatgaacaaggggaagaggattcctatgacctgaagggacggctggatgacattcgcatggagatggaatatccttttgctgactaggttcaaggcagatgagacattcattgtatttagttccctgatccctgtgtggaatggtttgggagatgatgactcagaacagagcatcaggcttatgtgtcttctcattaaataaggcaggtgtatttttattgcgctggctttacttagcttatcatagatcagggaagtcagtaaaggtgatctgagggttgttgagcatggaagccatcaaaatcagtgtaaacttcctagaatgtgatagcttagcttactaagatgtagaactggcttttagagatgtttggactgacagagggagtaatttagttacctgttaatattttcagtaagtgactttgaggcagttacctcttattttctgtctactgcctgatcttcaagccaagtacttactaggaatcctctgtgtgtatagtaccacccaattcactggtcccttaaaggacgttttagaaagcttaaagtttctggtgatgtttacaggaagaacagccagtagaatggaagtggtgtcttgctacttttccctagctttttcaagagttaaataagccacctgtcaaacataatttc

SEQ ID NO: 117989 - DNA, 1043 bp, Homo sapiens
ttcttcgtgggaaaggagtttgtacagggactgagttaaccaggggtaatgggtttgtaggccctagagttggtgcagagtttgttgctgttgattttgcttgtgtttagattatgccattcatccagtgcttcagtctgaagagatttttaaggtccatccttgatgcagaaagcattgtgtgtggttttctttcaataatacaaaataaatctttcatttatattgagtccatttttcttagagaaaaaaagtgtgtatatgtctatagagatttatactaaaatgttaactatacttatctttgaggaattttcatcagctgtaatagcttaaatttctagggatcaaaaagatttatttacttaagcattttacatgctcaactcttcactaagcatactaatattaaacactaaaaatttgtaaagaatttgaggcaattttgttttttctcttttttctccctctcctagctggatatgaacctgaatgaggagaaacagcaacctttgagggagaaggacatcatcatcaagagggagatggtgtcccaatacttgtacacctccaaggctgtgagtcctgggacaggtacccatgacatgggagactgtgcccttgtcttggacctgttttttttttgccaattttatgtaacattttatgtctgcatcaattctgtttcattccattatataagcctgttcactttttactgtcttatttagttaccgttcttacatacattttgcctggttaaattttcatgaagtatgtaaatatagggaatgggataggcagttctaagtctcatttatgttggtggtatgtgagatgggtatctgccctgataaacgtggcctgacatggtggcttactcctgtaatctgagcactttgggaggctgaggcagaaggatcacttgagcccaggagtttgaaatcagcctgggcaacgtagtaagaccttgtctctgctaaaaataaaaaataaaaataaagtataaactctattgactaatactagtccttaatttatga

SEQ ID NO: 117990 - DNA, 1050 bp, Homo sapiens
tatttggcttgtatctattaaaatctgtagtaatacctcttgaagggagacatcctctggggtcctagcaacatttattgttgggtagctagaaggaaacaaagggcattttattgatagaactctgtcatgagaggctttcagttccgtactactacaaggcttagaaatggcaggggagatcaagaacaatgtttcttctagtttaaagaggtttgaaatcttaatactttggtcctcttatctttgaacatagatgagagtacagagtcagtatggtaagttagataggaggaagactgatttcttcttttcatgtcagaagagtcttgaactgcttgtgaaccagaggaaccatgcctgtgtaagaggttaaaggggtaaagaatttgatgtgtggcttgttatgtaagtgaaaatggatcactgctaatgcttttttctgtttctcagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctggtaagtttcccattcccaaaatgttgcttcttcctgtgcatttatggacatggtgggctctttttggtgcataattcccaactagccctttattacaaagaattccaggcttaacatggaactttttaatattaaccctttaatcccataattagggactaaatatacaaataccagttcataaaattggaatctgtgcttggaaacatccgatcactgtcttgttcatggtcttctgcccagcaacactttagccacaaagacgtagtggaccatctaaccctgtgtaccagagttggtaatatggagaccacctttgggttaagccagagcagataaagtgtggaggtattcacaacaaactctgtataaaggagaaactgaggatggaatatcatttgctcaaggtcctgtatagtggtgaatctggaaagaaaatac

SEQ ID NO: 117991 - DNA, 1039 bp, Homo sapiens
acttccaaccttctgtctcaaggggaaaggccaggctgctggggctctaagagactagagggggaaaagtgctgagtgtctcagtatatactatgcctaggtttacttttctttttagtatagggaccctggcatcctccaatccagagaccctccgttttaccctcttctgagaacaaacttccagacctctgctggaagaagggagggtagtttcccaatggcatggttgaggggtggggtatgatctagggatctaactgcttcttaaacagcttccaaccagtcttatttttagcctccccctcctttaactcccatttccataggtatctggtgccaattattcctaagccttttgaggatccttaaagtgtaatgggttggttattgctctttccggtttaggactcagctttctgtaatgtgttggatttaatacctctagttcttctagtcccagtcttcaaaatttgcagttgctcttttgttcttcccaaccttgtaggctctttccttgcatcacttcttactttctaaaaaacaccttttctgtaggtttagtgaggtttcaagaaggagagaaattagatgttttggttcagtctgacatcttttacctgaaagttcctattaatctggattcctaagccagatttggatattttaaaaaaattcattctgtatttatgcttccttcagtatctatatttgtagttaaaggtataagtgctaatgtttagtggaggactcaatagaagggccaggaagtgagatatttaccacagccagcctaggacagtaagggtttggtttgggaccagaagagaattgacagcaaacaaggagaatgatgaaagtggatgcatttagatgtaggtaggatgattagagacttaattttaagaatcttggatatctgagacctaatacataaataaagctccagtagcatttatctccctggactcctgtgtttttgttgttgttgttgttgttgttgttgttgttgttaacttgtcatgatctaggaacttat

SEQ ID NO: 117992 - DNA, 1681 bp, Homo sapiens
atgttttgatatatgtatacattgtggaactaatgagtttaactctccagtgcttagtttagctgtggggctgctgaggcactctgaaccaaatggaggagctgctacagtcttacctaatccttcagcactttttcctcagtggtcatggagaacatgagcctatcatttccatttctggggactgctaggtaatcttcagccttctttcccttaaacacatttagcttttctaggtttatagtttatatttttaaattcctggtcattttgtgcccctcttctagacttcctttcctctgaggtaccctttttctttcctttattttctttttgaagtgggtactccaactctacacaacgcctgtgtaggctgcaggcaccaataagtggtgatgtcagaatctagtttgtttctctgtaaatgctagatgaaatgttgattcaattgctgttgtctttgggccattccttgaaaatggaagggaaagttcttctgtgcatttaaagttgtccattatttcattttctttagttctgactgacttctgtttaaggagtgggaattgaagaagggaaactagccagtttcagtggttccatcatatattatttaacttttacaaagtactttgcaaaacaaagtgctttatatctgttttattatttattcttcatactagtcctctgagacaacagaaccctagagataggaagactgaaactgtggtcgatttttaaaagcttaccctgactttacattcctttagtggaaatgtgataaattttgtggcaaaggccaggcgtggtggctcacgcttgtaatcccagcactttgggaggccaaggcaggtggatcacgaggtcaggagttcaagaccatcctggctaatacggtgaaaccccgtctctactaaatatacaaaaaattagccgagtgaggtgatgggcgcctgtagttccagctactcgggaggctgagacaggagaatggtctgaacgcaggggcgtagcttgcagtgagccaagattgcgccactgcactccagcataggcaacagagtgagacttcgtctcaaaaaaaaaaatttttttttgtggcaaagctagatcaggcctcaatggtaactgaattcaagatcctattatgaccctctgttgcctcagtaccctaaggaactgtgtcaatcctgaataaagaaattaatcagagctggacccttatctctctgttctgcatgattctaagtgacatatgccttaccttacctgttctttctgggtaggtagattaggatatgaaaggaaattatttttggctgtagtgatacttatttcccattttacccataggtagactttgtcattattgagggcttattgtcctgtgggctccagtcaaggttccttggtctcattcataaggaaagacattactcttgaaggtttgatttactgagctattcgtaacaatcatagtgtactgtcatataccttgaattgaaacttttccttacttttctcaatttgaatagagtaatgaaagaataaatatactgtttcggatgatgctcctaaacctgtagtgatgctaattttaaaatttatttattaaaatgtgggccacatcagttgaataagacatgattttgccctcatgcaatttagtctggttcacaga

SEQ ID NO: 117993 - DNA, 3890 bp, Homo sapiens
attttaaatttgacgtttggtattcttaaagacctctgtttgtgctcctgaaatttgactgttgtaatgattgcaaatggctaataaccaggatctcttctgagtctgggaactgctgaagtttgttctttagacctggcagttatttgccagtggttaataattaagacattgccacagaggtccaagtacctggaactgggatttgtttctggtgactagtggtgaggagtagggaagagtttctgttgatttcctgagtctacatgtatctactctagatccaaagactgaccaagaagtcatgagactgtcctatcaggttcagttcttgctctttaagaaattgtaatttcaaccacgtctataaaagagggatagaaaaagctctaaggctgtgatcttagactttaaatgctgtagaaattcatagaagtgagggaattaagtggaaaggctattggactgacagaaggcctaagtttcaaaatcttagaatgctggagtcaaaaggatgctaagaattatctaattcaacccctttattttttattttttaagagtcagagtcttactctgttgcccaggctggagcgcagtggtgcagtcatggcccactgcagcctggaactcctgggctcaagcagtcctcccacctcagcctccagagtagctgggatacaggcacaggccaccgggcccagctatcaacccctttactttatagattaagaaatgttgactagacaagtgatctgtccaaatttaaaactagaaatagaacctttatctcccaccctgtctgaattattctttccatatgtagctgcttagttgtgtctttaccactaattaaccatgtgaactctaagcaagttattttacttttcttcatctttttatcttttgtaaaattagggggttattatgaatcatttctaacatctctgctaatgccccagatactgtaaatgacccagaatgtaattgcgggcagtgttaacttagcttcctagaagatgggggatatgactgggccttgaataaaatccaagatttggcagagtagagagggaaagaattcatgagatggggagcagtagaacaaaggcttaggtgtgaatatgtggctgtagtaaagagaaatggcctgattatagcaattatatgaggtttagtagaaccatttaagaaaggtaaagccacttcatagaaattattttatccctggtaagggctttaaggttccctttctataaaaacctgcagaaagcaggattgaaatttaacattttgtaacaggttgtaatacatgttgatgtccgtttttggccatgtgataagtggtggtgacagtaagtacattggaatatccaagaaggaatagtgttaaggtcagttttcagcaagttatttccgctacgtagatggagtttaaaaagttaagtttatttgattttcagtccttaccaattttaatacatcgatctttttagactttcagaaattagattttaaaaggcgtgactcttcagctggatctcaaggatgtataagaaaattatgggctcagataggtaatgccattgttgaaacaatctgagtctatctttgggccctgttgtttcttctaaatgttctttaatacagtacgatttagcttttgattgcatacttatttgaagtattcttctgtctttcttgaatgcaaaaatatatgtttatatcttattttggggtcttatctcccatctagattgtaaggtttctaagagtagtggtagtatttagctcatgttagttaatatcctttatgtattttatattttagttttaatgttaaccttgggaatctttttcttttttctcatcttaaggtttgcttcctttttttttttttttaatagccttgggaatcttgattattttcaaggctctctgtttctgtgatctaatataggagactgacagttttgaaaacattaattctctctcaccaaagtaactatggggcagagagaatcactaatgtaactatatgtgaccagaagaactctgttgagaagagattattattcatctctggagagatagttttgacttgtgtttaatgaaagaacatgtctgtaggattaaaaaaaactcttatgttattttacatagtgtaaggctatcaacttttattattaaaaatgaaagcaggcactttgggaggccgaggtgggcagatcacctgaggccaggagttcaagaccagcctggccaacatggtgaaaccccgtctctactaaaaatacaaaaattatccaggcgtggtggtgcccagttgtagtcccagctacccgggaggccgaggcaggagaattgcttgaacccaggaggtggaggttgctgtgagtcgagattgtgccattgcactccagcctgggcgacagagcgagactctgtctcaaaataaataaataaataaaaatgaaagcaggatttgactcagtgcccttagggattgttacatacatttaaagtgaataattgctaagttcccatattatttgaatctattaatatgatctttaatggctacagaaaggtttacattgagtattaaatgaagagaacaaggaagagttttcaagtcctcagggtatgtctggatatccacaaaaagtactagtggcagtaggagtgcaccatttttttcataagcacatatactcccacccagagctataagaattccttcagttccttcatttggcaatagaagcaaaatagttttggactattctaaaattatttcattttgcatggggcctagagggatatttttagttttcttagtttttgtgaaagatgtgtgtcaggcttagaggtctctagtgatttctttcttgattcttgtatttttaaaagatgggagttggtcttagttggcagctctttgcatccgccagggctgttcgttacttacttctaggtctgtgggtgacgtctgtttcctgtgattgaaaccgcaagaagaagtggtgagaagccactgtaggatatgtattatcaggcaagcagcaggcattgggctgccctcaaaaagagcagtagtacctaagtatagtctttaaggagtcggaagagaccctagaaatgatctgacccagcctcttaaaattaggaggacactgaggcctagtggtattaagttgctcaaagtcgtgtaattagatgacctaggttttagactccactaatattcttctcagtattctttctcacattgcattgtcatacctaaactttgtaactgtgccttgtcaggagtgtttccttaagcaaaataccactggagaagagtaaatactgataggcattttgcctatggtaattggatgatgatgttttgcttttagatgatgtgctaatgattttttgtgtgtgctttttttttgaaaacacatatatatttttgaaacaatacgtaagaaccctaaatttctatttttcatttttattttacagtctttgtatattttagtcattatctctatgcacaaatatttttacaacattgcctttatagtttacagatgttttttgcttttaaaatagtgtcataaaaattttccagctttctaatctttgaaaattgccaccttaatttgaaatggaaatgtatgtgtattctaaaagtgatagtttttttctaagaaaatacaaatgtatataaaaagagtaaaacagtcccatactttgtttttcagaaattaattttttttaatggttagaaccaaagagaacagtacatgatatatggaagtttctttagatcctaagtactttggcatgaaattctgtgtgtgtttgtgttagaacatagttcaacacaagtacaattg

SEQ ID NO: 117994 - DNA, 1304 bp, Homo sapiens
agagcgagactccaactcagaaaaaaaagaaagaaagaaagaaagaaatggggtctcactatgttgcccaggctggtctcgaactcctagcgtcaagtgatcctcctgccttggcctcccaaagccctgtgattacaagtgtgagccactgtgctcggcttctctcttttcttctagaacttgtatagatttagcttttaaatttccctcttttctatcatgcatatgtgagttccacatgttcactttgggatataaattgtcacctgtggtcaacagagaacatttctgatactctgaggatttcgggactttcattccatttatcgtggaagcatttttttcttgttaggtggtggtgttagcaaccttttgttttcctgtattcagtatactacagattgtgtaatgccagtcttcctgtttctaaatattaatgaatgtttagcatctttatagataaggaaaattaattcattccagactaggatagggaataacaacagtagcagtaataaaagcagttgtttgttgcatacttaactgtatccctagtgcagtgctaaagagccttagatttattatctcattaatctctacattgaccttataaaataggtactgttattattcccattttataggtaatgaaactggaactcagatcaagcagcctgcttgaagacatagaactagttagtgacagagctaggattcaaacctaggcctagctgattcaaaactcatggacttactcactacattgtactgacagtttatgtgtgtccagtttttgtgcctgcagtgtaaaactggactgcagtgtaactattcactgctaggaatttcttagaaaattttggtggtattcccttagagttctttggtcatctacagtctattaaaatgaactggattctcctagagttcagttggcaggaaaaaagtactaggcttagatgtaaaaagcgtagtggctaaatgcctgtttttttttttttttttttgcatttagtaatttagactttgaagccattggaagaatcttaattaaaccttttttaggcatgaaaaaatagctattacagtgcttgcaaaacctatctttcgcttggctcatgcgttattaggatgatgcttaaattattattttttaatgtaactgtgtctcctttgtaagtagaacagctctaacatcatcacctgtcaggagttttagttgtttaaattgctgagagccacaagtagtggtaacaatgttacaggaagggggaagctgttactagactgtctctatagttatc

SEQ ID NO: 117995 - DNA, 1981 bp, Homo sapiens
ttacactagtgtatctttctactaaacaaatggcttgtaactcttagtcccacctcccaacattttgacccagctccacaaatttgggaagaaaactgataaagcgatggaaacaggaagaaaatgttgttttatgacctagagggttgagatgttaaccctggagggttagatgtttaattctaaatagaattaaaatagtgactcatctcttcctatttctagcaagaccaagtgctcctggactgccctttccagtgatatctgagatgtcagtaaccatctgtttttatctggtgaacatctttttttccccccctagaaatataaggttaagggtattgacaccccctccttctttggtgactaaagcagcatttttgtatgtttctttaggataagaattgacccctcccccccgttagctttccttccaaaacttaagttctagggctcatattccttctatttctgtatctttttgttttgattttatttccatgagtactgtttgaccttcctcacccaaattccagctattgctgctgacttgtggtgacctcagtgacttgttttcatgtcttgagtagaattttatatgtactctattttatctaacaattatttcacgaacttgtgaagtctactatgtgtgtggtactgtaaggtgagaaacctgaggaagctcaaccccttttcacctgtcttttggaatgtccatgaagtcttctatatgtttaatggatttggctcagggttgtaggtatttgctttagagaggatggagctgaaccaagttctcttttctttctgcggtgttagtcttaacccttaatctgctgaatttttaaaactaaatagctcaagtaatgaggaaaattgcattagtagctacggaattggaaggtttctaggaaagtagtgctgcttaacccttttattgccaaatgtaacctatctcaaggcatcagaatattctttcttcctcttgctccttttatgagaactctgtggaaatgagagatgaggaggagcattgcaatccacttctctttgtgtctgtgtatgtatacgtgggtgggtggagtgggcgagattgctggtgtgcttttgatacccgtggcttagttttcttgaactataggctaaaactgaactcaaaggtctttcgccgcctccaccttttctagagtatgtgtcctctggaactccattaagaatgtactgtataaaactgcactggtttggactaagtgtgcccgaaggttgtttgcatttgagggtttataattcctttagctgctacatacctttcctggcttatgcaggttctaaatacggattaactggtgagaacacagagctcacaaattgtctgagatctgctcttaccctctgaggcatcttgtgtggaaaggagatggaccctcagtttaaaagtggttgggcatcatcttttaaaaacacatgattgttagacgtgctgacagtgagtggctgaagccaggctgcctggtattaccccttggttcttcatgagtctgtcttctcctgggccatgagcataccccttctccggcattattccatttcctttcacaagtccttaagatgaaggaaaataaaaattttaggtgaacagagggttttctgacttttcagcagtgatcaatgtgggtgtcaaatagactgatttccaaaatatacgtaaggggaataagtagaaccgggatgttaggaggctgcagagtattcttacatttaatagactttgtatgcactctcatataatcgagaaagtgatgcattgtaagagagaatattgcttcctgatttaactaggagcattagcgagaattttttttttctttttttgagatggagtctcgctctgttgcccaggctggagtgcagtggtgcaatctcagctcactgcaagctccgcctcccgggttcatgccattcttctgcctcagcctcc

SEQ ID NO: 117996 - DNA, 1024 bp, Homo sapiens
gcgatttttggtctgggatgtgagagggtccaggctgtcaggctgtacagccacgtgggcgctgcgtgggagccagaggcctgcgctgctccaaccgccagggggcggtgctctccgccgcggccgcggagagctgcaccgcccactcaccacccccccccacgtgggtccgaatggttaggtccgctgggcaggtagcgcgcttccgcggcttccctccgcccctctcccttcccccattggtaggggctgcgggtccgggcggaagtggggcaggcgggcgggagcgaggcgtcgtcgttgtatattcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttgtgagtgtccctcccatcccgctcctgcctggccccgtaaccgccctctggacccctgcagccggcccctggggcgcctgcccggctttggggagccgcccccgcgccttccttcctcgtttcgctcggtccgcagctctgcagcccgacatcctctcccttcgggacctcgggaagccccggaatcccacccggctcttgccccggccacctcggggcttccctcgttccccagcccttacattctgccctcccgcccgcatatccccggccggctctcagccccgtctctcccctctcagcctcacttcctttcttcttcctccagtacccgaacacgcctcctcttttttggtcccctcttctgggtccattttctcttcttaaccttacaccttttttggtattctcgtatttccttctcctaaaggtcacttccttctccatgattcatcctttt

SEQ ID NO: 117997 - DNA, 1012 bp, Homo sapiens
ttctcaacggggcctgagaaatggctttggaaaagggtgctgggagaagattagaacttagagtgagatcctgacctctctccccttgctttgcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtacctttcgcctttctaggaatgttaattcttgctagtttcctatttatgaaaggagagggaaatgggcatgatgatgcatgtaataaaagcatagttaacattcattcagcacttatcctacgttaggccctgtgtatgtattctacatttattattgtaaatataagaagttaatagaggattttggttaagagttagacaaacctgggcagatttgagaggagtagaagatgacttcaggtttttgaatctgggtgtt

SEQ ID NO: 117998 - DNA, 1051 bp, Homo sapiens
ctgacctccctgagccacactgagctggaagccgcagaggtcatcctggagcatgcccaccgcggggagcagacaacctcccaggtgagggctgtggcctctaagagcttccccggggatcctttttacccttccctcccaatgcagccctctttgcttcacacattgtcctttttcttccaagaagtgctagggacagggttggagagtgagtcagtgaatgagtgactttgacttttcccaacccctaggtaagctgggagcaagacctgaagctgtttcttcaggagcctggtgtattttcccccaccccacctcagcagtttcagccagcagggactgatcaggtgagatcttcctgcttgttggaaccaggccacatataaaggcgattatgatttaggcctcctccattatctttgttttgtgttaacttagtgagtgtacaccgtggagagggggtttcagaactccagctcacctccctcccaacaggacacacacaaaaaaacacacctcagtccacctttcagtcacttgactgcgccatccttttcattctacctctgtcccttgacctggatcccatttctgaagctctgtatctctgtgtccacattacctgtgtccatgactgtaggcatgtgcccctttctctttgtccttgtccttggaggtcaagatagagtggaaaaaggagggaactggagagaaggagcagcctcaggtcctcctcacagcaccccctgacccattcaggtgtgtgtcctggagtggggagcagaaggcgtggctggcaagagtggcctggagaaagaggttcagcgcttgaccagccgagctgcccgtgactacaagatccagaaccatgggcatcgggtgaggtgggggggcacaggtgtcatgtgcaccttcttgtctcagcaagaagagctgagagaggggatcttggagccattgagggtgtcatggagctacagaggggagggaaaggtattttaaggtaacagtgtggcacaatagttaagagcacagtttttggagctagacc

SEQ ID NO: 117999 - DNA, 1035 bp, Homo sapiens
caagtcaccaaagctgggcctgactctgatctcatattctcccacttggggtgggcctgactcctttctctcatctgcacaggctaaaccgaagtgaccatgggatcttccactctcggaccagtctccagaaactgagcaccaaggttcgagggatgagggcatgagtgggggcagggaagagggaggcagagtagtctagtggtttggaacataggtgcatatgtatgaaagactgggttgaatccaggctctcctacttcctgggtgggtaaccttggttaatttacttgatctctgtgagccttattttcttctataaaatggagagaatacccttctttttcagtcctttaatatgcatttattgaggatctgtatataataggcactgttctagacattatggatacagtggagaacactaccaatggagttcctgccctcacagtctggttaagagagacagacagcaaataaatacttagattaagatgaaaataaaacaaggtactatgataaagaataacaagggggtagaatttagagggaggcctctctgaataggtggcctaactgtcaagaaggagctggccttgcaaagatctaggggaagaacattgcagagagaagaaatggtgagtgcaaagggtctgaggtgggaataactttgtaggctcgaggaactgagagagggccagtatggctggagtactgtgagcaagggaacaagcgcttgaaaagaggtcagagagattgcgggggccagctcatattgaacgtggtggaccatggtaaggaacagtggattttattttaaatgcgtgcagaaggcactagaagattttgagcaggagttgtgtgtatgcaacatttttagtgtagtgccaggcacatagtaagcactcaataatgtgagaatccattctggatctggcttctcaattggtcttggaaggactctgggggtctagggcttcctattgacatcagtttaccctcctagctgtccgcccagtcagcccagtactccca

SEQ ID NO: 118000 - DNA, 1043 bp, Homo sapiens
ctgtaaatataccattaaaaggatacacttgtttagagtaagaacatgcacattggggaggggacttaaatttttcttcactctgttcataaatgatgatgaaaatgccaaaagtattgattttggggttacaaataacttttagcaagtaggagaatgtgcagatatggaatccacagataataagggtggactataaagtgatttcagagagtgctatttaaaaataaaagtggtgaggagatacagtgtgatgggggttgtacttgtgacagtgaggtcagggaaggactttctgaggatgaggactccagcagagacctgagaatcaagaacatggaggcatagatctcctcctctctgaatcccatgcccccatcagccacataccacatagggaggccacagatgggccgtggtgggtggtggtagcctttgcaccatggtgagcagagacggctggctctcctcagggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctggtattcctaagatccctgagagccaaggcccaaccaggatctctgccttcccccaccagaatccatggtttggcagccctccgccccatcacttcccaccctgggggatcatccagagacttggctcagggggaggtgggaagggggcagagacacatccatcctgcatttgtgcctaaaaatccctccctctgtaccagctgccactctttcttcccgggtcctccccaaccctcctccattccatccccagagctgccccagaagaatcagcgcctggagaaatataaagatgtgattggctgcctgccgcgggtcaaccgccgcacactggccaccctcattgggcatctctat

SEQ ID NO: 118001 - DNA, 1167 bp, Homo sapiens
tgcccggcctctgccccatccctcctcgccccctccctcgtcgcagcctgcgctgcccgccactgcccgccccgcccccgccactcctgtcccgcgagcacctcagctcccagccccgtgctgtcgagcccggcctgagtcaccgggaaaccgggccctgagtcagggcccgaggctcagcacgcgggccctggcttgggaatgaggcccagctggagagaggcagagggaggccagcagtgatgctgggacggagagggcgtcctggtcaccgacagagcacaagagtaacagggagagagcctaggccgaggcggaagacagaaacccaggctcagaggcagacagagacacagatacaactcaagatctggttagaattgtagactgagtcaaggacaagcttaataacagagagcaaaacagggtgggacaaggagagggacaaagaagaattgagaggttgagatggaatggggcagggacagtgacaaggcagagataaaactcaggggccacagaattagagacaggtctatgaaatagaccagggtcagggtcggggtcaggctggtggaagggggacagagcacagagacctgagcccaagggaatgagcagggaaaaggcaagctcagaaaaggaaggcttggagaaagcagaggtggggggatggcatttcacactgccaaatcgctacagggcatgtgcacacacaggtgaacagcatgtgaacatgctgccggtgggcagagagtccagaagcctctggagtacccctgaccagaggtcaggcctcatctctctggcatccccatccttattcttcaattagcctccacccagggccgggaccccacacattaggactggttagggctctcccggcagcctgaccaaagcaggcaggatgtggaggcggccagggctggagggacaggaaggaagtctgagcagagacaataggtggaaggggaggagggactgggaacaaccaggattaggacggcaggcctgcatacatcggctctggaaacaagagggagggggcgtctgcacctccttcctcctatctaggctgcccctctccctaccttactccagagctgattggccacatcattggcccctcctctgcatctccctatcccactctgacccacagca

SEQ ID NO: 118002 - DNA, 1052 bp, Homo sapiens
agaacggaggctggggatggcttcttccatcagagctctgtgagggaggagtggggctgtgtgtgtgtctgggggaaggcaggggagctctgtgaagctgtggggcacctaggggagcccttgaatcacacttgctaagagtctgagacacctggggggctccatgggcaaaggccacctccactcctcagaggcagatccagctcagctctggctgctgagaatcctgtcgccatggagatgaggagctggctcgtctgacagcattggcggcactgggcgtggcctgccctcagcatgatttgcaggtgggggtgggcaagttggggcagcaaagggattccgtaggactgtgtcaggtgcaatgttgactgacacatgcaatgtggctgctgctggctttacagtccactgacatgggcctgcatcccagttattaactggcggccctgaacaagggccacagcatctctgagcctcaatcccagcatcggtaaaatggggttggcagtattgttcgcacggtagttgtgacattcactcgagcctgtcaatggggagtacagtgctggggcacagcgaagactcagtaagtggtgactattacttcttaattggtgttaggattggggccctgcaggagcctgccccaaggcagcagccccctgccctcagcctgctccctgggactcccaggtgagactggagagaggcctgactccttttccacagacaaaggcgatcaggagtcaggagttatatcatcctttgaacatgggcctggaggctctgccgcaggcgcctctgaaaaataaataataacaacgtgaataattcacagaatctgtgtgaataattcaccatggcctcctaagcaccagccgattagtcaccgcagacccaggctctggtcttgtctgcctcaggctgccccactggccctagggagtgtggcctggccacaggggcaggaggtggagggcatgtggggacacttagaggagccctctggaggctacagggtcctgaggggcagccaggagatagggctg

SEQ ID NO: 118003 - DNA, 1088 bp, Homo sapiens
cccatgctctacccagggaggctccttcggaagcctccgtcttcccaaatcaaaggtgatggcaatattaactcattagcactaagcccctagaggaagctggatttgaggggtaatcttttcacagggcctcaccttgttccttggccctctcctcagcccaggggcttcctgagaaggcagacaagggacaggcgagatagcctggaggctggggggtggggagattcccctgagaagcagtgtctccccggaattgggcagagtggctatgtgtgtgggggtgggggtgagggaacagaggagattggaggtgtgcacctgcagtggttgtcatggtaacctggcccaagggggtggcctctcccccaaagccctgtgaagcttggaacacaagagtggagacacacacacacacacacacacacacacacacacacacacacacacacacacggttttgcagaactctacttctgggttctctctactcctcggctgcccctcttctctctacttctctgggtgaggctgacacgagggagggggccgtgggaagaggatgtgtcagggtgccagcaagcgggaggccctccacaaggtgggtaggggatgtgcttcgcaaatgggtggtttggtgtgggattatgtgtgcagcgtagctgggtggtgtccccgtatccacggaggacatgtatatacccaggtgacccagccccagtcctgcagtcagaccacacaggagagggatttgggggggatgattattaacaaagacaacaataatcacagttatctttaattgagagtttattaaattccagctatgtggttgtggtaaacattttacaggcagtgtctcatttgattttcagcaatagtacaaggtaggaactattagccccgtttacagatgagaaaactgaggttctaagagtttaagtaacttgtttcaggtcaaggagctggaaagagacaggtcaagactctgtaggaggggaggaggcacaggacaggggtgccagctgctgaggccactagtcctgtccccaggccccaggggtcacttatgcccatgtgtccccatg

SEQ ID NO: 118004 - DNA, 1028 bp, Homo sapiens
gtatatttcatttcttatagctgtagtggttcctacggcttttaggctgtatgtttacacagtcatgtcttttttttgcccctgtgttcaatgtccccccctccgtagggacaaaaaaaggcatgactcccaaggactggtacccttaaccctcattccctctgccttatcaggagaccccagtagctggaaaaagctggtgggttgggagcagaggcagaggttggggtggtagggaggaggtcgaggtctcccgaatttatgtctctgtcacggttgactaaggaggaaggtgtccagcagaacaggtgggaatgagggggacagcatccgagtctagtggcttccatgccccctgcttgcagatgagctgggggactgtctctgtcaaacctctgtcttagggtagttcctgtagggctgctgcctatgaccctttcctgacaacatatctaagtaagggaatagaaggtgtccctttcaatcttggtcacaggccccccttgtccctttccttgaccgtattccaatctatgattatttaatctttttgagccttcaatttctgcctcttcccactagaataaaagtttgcaggaggccagaacgttgtttaacttatttaccaccaccgaaaatatttgttgcatgaatgagtgaatggaaggaattctgcttagagattctgtagccagagcaagataagggagggagaaggagggcaggctccagatgagtagggctgtaggtgagaactgtggtgaaaagggggaaagagggttagatggtgaagagagtgggtgggatgggttgggagggacaatggggaagaggagagacctgggatggaagcagatggagctagaaccaggaggcatggactttaggggaagggattcaggtgcccagaggcaccagaggcaggggctttgggtaggaggagggcaaacctggaatagggagtcaaggacagagtgtgtccttggcaagggcaaggggaaacctgaaattcaggtccggggccacag

SEQ ID NO: 118005 - DNA, 1114 bp, Homo sapiens
taaacctgaggcctcacctcattaggagaggcgctgaatcagcgggggaggggcccgcattgtctccacccctgacttgaccccacagtgaagggtgaggagttccttctgttaaggcctagcccaggaaaagatgtctggagttaaggaagttggaggagatgtggtggccgactgggtaccagaatcctgtcactggttgattaactcattctacaaacatttcctgagcccctcccatgtgccagaccggcacagggtactggaccccaagaatgacacacagtctctgtgggaaaggcagacaggtaaacaatgaccacatcttgtgttcggccctgccttgagccggaaattctggcaggagacctaaaggcgctgtcctctccaaagtctagaggctttctggaaggggtggtgccagagctgagtttcaaagggcaaatgagggataggctactgaggaaggggtcagccttgcaggctgaggaggagtatgtgccagggtctggaggtggaggaggaggtgaggtggctcaggagggcaggagaagttggagaagaaggcaggggccagaactaaggacctgctggtcaacttaaagtgcttggattgaggggttggagaggagccatttacagattttaagcctgtaaaagaaaaggtcagatttacattcttccagattctgtgttcctcccttccctgccccaggtttctctggggatgcctgggttgggagtggagatacacaggcagacaggaagaggaaccaggtgcagtttaggctggttaagaatggtccctggctggtcgcggtggctcacacctgtaatcccagcactttgggaggccgaggtgggctgatcacgaggtcaggagttcgaaaccagcctggccaacatggggaaaccccatctctactaaaaatatcaaaattagctgggcacggtggtgcgcacctgtaatcccagctacttgggaggctgaggcaggagaatcatttgaacccgggaggcagaggttgcagtgagccgagattgtgccactgcactctagcctggacagcagagcaagactccatctcggaaaacaaacaaaagaatggtcccc

SEQ ID NO: 118006 - DNA, 1055 bp, Homo sapiens
tcgtttccggtttgtttgctgagctgtcaatgaaagacccgtgtaattattcccgagctttacaataaaagtgtgaaaaccggaccccactcagcttcttccgggtcctcgggcctgcgtcccgtggagagtgggagctaaatctggaggccttggagagggctgggggacgcgagggacaagagactgagacccgcactggtattaatcggggatggggtcgagctgacgcgttctgaggatagactcctagtccgtacacctcaaagtgacccctgccggatcctctgggcccgacctgctgtgggcaccccctccccgcaagaactcaggtgcaggatggggtgggaggtgaccgcaggagaggttttgtgctgcgctgccttcttccccgggcgcccgcaggacgtgcagtcgttcccgggtgtatccattcccgctccccactctttggcaacgagtgtgaattgcggaactggataggataaggggcgggagacatctgtctgtctgccgcgttctcccacgctcaggaacgagggttggaagtcgatttaggggaaaggaaccgaaaaggtctcagcctcggtctccgactgcgctcccctccccccttccgggctcgaccggccccggcctcctccgtccggctcccgggtaaacacccgctccggagaggtcggaaaacagagaccggatcagccggttcctggccccgcctcccggggcgttgctccctcctccgcccctccccacccccacacccgcccagcgtcgcgcgcttttgctcgacccgcgccctagctccctaggccggtactgtgtgggcctcgctccggaccccggggtcggtccagccgctgggattagccgaccgcagggactaatcccggatgagcctcgtgtaaacccggatcgacagcggggacggcgggggttgctggcaccccttcatccgttcccagacgcggagcatcacggggcatagagcccaccccgaggctccttgctgctttcggagagacccgagttggatctgcagttgggggcgtggc

SEQ ID NO: 118007 - DNA, 1055 bp, Homo sapiens
ccgaattgggaaaaggcaggacacacatggcttctggaaagggagcgatgttggattggctgtgtctgccatgcttgttggaaaggacattggcagcatgtgtgcccctttatttgctatccctgatctaaaccatctctgttctccttgtttttctctcctgccctataggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagc

SEQ ID NO: 118008 - DNA, 1160 bp, Homo sapiens
gtccttgtaggaatgaccacccccattgctgtcttcaccccatctgtgttgtcctctgttcacatatccatctctgcctttgaactacaagctccattaaatcagagattgaattgtatgagtctgtgtctctggtgcccaacacaggacctagcatatagaagaacttaataaatgaatgtttactgttggaaggaactggtgaaacaatgtagaagacccaggattccctctggcctgagtcccaccatcccctctgggtcatttaccacaaatagagagcctaggccagtcacgtcccggggactgaggatacagcagcgaatgagataggctgggctcctggcctcatggagtgaattgtccagggggtgatggacgggaaacataacaaaactgatgatacgtttcaattaggaaggttgctaggaaggagaagctgggctgctatgagagcatagagcagaggaactatattttgggcagaaatgaatcgggaagaatttcctggacaatgttacaagtaaattgaggcccaaagaaagggcaggctgggttgaagcagaaggtggaaaagagccatctaggcagagggaacagcagatgcaaaggtcctgaggcagataggaactaggttgctcagtggaagtcaaggttattgtggctggaacccagtgatggaaggggtcagtgacctctccaaggctgcagagctaggagcacgggttgtaagagccgtgtaggctatgatgagaatttgaatttttatccctgattataatagctaacatttattaaattgtatgtatatgtgcactgtgttaagtattttgcatggtttctcattttcttttcacagcctccctgggagactggtactattattcccattttacagatgatgaaatgctggctcagggaggtaaatttcttcaaggtcacatagttgacggtggcagagttgatttgaacccaggtatcaggatccaacgcctgcccctttaggccccgcgtggcccagcttaagagctaagtgcggacttggatccgcagtacacgttcctcaaggcctaggttcctctttcgccgcctcccttcccccggattggggaaggcaggtgcaggtttgccctgaccagaggagcgccccagcggcaggc

SEQ ID NO: 118009 - DNA, 1658 bp, Homo sapiens
cggcctactggcttcatttgtgggaccccgggggtcctctcctccgcccatggagcctggttactcccacttcctcaagcctagggcctggagaagcctttcctggttcgcggcctcacggtctgcaaggtcctcttacttccctgaagccgctccagccccacttcccgaaggtcccgcttccgggtggctcgcttcgccacctgcggtcccctgcctcggcttgggaacgccaaggacatcccccacggaagcctgggcccacatccccatgcccttgccgcacgtcaccgccccgctggccccgaatacgcctccgccctgcacttcctctctgcagcgccgtctttccggccgggctcccttctaattggccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgaggtaagggacgtccaagcaaccagcgtcactctgggccgcaaagaccgaactggagtgggggcgggcccgaggaaacagccgaagcgatcgtgggccgggttagagccaaggaaggcggggcttgaaagagggcggggaagtcaggggctgctggaatttgagatgtggatgggcctagctagaagagggtggagtccaagaagttggtaggactgttgggagggggaggagtccaatggcaggagatggtggactgaatgaatgaaagaggattaggggccaatggagtaggcatagccagtgaagagaggagaggtttagagtcaaagagccccaaacattagtgagagtatatgtatgaacgtttggtcatcttagaacagtggttggcatccacaggagaccagcagaatcacatgggcgcttttaaaaaacgtggatgctctaccctgagaaatcttagtttattggttctggggtactaccctagaatctgtagtagataaaagattcccatgtgtatccatgtttaagaacctctgctgaggcagatgacagtgattcctgggttcttgttgaggtgcctgagttttggttgttctgtacagctcttccccgtacactgggacctagcctctggagggtgactcctaagtccaccagcccagatgggcctcagactacctcctccactttgctggttcctgtgcctaacctcgacaggtaagatactgccattttaccactcatttcctcccctagtcaccctttttttttatttttttttttttgttgttttttgagatggagtctcattctgtcgcccaggctggagtgcagtggggcaatctcagctcactgcaacctccgcctcccaggttcaagcagttctctgcctcagcctcccgagtagctgggattacaggcacccgtcaccacaccctgctaatttttattttattttattttttttgagacagagtctcgctctgtcgcccaggctggagtgcagtggcgcgatcttggctcactgaaacctccgcctcctgggttcaagcgattctgctgcctcagcctcccaagtagctgggatttcaggcatgcaccatcacgcctggctaattttttttgt

SEQ ID NO: 118010 - DNA, 1195 bp, Homo sapiens
tcatgagggcagaaattatgtctgtcttacttgctattgtatgcagtgcctggagcaacaagtaagtatctgggtcaacctgtgtgttttttttaggctggagcgcagtggtgcgatcctggctcactgcaacctctgcctcccaggttcaagcaattttcatgcctcaacctccgagtagttgggattacaggtgtgccccaccacgcctggctaattcttgtatttttagtggaacagagtttctccatgttggctggtcttcaactcctggcctcaagtgatccacctgcctcagcctcccaagtgctgggattacaggcatgagccactgcacccgaccctgggtcaaccttcttaagcataacataaggagagacaggagacagggaaaaccaaggagtctctgggataagagctagctcaggtcttctgcagacctgtcagagaagaaacacctttacaaagcttacacctggagatgtgtgtgtgctggggtggcttcactgggggaatgggagttggtggaaggaggggttgtgcaagactggaaagagagcctaatggggaactctgacctgttgctatatttgcaactaggtgccaacctaccccattatctttttgcctgcttagtcttcgcttatttagtcacttgatcaagcatttattcaggttgtacttattaggtccctactatatattagcactgtgctgtacttgggcaccagagatacattggtgagtaaaacacacatggtccctgcccatgtcgtgcttatagactaacaggagagacagaccttagataaataaatgtagagatgattgtttaaatgccagtgtggtcagggctccagagaagttagggtgttgtgaaagtttgtagtcggggagctgccccacctggatttcctgaggaagtgatgtttgagaataaggccgggtctgatggagttgattggtgaaggaccgtgtccttaacgtgctgtctttcccagggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctgtgagttctcagtcctggggacaggagggctgggctgggcgtttct

SEQ ID NO: 118011 - DNA, 1085 bp, Homo sapiens
tatccacccagggcatgggccacacctgcccctcagtgtctttccatttcctcccatcacctccaaccaagggaggcccacagggtccagactactttagattctgggtgtggcttcctggcccacattcaaccagttaaattattctctggtcagtcactcagtcattcataaataaatgaatctttattgagcacctattatgtgccatggtgcagaagcaacatagcctagtggttgaggctctggagtcagattatagaggttcaagtcccaaaattgctgcatactagtcttatgtccctgaacaagtcacttttaacttccttctgcctcggtttctttatctataaattggggtaataataaaacccaccccataggtttcttgggaggactaaatgagttaatacatgtcaaggacttagggcagtgcctgacacatagtaagtgtgtagtaattattagtttaagcattagttcttgtccttattatgatgataatcattagcaatattgctatcaaagaaagtgctaggtactggggctacaacagtgagtaaggtagatgcctccctgccactgaagaatttaggcagaggagtgattgatgcttagggtgggagatcagcacaaatacaggcccctctagactcctctggagggaagccaaggaaacagaggaggaggagtgtgaaggaagtgtcacaggagtttcaaaattcttcctatggcctctaaaacctcagggaggactcagtcaagcccgagcagcctgcactgatcctcttctgacctgatcactctttttttttcttttgagacacagtcttgctctgtcacccaggctggagtgcagtggtgtgatcttggctcactgcaacctccgcctcctgggttcaagcaattttcctgcctcagcctcctgagtagctgggattacaggcatgtgccactgcaccccgctaattttttgtatttttagtacagatggggtttcaccatgttggccaggctggtcttgaactcctgacctcaggtgatccacccgcctcggcctcccaaggtgctgtgattataggtgt

SEQ ID NO: 118012 - DNA, 1026 bp, Homo sapiens
tttccaagtggcgggaacagtaagcgcgaaaatcctgaggcaggattggattttgattgctagaggaacaaaagaaaggtgagtgtggctggagcttagagatcttgggaagggcggaaggagataaagccagaaaagcaggcaggggtcagatcaggtgaggtcttctgagccacagtaaagagtgtggattttctaagtgagacaggaagtctttggagggctttaagcaggagcaggaaagggggcagccacatgatctgatgtacttttccaaagatctctctggctgccatgtagacagacatggattgtaggattgccggggggaaaaaggagacgaggcaggcgctgttggtgacggctgaacaaaacatgtcagtggcatggtctagatgagagaaagaagagagcaagaagagtagatggatctggttatattaatgagccaggtgggaaagaggaggatggtgggatcctttgcactcttgagtcttctacccaagggcagagggctctgtcaaccctggacagtgagttttcaggcagcaaggaggcaactttatttaattcactgctggctgaatggaacctggtttctccctcatgagctttatgtgattttgatgggcaaagagtctcttctcagaatttacttgcccatcccttcattcatatattcatttattcagcaagcgcttggcatggtggcagaacgcgaaaggagcataagccataatcatgttttgcatttgtatggcgccttcaccctaggcaaaattatttcttctacattctttttctgcttctgcctccaggattttacagtctaattgaggagacaggacttgtacttttgaaacggtttagtttgtagaaaaaggcttggtatattaagtaagtgccaaaaaagtgtttaagcctgagtgtggtccgaaggtttagagcagacacaggatgggagctttgatggtggaggcggaaagaaagatcccaggcaggagagacaattgaagcaaaggcctt

SEQ ID NO: 118013 - DNA, 1025 bp, Homo sapiens
agatgctactaccaagagaaggaggaatggtttatagtagggcagaacccactgctgtccatggcaaaccagtgaaatatttagaagatagaaatatatgcaaaggccaggcacagtggctcacgcctgtaatcccgacactttgggaggccgaggcaggtggatcacctgagatcaagagtttgagacaagcctggccaacatggtgaaaccccatctctactaaaaatacaaaagttagccaggcatggggtcaggcatctgtaaacccagctacttgggaggctgaggcaggagaatcgtttgaactcaggaggtggaggttgtagtgagctgagattgcgccactgcattccagcctgggcaacagagcaagactccatctcaaaaaaaaaaaaaaaaaatatatatatatatatatatatatgtaaagtgtctggcacaaaaaaagaaagggaggaggatcagatgaggagtctgtaggtacctggctgagggtgtggggaagttcactgaggaagctgtgtttgtgccctgtgccttcttacaggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggtattcccctgcccccaagcctgccttctgtgctgggctgctgagattgatgtctagaaatgagcagtgggcagggatgggggaaagtttggcttcttttctccacttggttctagcccagctgcgaaggaaaaataagaaagaagctcctaacttccaggaatttagactcaaaattcagggagggcagggattttgcctttcttctttgcaactacatcctcagcctagaatagcatcttgatgaatggattaattaatttttaaaaagtgggataagaacacaaagaggttatatataagaatgtatttcgtagagttgtatgtgaagg

SEQ ID NO: 118014 - DNA, 1042 bp, Homo sapiens
tctgaattttctgactagtctataattattatgtattagttaattaaaataatttttaaaaatttcactgagtgcaaaagatgcttacagagttgccagccgactgggtgtttctccctttgccccaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggtgagtgccattggcagggtctgttcaaggtctctgaggcctgtggagcctgaaagtgaccaagatgccttcttttccttcctccttgaccacaggcccaagctttcctcggggtgcttttcaccaaggagccctacctggatgagcagagagctgtgaaatatctttggcttgcagccaacaatggggtatgcgatctcagtggacaagcatgttggggatgaagcctgataagagaagggattttggaactggtactgagttcttctgtgcttaggagattgttggataggagccttggcctggcttcaagccttagcgctcactgacttactgtgtgaccgttgggcagttgcagtagtacgccagagctggcttgcaccaggctgtgagagctgttggcagcttaaaatctgctatggtgggaatatttgcaccacagaaattgctaaatgccataaaacagggctttttccctcctcgagagccagttgttcaacatttaccagcacactactgggcctggtcacttcttgattcaaacctgtttcctcgtctttaaaatcagaataataatgcttgccttacctgtccagtacttcacagggtggttgtgaggatcaaaatctaactgagataactaacaggtgtgacagtgctgtgaaacctgtacacatgaaaaacacatcattacaagtgatggtaacccagggaaattagaagacgcatcaagtggagacagtaaacagggaaca

SEQ ID NO: 118015 - DNA, 1048 bp, Homo sapiens
aagcatttagaataaaacttaaaagtttgtgtttgtgtactcttgttttgtttaagtatttttctgttaccaaaattaaccttgagtgccactggcaggcttaattcatgaacaagagaggaaaaactggaggggagtggcaaatgaaggaatacaagaagcagaagaggaaaggagaaaaaaacaaaacaaaaaacaaactgaagagattgtttgttatggggcatggtgtcctgtactttcatatgaccttggtgttcctccttagctcctcccatagctgagggcagacagataaaaagtcctcagtcattgctggggacatgcaaatactcctttaaccacatggctcagttagcctgccctaggagagtaacatgcacttgtagattaggattggctatatgttaggatatgtttgacttaagcagtgatcatggaaattcagaattttaatttggagagggtcctaacaccatcttttgtatttcttttctgcagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtactaactgacctcaagtagaacatgtaattgtgtcttagatagggatgcagcttaagcagagccatgaactaacatctcctagaaaaaaagtgttttttgaaaatgaaatcatttttaatttcatagtatgaccttttaaaatgtaaaaaatcctaactttttacttatgtacattttaattaaaaatattttagttgtgagggaggatatttgcaaatgcaattgtagttcaatattttaattgactggtagttttgttttattaaaatgatttttgtaaattctcattgcatatttttttcacatttaaattatctgaaattgctgtatctttcagttgatgctattttaaaaaacattgattcatact

SEQ ID NO: 118016 - DNA, 1056 bp, Homo sapiens
tcaatttgattctacctttttgatcactgaagagggatattatcctgcatatttcatacatcctggtctgctaactagcagtttatcagccatgagtcattggctgttacatagcagtaatcaaagagaaaatgaatgtatgtgaaaacgcttagaaattttcaagtacagtggtggtggttaatactatttggtttccagaatcatttcaactactataaacatatgacacatgctattactctgtgaccttttgcttcagaaaaaacaaaactgctgcttttgatacagacatttacagaagactttgatgcacactttctcaaaatgtttctactataaagggattgagtaaggaaagtaagtgtggtaatttaaatgaaactttgattgtgagagtgttgtgtgctatattatatcctcaaacctgagatcattgtgttggcacaaattttcccaactgattcatgggtagttgggacatgctggtctaagtgggacatgctggtctaagtaggtcatgctgttcaatggaaatgaacatcctttctctagattgtgtcttcaatcatccactgtaaaccaaaccacaacaaaacaaacattgtgtgttccttggtcattagtgttaggaattgtactcagaagtgtatacaagaataagttgtagtattttcattatacatttcatggtgctgtagatttttcaagggcttacaagatttttttttaaggtggtggctacgaagttaaaattaagaaatagaaagtgctttgggggagggtttttattccctcaactaaagcattaagtctttcttgagcgctgctcaacagtagtggacactcaagtgttgaccaactgatcctttctaatctttgtttttggttcaggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcaggttagacttg

SEQ ID NO: 118017 - DNA, 1038 bp, Homo sapiens
cttgaagctaaatataaataatataaagcattctgggagagataatgaatcagcagctgcttttctagaagtcataatgaagatcaatagactaatgtgtattaagacaaaagctcagcctgtgcaacatggcgaaacccaatttctacaaaaaatacaaaaattagccaagtgtggtggtgcgtccctgtaatcccagatacttgggaggctgaggtgggaggatcacttgagcctgggtggcagagattgcagtgagccaagactgagccactgcactccagcctgggtgacagacagagaccctgtctcaaaaaaaaaaaaaaaagaaaaagacaaaagatgtcagagttgctgacctcaaggaatagctcattagtttttctctttggatcatacagttttcatttccccatccaccaatctaatcttttaagtgagagtactttcacaaactagagcttatggtttaaaagcaaaattaaaccttaaaaaggataacacaggtagaataaaaaggagtattactttacattctaatgtctgtgccagaggcaacagatgcaagacagttgatttgtccaggaatatcaagactgtttggcatttaggccactgatagttggcttaattatttagatcttcatagtcctatttcaccagagagcttttcatactttacatccacgcatgtgcgtgcatgcacgtgcatgcacacacacgcacaaaacagggacagattaactggatgcgtggttgtggtttcagattccagccaaccagcatctacttaatgctggatttgggggcggaggtgtgtgctggggaagagagttgttttatgtgttacagctaaaattacagtagaattcttaatcaaataaatgtttatgcatataattaacattttaattggtctcttatattccttcttggttcagttcttgtttgttgctgtaccctgattccttggcattatgactctcacctgttaatggtgaaattgacacatagagctgtcattccctgaattggggc

SEQ ID NO: 118018 - DNA, 2062 bp, Homo sapiens
ggggtagaaaagaggttggagaatggcttcttcataggacttggtagctcacacagcactcatagcttcccttttagtatttatcacattttacagatgttagcagatttctcaaaagcatggttgatttataaggatatttatgcaaatgtgaaaaatcattagttgttcaatcttaactcatcaataagtatttaaggtagtacctatgcagggtttagtcagtggcactacacagagtgtaagaaacagaaaatctggtcccttttcatttgtcatttaaatttacaaaatttgtttgccatctggaaggcatatttttggatgtttacctaaaaaagaaaagctgcttataattcctgtgctctagttaaaaatattttatatttctaatggaaaattctccaacatttgcctttcaaattgaacagaccacttttaaagaggaaaattccaaataatttaattttggttgcttagcttaggaagtgtaagctttctctatggctgccaaaccttgctgagggcttgtgattaggaccagggtcaatatcaggcagcttccctccattaaccaggatctgatataagcccagattgcttacttaaaagcagcttgtaaatctgaacaaggactctgaggttgaattctgttagtgattgtttcagatgagttgactttttgataaaactgaaagaattaattttaaaacttggatagtatttttaaactattctttttctaaccattattctaggatacgaacagggctaggactcctaatggaagaaaaatagtttatttttagaactagatctctttgtcctacatgaggtatatggcagtactaaaagattaaagaacagaaaaaagtcttccatttcagtggctaaaatgtacagctatttctctaccttacggagtcttgctatttctcttcttctcgtggtacttcttgcttctgactttatgttctactctggctcatgttgccgaatagtttaagaagtgctccagtaagaatgtttgtactgttttgtatgtagcacagtgtatcacagcagtaaaaaatagtgttagaataagggcctaacttgcaagtggaaaagatttctagggaaaccaggagttggcagcagcatcatctttccaaactcaccaacatcttcatgtgttttctcctagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtaactgtttaccctgctgatggttgcctcctaattctcttccataaatggagatatcatctcaggaacttccttgatagggctcatggggcagtccgaggccttggagccagcccacaagttgttttgctgtatccattaaaaatgctatggtcttagtctactgcttaagcaaatggaatgcttcctttggccttgcagtgggcaaggatgagtgttaaagtagttattaagtaattgtgataatttactttgtatatctgctagtaggatcccataaaccttggggaatcactagcttattcttgtgtgaggttggcatctgaaggggacgtctcttagaatgat

SEQ ID NO: 118019 - DNA, 1046 bp, Homo sapiens
tcaaacctatggtgttttgtatttccctccaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcaggtatgttttaactgtgaacccaaacccccatccccagtctctccctcacatttcactctactaccagggccttatgacttcattcttcaatttggaagtattcatttagcagatatttctgtgtcagtgactatctcaggccttggggctgtagtagtgaccagaagagacaaaatgtctgccctcatggaactcacattctaccaggggagacaggaaaacaaaataaggatattaggtggtggtaagtgctgaagaggcagaagaaataaagcaaggacaggatatgaaatgttctgaaggggaggggacttgggattttagttagggaaaacaggggaggcctcaccggcaaaatggtttaagtaaggacttgaaggaggtaagaaaaaccgtgcagataccagggaggaacattccaggagaaggaatggcacaggaaattctatatacaaacatggaataatgtagatcctggatggccaatgcagggcatctaagctgccattcttgtctccatggcacatgtgtttgactagtcatcaaatgctttctccttgagcccagagaggcctcagaatcttcctcaacatggcacttcggaaagctaccctctgatgaagtagacacaggagtgaaatgtgtttgccgtttccagtctacgtaaggaatcataaatcaggcccttaacgtcgatttaattggactttggtggcttagtcttcttcagactaacagggataatgataacagctacctcacaaaattgcagctagagcagataa

SEQ ID NO: 118020 - DNA, 1096 bp, Homo sapiens
tgtataatataagcctttactttagacttctgtaaccttttcattaaaagtcaacagtacatttcaagtgtttcacagcattcagggaagaaattgaagatagattcagggctttagcaaaattaggaatctctccctctctttgtatgtatatattatataaaatatgaaatacaattttattattttgggaagactaaagcaatataacctttgtccttaagatgcctaggaacacaaaaatgcattgaattattagagggatgagatttacattgcttcactgctacattgaagtagaggtgatgaagctgtgggaatgtactacacagagaaagaattcacaggtgaaagcaaagagtggagataggatataggattctataccagaagatgtcttttgctttaaaagggagatagacttccaaataatgtgaggaaagtaaactgataaaataactagaacattgttgagaaaactctttaattaattgtattgaaaaattaaggtaatacaactgtgaacaaaagccttttgtctgcaagtaaaacctttgggattggttacctgttccatttcagttaaatgatagagcagtagaagccagattgaagagtatcgagggaaaacttttcagcacctgtagcaaagcatagtacggggtgagacttgggtgctaagttttattcactgattttttttttttacacagaattgaagaggtagtctttgcccttaagccaaaagtgcctttgtatttggtaggcctcttcattatcaaacagtgaatggtgctgacttagtggaaaaatcaatgtctgtttcaacctttgtgtcttctagataagtcagtctttaactgcatacttctagatgcataaacataccaacattaagaaatcaaaatcaaaggaaaaaaatagcctatcttattctaccacttttagcagatacatcttttctagttgggggattcctttccatttattatcatttgtgcaagtataatttttactgggttataacataaatatactttttttctggattctgtgatgagtgttttaattgggttgtagcgaacctaattatgtt

SEQ ID NO: 118021 - DNA, 1064 bp, Homo sapiens
aagatacactcaggaattaatttgagtcaaaataattagacagatatattgcttcttgacaaaaatcttaatatgttttaaaatcaaaatacatcttagcatttgattctattgttctaatctgttatgtctgaactgaacatagtgggctccagttaaggaaactaggactatatgtaatcacttttttttttttttttttgatactgagtctctcttgcccaggctggagtgcggtagtgcaatctcagctaactgcaatccccgcctcccaggttcaaggaattttcatgcctcagcctcccgagtagctgggattacaggcgccagccaccacacctggctaatttttgtatttttagtagagacagggtttcaccatgttggccaggctggtctcgaactcctgacctcaaatgactcgcccaccttggcttcccaaagtgctgggattacaggcatgagccaccacacctggccatataatcacttttgacataccttagccctatgacagagtggaggacttggtaccaaatatttacttagatttctgtaaaaattaaaaacccacacgttacatccaaacattttaatattaatctaactacattttccagttatacttgtgtgatttttatctactgcttgtcagaagagattgtgccaagtaactaattgtagtaacactagctattttctgtattttacttctaatgcaaaatagaaagaattacatagtcatcagtgtgttacattgatatctcaaccctgcataagaaaagggagaggaccaagacaatgttgtactgaatcattttggcatgtgctgtctcttctgcttttacagccttgatatttttctctttctatccttcccaccagaaattagacggatgtaacaagatgacatgtactggctgtatgcaatatttctgttggatttgcatgggttctctctctagagcaaacccttacaaacatttcaatgaccctggttcaccatgttttaaccggtatgtatacacagaattcctcaggctcaccagcaatttttggtactt

SEQ ID NO: 118022 - DNA, 2371 bp, Homo sapiens
ggtcaaacttattttgtcccatatcattgctggagtggtgtggctaacctgcctcgcctccatctaggccctcagtgggacccctatggccaagggacttaaggccaaaagacagccaattaaatcttctaggccagtgggaatggagctggacaagtactcatccaccttaaatgggccattcttaactaactttagggtagattgttcagagggacccatatttcagccctcctcagtgcaatgattaaaggagaagaaaagatgtacaaagatgttataagagtacaaaaaatatttttcagcggagaggcaatttatattgtttcgttcaagtgtataaaaatgtaccttttttaatgcttccaggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaacagagttgctgctatttgttctgtcaccaaggcaactaatcacattttaaaactgttcggcatataacatattcttaaagtaagaaaaaaaaggtcacagaatagcatctcttttacctgggcttgtgactgagcttaggttttagggcccatattttgtttaaaccagatagtttcatggtcttccattcaggacattttgtgtaaaaattgaggttaatttgctgggcacagtggctcacgcctgtaatcccagcactttgggaggcctaggcgggcggatcacgaggtcaggagttcgagaccatcatggctaacacggtgaaaccccgtctctactaaaaatacaaaaaattagctgggcatggtggcaggcgcctgtagtcccagctactcaggaggctgaggcaggagaatggcatgaacctgggaggtggagcttgcagtgagccgagatagcgccactgcactccagcctgagcgacagagcgagactccttctcaaaaaaaaaaaaaaaaaaaattgaggttaaagaataaattaa

SEQ ID NO: 118023 - DNA, 1721 bp, Homo sapiens
ggatcataggtgtgagccacgatgcccagcccttcttttactttaaaaggatgcacactgctttaggcaaacatgtgaaaatcctcttttactcaagtaggtcaattaggaatttgtcctttgctgaaaagactaacctttaaatagccaactcccatagtgattgaatttataaaagttccatgaatgtagtactcactgtgaataactctttttatactcttagggtgtttatcatttggggatcatagagaaaagagagaagtgtcagctctaagacaaaatttgagagctcctggatgttatgattgataatcaaggaactcttgccactgcctgaattaactactttttgtttttaattttttgtaggtttaatgcttgttcataacaagttggtggaccccttgtacagtatcaaagagaaagaaactgagaaaagccaatcttcgaagaaaccatacagcgattagcctgtgctgggacctagtgtcaagtacccatagggaaaggcaggtctttctggaaattgtctttagaagaaagaattgtatttctttaatctagtatggttactccagataagtgggtgaacttattgttcttggccatgaggctgggagcctagtcacggagtttagctatagggagaatgtttgtaacttaatcagaaaaaaaatatctgcaaaatgtactccatcattttgatgtctgccaaacccaggttgggagttttaaactttttgttctgcttcagccatggttcacacatatgacacactcccgtcaggaatttctctccttacacgcactgattttcaagtgggagggaattaggggcttatgtatattggataccacctctttgaagagtcttgagagtccttcttgcacaggcctgccccttggttgagaaccattgttccaagtgaaggcacaaactctcaatatctaaaataagtgcaaggaagcagtctctttggtcagtaacaagtgcaatggaaagaaaacgatcccttccttcttccactttcacagcttttctctgaactaggagaacctgggggtggatttgggtgggtggggccaaagaggaggcttctattgataaatccagagcctcaaggggcccagccacgtcaaacttctctccctcagggactctccagcaccaaaaggcagaaggtggaagccgtttttcccccagagccctgtgtttttgtgaaagcctcactgtggctcctctgttttacatactcattagtaagtgggaggtccactggggcaacagacactgccacaatttcagtgttgtgttcagccaaggggacggtctgggcaggcagcttaagtgtgagtttagtcacaactcctgagtgtcccgctctcctgcttacctaggaggtgagtgccaggaaaatacaccaaatgcttctagtattgtttccccacttaaaatagtcctgcttaaattcacatggtgtggtctgatgttctgagagcatcaggaaatacaacccttttgcccatttacccttctccccggatcccaaggtggtctgttgctctggcttcctttcattgtcttaggccttcatggagtggatgctgcctcctcctggctgtttttgtgcctgtttgaagctactgctgcctccatttctgggaaagacctttgagagcctagcccaggcctaagggctatgtttggtaccagtgtt

SEQ ID NO: 118024 - DNA, 1439 bp, Homo sapiens
gaaaggtgacacagctttcaatgatttttcttcagaccctagttagggaaggagagattgtccattcttgaaatcttggatccctgggactgacagggctgcacgggctctctccctataggcatcggccctgatggacacattgccttcaacgagccaggctccagtctggtgtccaggacccgtgtgaagacgctggccatggataccatcctggccaatgctaggttcttcgatggagaactcaccaaggtgcccaccatggccttgacggtgggggtgggcactgtcatggatgctagagaggtaagggcataagggccccaccagcttgcgctggtggacttgtctttctcttgttaatcttaactatactggtaccacctacattcttattaaagatgaaggcatggtaaataaggctaaaatccctgctgaccctgttactcactgttcctcttgcgtctttggaagacatcattattcccagtgtgaggtgaatcccttgagcacgtttttggtgcctttggctgactgcctgagacagcaggctctctggcctcaggcccctttcatgcttttcacaggcagagaggaggccagcatcgctaatgttggaatatttgtacctgaccaggtatggagagaggggttcccttgttccttgtagttggtagaggtcactgttgggacaccaaggatgcttgtgcttctagccccgtgctcagagattaataaatgtggtgaagtatgattaaaatataagtgttttaaactgaatttagcttttcccctaaaaaattggctatcatttgaatgtgaattttttgtggttccaatttccttattttcattagaactttagaagcattttctcttcctttctgacgtgtatagacatgttagatttacatttctttgcccaagccaataaacaagcatctaaatcagtgaaaacttccctgtttaaagtgaacttttgtgaaatgagtgatggcacccagatttctgttgggtaatcttcaatcagtacgtggggtgggggtgtttactcgctgtttttagctctgcagcttggaaacaggtttagggccgtctttatcatgagggcatcttgatctgggaaaggacctggggctggaaatcaggaaattatcttttctaaagagttctgggttgctgaggggtccggaagaaatagtcacattccctctctgcttctgcattctaatcttttaagaaaggaacagtaaatcctgttcacaactctgtggcacatgtgaattaaaatgaaaggaaatctacagaactgagtttttttctcttttcctgcccttgaatagagctgagttctttaagatcacttacattctcgatattttaactgttaagtggagactgtgcctttgttttattatatattaacaaaaaccatcacc

SEQ ID NO: 118025 - DNA, 1085 bp, Homo sapiens
agacgcaagaggaacagtgagtaacagggtcagcagggattttagccttatttaccatgccttcatctttaataagaatgtaggtggtaccagtatagttaagattaacaagagaaagacaagtccaccagcgcaagctggtggggcccttatgcccttacctctctagcatccatgacagtgcccacccccaccgtcaaggccatggtgggcaccttggtgagttctccatcgaagaacctagcattggccaggatggtatccatggccagcgtcttcacacgggtcctggacaccagactggagcctggctcgttgaaggcaatgtgtccatcagggccgatgcctatagggagagagcccgtgcagccctgtcagtcccagggatccaagatttcaagaatggacaatctctccttccctaactagggtctgaagaaaaatcattgaaagctgtgtcacctttctcatttgcagccctgggcaggtacaccttaaacatgtgatctgtccccctccctaccatttctttctctttgccatactgtctcagaggagaccctccccatcatgtctatctgaggcacacacagacattgttaacttgctatcaccctcaaaaagctgaggaggaaacactccaaacagcttctgcctccccagattgtcagaaaagtggaccttctctgtctcttctgcctgtagttagagggtcctgctgctgggatagaggtgcagtgaacaaaacacccagagaacctggacaggggctgccaaggttctaaaatctcagaggatgagaggtcctgcccccctcctccccaccttgaagtatagaagagtgatctctagagcaataaaaggcagttcaatgttacccctcatgggtaactccagaggtggcgatagatggatacacagaagggcagcccagaggacccgagcacaaatccaagaagcacacacttgctcccacctgtgaaccttgagtgagtcacctaacttctctggggttcaactggctatctacaggggctgtgtggagccttccggaactacatgagtccatgatgttaaatgtttag

SEQ ID NO: 118026 - DNA, 1022 bp, Homo sapiens
agtctggccttctgaaaccattccctcgttcccatcattgcagagtcagatccaagctcttcagagtggcattcaaggccctccaaaacctggcctctccctgcctgtcctgcttgaaccaacaggacagcgtttccacacgggttccttggaacattgcttctgttagatgtagcacctgtcagggttctgagtggaaaccacagaaaccaactccagctaaattaagcagaaaaggagtttattggctagatactgggaagttcagagaattcatgggaaggctagaagtttggaaaatggcaggagagaggaagctatgtggctcaggcatagctaaggccttgtcacacggaccaactaattattttgggtgggctgcggggagctgccattcactcagcaggtatttattgagtaccctctgtatgcaaagctgttctagcctctaaggatacagcaatgaacaaaaaggatatgaacttctgccttctgaggcttaaattataatgggagagacataataattagcaaaatatagagtatgttagatggtgataagaggaaaggagaaacatgaagcaggaaaggatagggagtgtgtcggcaggggtggggctgtgcagtgttggatatggtggcagggagggtctcatagccaggggccaggttctgtggagccttagaataactggtgttgctgagggtgaaatgagaagctattggtgggttttgaaaagaggggtgacatgacgtaatctcgatgggttttttttctttcatttttttagtttgcaaaatttcaaatattcaaaaaagaggaaaaaaacaggtcaataccattcacctaaattcaccaattgttaccattttgccacatttgcttttacctttctctggctcttgttctttatctacacacacacacactttttttttctgaaccacatgaaaataagttccagacatcctgacacttatctctaaatccttcagcacatatctcctgagaataaggacat

SEQ ID NO: 118027 - DNA, 1028 bp, Homo sapiens
tttacatccattttttttttcttttaattcataccaaacccttatgaaccagggtttgttctcattgtcaaagactcaaagtggctcagtaacttgcctcaaggtcacaggctgctaagtagtgattataaggatatacacacactcacctacttaaaacacaggctcacagtccagatataggtgtatgcattagcagatatatacacatgcatatgtattctcttatgtacccatatatacgtatacagacatatctttgtacatttgtgtgcagttttatgagccccgatcatacttgcacatacttttgcacgtgtccatgtgtatcttgttctcagacatgtgcattcatacatttgcacatgtgtatcatgcacatgtatctacaaaggcatgctagataaataatgaaataggttcataattctattttgtaatgttcttcacacaatgttattaatgtcttctatataaaatatttttaatgtctgcatggcatgtaattgtatggctgaatcataatttaactaattgcttatctttggtcactaagaatgtttacagtttttttcattgaaatttatttcacatacgtcttcaaccgtttccttagcataaattactagccatggaaatgcctggtcagcgaatatgcatttttaaaaggcttttgaattatagaatgatggtgaattgtccaggcaacttgataggagcatgatactctttggttgtcacacagggctgttctgacttctatttgatctggttaatcaaattgagctagttttctcaccaagtaaatgtaatggaaaactgtatgattcattcataaatgcaaacacagttttgtctttatggtctttttattggtagtgtaatatgtggacaacttgaatttagcatagtgacagactatgcagaaagggtaggctcaaccaggtgtggtggctcacacctgtaatcacagcactttgggaggccgaggtgggcggatcacttgaggtcaggagttcgagaccagc

SEQ ID NO: 118028 - DNA, 1068 bp, Homo sapiens
taaaattggtcagaaattatatgacaggaaaaaaaatccagtgtccaacagctatttattatctatcacagtcactcaaaggatatcccccctacccttgcccaacatctctgtgcactgagagcagaagttcccagatctgtcccagttttcagatctgtctctctgagtatcccctacaacccagattctgtgacagttaaattggactcgggcttccactgacccagttgatggaagagactgagcatctttccaactctaacccaaacgtgacaatgccgcgtattctttcagaaagtgtcaggaaagagcccgaagatccctgagctccagggacatggcagggaggctgcacagaagggttcccaggggtggaaaaggggaatcttaaaaataaattttggaaccaagtaatcaattttatagcacactctagttctagcgcacatggttcctccacttgttagtgaatgcctgacttgttgcccctgaagtgtaaaaagatgtatatttaaggattccattgttcagcaagttattatgcatgcagatggcaggcactaagtgcttactctttttgaaggtgattgcctctccccgcgatccccctacattgcagtgttttgttttaaacagctttcttgatggagcctaatcttatcaccagcattatagaaataagccagagtgagaagcctgtacagtgaggtcttgggattataccatagtcataatggtgttttaaattgtttttatttttcaattgaaaaaagtacactattctaaagtagtgaattttagtggagcaaactcttcacctggaagtgtttttttccttaccaaagtgaaaattggtggttctaagaaggctggaatttatttgcactgtcatcttttactatggtgggggatgatcaaatttaacatttccaagtttccaggagacaggcagcctatcttataaatattgtcatagaagacctcttaacctctttgttctttggatttctgtatttcttagaattgtcatgcttcctttctgagacctaaattatgcaggggtaa

SEQ ID NO: 118029 - DNA, 1026 bp, Homo sapiens
aaaattgaagatttgactggcagaaaagttgctgagatagggaaaagggatatctattgacagatatatgtagaattagggagaattttatgttttcataagtgtctcaattatttaagatttaatttggtgtgcatgtggaatataatggtaacatggtttgtctgtgatttgtcttttgtcttaacagattatttttctaactttaaaaaagtatacatcacttgaggccaggagttttaaaccagtctgggcaacacaggaagaccccatctctacaaaacataaattttaaaaaaagttagccagggtcacagtgtgccataattgtgccactgcactcctgcctggacaacaagagtgagatcctgtctctccaaaaaaaaaaaagtatgcaagtgataaatattcactacaaaatatttgaacatgcagatacacaacaaaaaggaaaaattcccctgtactcctattacctagaaataacagtgttgaactgtaaatgtctcattctaggcctcctttccattatatgtctgcctttttaaaaaggattatatgatgcctattgtttggcaagtttagcttttttcatgtaataatagtacactgtaaatatctatttgagtaatgaaatttaatttttttttttttaaagacatggtctctctcatgccccaggctggagggcagtggcacaatcttagctcgctgcagccacgacctcctgggttcaagccatcctgctgcctcagcctcctgagtagctagaaccacaggtgcatgccaccactcccgggtaatttttgtattttttgtagagacagggtttgttttgccatgttgcccaggctagtcttgaactcctaaactctcctaatctcaagcgatcccacccacctaggcctcccagagtgctaggattacaggtgtgagccaccatgcctggctgaaatttaatgtatattttttttgacacagagtttcactctgttgcccaggctggagtgcagtggcaccatctca

SEQ ID NO: 118030 - DNA, 1443 bp, Homo sapiens
tagctttcgagaaaggctatttatttcagtttttgggttcttatctttctaattggctttatgcttacattaaaatatgaaatttttatttagttgcagaatgaagaagagtctggagaacctgaacaggctgcaggtgatgctcctccaccttacagcagcatttctgcagagagcgcaggtaggtaacagggcaaggtgatcacggaatccttaaaaacactctgtgctttgacattacagtttaaaaaaaaaaaagcttcagaagcagttggaagaaaggttacaaagcaagtctggattttaaataattgagaagtggatacatttaaaaatcacccccagtctcttacattcatctaagaatgtcttttggttcaattgttatgtatgtactcttaagggaatggctgggttttgtctgctagagttagtggaactccttttatttcaattcagctaatcatcaaaaaattgtgactgttaaaattctgcagcatattttgactacaaggatgagtctgggtttccaaagcccccatcttacaatgtagctacaacactgcccagttatgatgaagcggagaggaccaaggctgaagctactatccctttggttcctgggagagtgagtataatttgccatgttacttgatggctgctctgtgggaattaagttattttcattatccaattttgattcgttacttatgattgtattgattagtgaaagtagagctaattttaaaaatcaggtacatttgcttttgggataataaactcatctcttcttaaaaatgatgaggtaaattactagtcagacctgctcatttttccttcatctctcctattaccactactttttcaagtctcctgggatggctgaagtatcttgaagcagaagcacactaatgtttccttgattctgcacacttaatattttgctgttgggtggatagctgctagggaggtctaggaagagaataaatatatgcaaatttgtagaattaaactcataagagggatcttcacattgatttagatgaactccgttcttccagcagtccagatcatgtcatttgtggggacatagtgagttcagattccatctagcctgatgttgattcatggaggtggagattgggatgccatataaaccagtggagattattgggcactcttggttcttgatgtcagatatgtgagtgctgcatttgtcattttgtaaatattcatccagattgaggctgatgaaggtagggcattgtgggagaatggaagcaggataagtccccagaaatgcggggaccatcaggcctctaggctctattctagcaagtaactggagtgagtgatgagcaagtacagaagcctagtctgggcagtgtgatggcataggcccagatgttcccctcttggctttaagatagtagacagtttgca

SEQ ID NO: 118031 - DNA, 1054 bp, Homo sapiens
atactttcatttgatacaagtacatatttaggaacttcttaaagggctctagtattcagcagacatgtataaagcactttttaaatataagatgcagtatattttacagtggataggtaaaaagctttgtataaggcagtgttcctcattgttattcaaaagcctaaaatccaactagggtaaagggcccacaaatactgataactaagacacataagagcagtgggcatcaagaactgaaactttttactgggtgatcataggggaaaatgagatttgatgtgggcccggagttttgatgggtaagaacattccagagggaaaaaggcacagaaagcaggtgtgaattcagccaggtgaaggcagttctgtggatgtagtaattggctttgtatgagcaagagtttgtgaagggagatagaaagtcctgactacaactgttgtttatagaatctttggaatgttagatgggcgtatttaaacttcatatgtagcttttagagaatccttcagagtttttgagcaggggtatgagaggacttgtgtggtgttttggaaacattaacttggcagcaatttctaggatgcatcatggtagaagagataccaagaggacaggaagaacagttagaaggtgttcgtaatattattagatgttacttccatatattttttggagtatatctttgaatagttatgcaaaaaacaattagcttttaattttggcaaaaccttattctgctgatacgaagtaagaatactaggtatttaatgttttaaaaaattaattataaaaattcgtttttatagaaatttcaaacaatagaggaagtatgttaagttagaaaaggaagctgccattgccaccgacttccctttctctagttcccactccccaggggaaccactgttaacaatttgggtcttccagacccttttctgtgtacaacaagttttgatattccctaaaatatttttcatttaaggagccctcattgaactgtgtacaaatctatcacttttaagtatatattcaattatttttaaatatctc

SEQ ID NO: 118032 - DNA, 1285 bp, Homo sapiens
aggctggagtgcagtggtgggatcttggctcactgcaagctctgcctcccgggttcatgccattctcctgccttagcctcccgagtagctgggactacaggtgcccgccaccactcccggctaatttttttgtatttttagtagagacgggtttcaccatgttagccaggatggtctcgatctcctgacctcgtgatctgcctgccttggcctcccaaagtgctgggattacaggcatgagccactgcacctggctgattttatctctaattactaatattttaggtcctaaacaggtcctcgattactgatattctagaatttaaaccaaatgtgtaagtaaattttgtcttttgtcttttcttgaggtatatttttttaaaggaagagtaaatagttctttgtgaactattcttgaagtgtattgtttttgaagtgtattaaatttttgaagtgtattgttaaagaacttgggttataagatgaaaatttcatttagaacactggggatagaagaaagatttgcttcttttctaattatatattaataatgcaaaatggaattttaaacacacattgagcctttaatgctcataattttgaactgaaccaaagcaataacttttttccttgctactcaaatttaacccttcatttttctttatgtcttccctttgcctagaaataattctttttcttttcatttaggatgaggattttgtgggtcgggatgattttgatgatgctgaccagctgaggataggaaatgatgggattttcatgttaacttttttcagtaagtatgtatgcatatcagaaccaccccctacaaactagagtgctttggattatgggtgaatctgactgaattaaaataactagttgagctaatatattaatacattatgtttatttggtgccttttactggaatattcaaagcttaatatacctttgttttaatatcccttctctttgccttctattttcatgaatatctgtggaaaatataattaaagcagttatgaggatgctgcatttttacatgagctaagcctcatcttccaggtctacggggcccttttgcgttgcttctactcatacttaatctgtagaataggaattaaatgcctttgatgaattttgctctgaaagcttcttttttctgacagatcaaagtcagcctgattttctcccttcatgttacttgccatttatctttttgtgtgcctcacatagaagtgagcaaccatttcctttatttgttgtattagaaagataagaaa

SEQ ID NO: 118033 - DNA, 1047 bp, Homo sapiens
ccaaaatgtttggggagccaaaactgtttaacaagtattgctccattaggagcctacctctcaagtaaattacagagatgtatgtctttagtgacttcagagttaccagttagttaaatttgcatgaagtaatttacagttgtaaaagatctaggcttttaaagtatcctctgatttcagataaatttattgctatcgtcaaccttataaacaaaaccaatttatccgtcataaattggcatacttaactaactaatgggtgttgcttgaccactgtagtttttctacgtagtgccaccttatttattataaaacatttgttaacgtttttagggttccagaatcctttgggaatctgatgaaagttgtaagcttttcccccacatagctaatatgtactcatctataataatggactttaggttaagaactcgagccctaaagaggttttcattccttccctaaattttaattgttactttattaacaaagaaaatactatattttacttttcgaactacattaaactcttggacaccaaagcctccaaggaaaagagaaataaaattaattccagtcttttttttttttcaaactaaattttcaactgcatttaaaaagtgaatcaaatgggccgggtgcggtggctcacgcctgtaatcccagcactttgggaggccgaggcggacagatcacgaagtcaggagatcgagaccatcctggctaacatggtgaaaccccgtctctactaaaaaaatacaaaaaaaatagccagacatggtagcgggggcctgtagtcccagctactcgggaggctgaggaaggagaatggcgtgaacccaggaggtggagcttacagtgagccgagatcgtgccactgcactccagcctgggcgacagagcgagactccttctcaaaaaaaaaaaaaaagttaaatgaattaacttgtatcaggtaggatgcttttgactgtgagtaacaaaaacctagctcaaaatggcttagaaaaaaatttttaattgtttttttaaacggggaaattttat

SEQ ID NO: 118034 - DNA, 1180 bp, Homo sapiens
aaaattagctggctgtggttgctcatgcctatgatcccagctacttgggaggagaatggcttgaacccgagagacggaggttgcggtgagctgagatcgtgccactgcactccagcctgggtaacagagcaagattccatctcaaaaaaaaaaaaaaaaaaaaaaaatatatatatatatatatatatatatattaataagagtttggatacacttatgagcatttgtgcccaatattcgggtcattttgggaacttcccttttgaagagaaccagtttaatggtgttttgtcttgcagagctctgtgcagagctcccaagctggctgctcttgagctatagttagcctatagtttatttgttccacagttatttttcaagtttttttaaattagttgccaacattttaaaaatcaaaattatttcacataaaacgcctgaatgtttttacttttcttgaaagttggaatatcaagaaaagctagcctacatttcacatggcaccctttggctggagctgagttgttgctgtctcctccatacaggtcatgtgccttccagttcagtaagatcccaccaccataccccaacttagtatttgaaggggtaacccctgctcaatagtcacttgttgctttgggtcccaaacagaatgatgttccccaagctcagagctgacagctcttggttactgctaaaaatcagttcaactgtccaagtaccattttctaccactgagtatcccagtaaaagtatttaaaaaaaaaaatgtgctaaaggctcagagaccatctctgaaagaggaaggccaggaggagtatctgagtttccactggaggggcatatcacctctctgctgacagttttaggaggtacaaacttttgtgaatgtatagattctggtgtagtcacacaaaaagagtcttactaagaatagagaaataggctgggtacagtggttgacacctataatcccaactctttgggaggctgagacaggagaatcacttgagcctaggagttgaaggccagcctgagcaacatagcgagacccctatctctacagaaaattaaaaaattagctgggcatgaacctgttatcttagctacttgggaagcagaggcaggaggatcatctgggcccaggaattcaagcttgcagaggctgtgatcataccgc

SEQ ID NO: 118035 - DNA, 1048 bp, Homo sapiens
gacagaaaaaacagcccatgacaaggaaggttacattttttctttttacttgagaaaaacacagttataacctctttttgttgttgttgttgttgttgttgtttggagttcattatcttggaatgcttttttggaactcaataggtagattttgatgtttctcaatgaggctttcatatgtaaatgtttggctccatcttattttttatttcctttttagaccaattcaattctgaatgtgcaaaagacactattgactcttacattataccttctcattgaaggatggataatttggtatgaaaatcctctgcagattctggaggaaattgctaatgttttgattacctttagcagaaaaataacaatgtatcgctatcaggagagggatttctggggaggggacttaacatggaaattataaattcattcatgacttttcttttttaaattaggctttctcctgtttctcagaggatttatcaattatgcaaaagttcggaagatgccagaaactttctcaaatctccccaggaccagagttctctttatttattaaaggtattaaagaaaaaatttattctagtcccagtgtaaccatgtgctacattgtagatttctgttcagttttagagtaagtatctgtgataggggcatatagagaaagtaaagaaggcacagtccctgccttttagcagtttcttgtctagtaacagggatttttacaaaaagctattgataaagtcaaattagaaaaactgccataggagaaatcattacttcatgctttgacagtgtgaaagaggcaggggtcttagcagtcatcagaaagctgggatatttggctgcttgactgaattccagcatcctgaagccactgcttactgttgcaccagttccagaggatgacattcagaaggaacccttcaggcctaatcactcatctctgcccctaaatcccagaacctggagagactgtgtagtactttaagaactccttttgtctgggctgctgacaagcccaccaagtcttccatcttttaaaatt

SEQ ID NO: 118036 - DNA, 2487 bp, Homo sapiens
cttccattgtattcttttgttaagaggtttggaaagagagactcctgacttcaggagtttttagaaaaagcattccagttttttctagttctagaggccttgataactttaagaactgaaattttaatgtttattgaataccgtgatgtcagtatacagtaatcttaaaactatgttaaaatgcacttgtgtctccaaacatcctgccttcttttgtgactacatccttctcttagccaaaataacaagctaactagagtttcaatattcaatatccttctctggcagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcaatgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaat

SEQ ID NO: 118037 - DNA, 1070 bp, Homo sapiens
tgctggaattacaggcgtgagccacctcacctggccagtaggagggtatattttatgaaaaagtagttgtgacccctattacctatgtgaatctggttcttggttaaacctcagtggtgaatataggttaatcatgtgcaaaatgtataataattttcaggttctgtgggtggttcagctgttcagaagattttcacctctcaggcttttagaatatgagttgaggaatgatgagggtcataacagaaggcaaaatatgcttccatagatggtttatatatttaaaaaaaatgtttttttgcgtattttaaaccctaaatagtgtttctatcctgtaagatggataaggtggattgggtgagagcatttgttaaagcagtagtacagtactcttgcatctccttttcccttttgcgtatacctgtacacgtttgtgtatgtgtataattgtgttcttttagactacctacagaaagtgccctttgacaagtagcctctgcatgttggttctttgtaggctctactgttaatgtggaagacatctcaaagaaatacactgggaattcccaaaggggagagtaagtttaggttgaaagtgaaagaggtgttcaggaggaaatgatggttgtagaaattgatttttgtatcatctccattctaaaaagaagctattttataacccagttgattgtatcacctacaactttatggcctatagaaagaactgctcttacgtaaagtacatgaattgagagctgtcctcccgaagccagtttccctgactataaaatctgaaatagtccatctactgcgtggcattttaatcccctcagtcctccattattctcagaattttccgcttataggataaatacattactcaaaggttttgtgttaatttttatacctgtttttacttatagcctgtttctttttttctttaccaaaaagcatcgtcttctgattttgagagttttaattcttaagtatcagttgatgaattaataaaatgtaaatgtaaatgcacatctcttaaacctgaatacagaacatattaatatagaggattc

SEQ ID NO: 118038 - DNA, 1315 bp, Homo sapiens
tctctggtcctcatacagagtccctccaacgtgaatcacaggttgtttattcaaattaaggaatatattttcttcctgagggcatggtaggaagaaatatgctatttgcaaaacaagagttacaagcaagacttcaggaagagagagattaaaaaacagggacacggcttctggaagtgtttgtgggtgttctttttctagaggctctcagggatgcactagctcagggcagctggttggggagtgggggacagggctgcatcctttgaggatcccttccagaaaatgtcagccttgggtaaagatggaagccaagtccagatggtttgaatgtagctgctcctctgagaatatgtttctggctatattcctgagccaaatgaaagtggtttttggattatccagtgttttattttaattcaagcctcatcttccattagtccaagccaacccatcgttaccagcatttgttctgtaattgtgagtcatcaatctatttctctatggccaatgggagtagtggtggtgtttggtgtcaaatagttggagttctaatccgaactaccattattagccatgtcattctggcaaattacttaatctccttgtgcctcagtttttccatgtgtagaatgagaacaatcatagtatctacttcattaggttcttgtgagattaaaatgagaaatgtattcatttattcctaagtattcacttaacacctgcttttaagtgctggcaatagagaactagacaggcagtgctcctgctcttgaaatgtgaacattctccagtgtgctcagcaaataataggtactattattgttgttgtgctgttgctattggtgttcttaccacccaactcatggggagggagagagatctaatcctaacctgtggctcagtttttctgaatatgcatggtctgaaagattcggcctggcacagtggctcttgcttgtaatcccagcactttgggaggccgaggtggaggcatcacttgagtttaggagttcaagaccagcctgggtaacatggagagatcccatctctacaaaaatataaaacaattagccaggcatcgtggtgtgtgcctgtgttcccagctacttgggaggctgaggtgggaggatcacttgcgcccagggagtcaaggcttcagtgagctatgaccaaaccaccatactccaggctgggtgacagggcaagatcctgtcaaaaaataaaaaaataaataaaataaaatccatcctttactgtgtaataaccattctcaggccaggtgtggtggctcacccctgtaatcccagcactt

SEQ ID NO: 118039 - DNA, 1054 bp, Homo sapiens
cgagcaccctgggaactgggtcttgggtagcaaagccctcccagagaaaagattgggcacaactaaggctttcctgagcaggaagggggtgaagaccaatcccttcctttggtcctttggtacgcaccccctcagagctgagatggaagacatggctagttcttttcagccttgtggagcctgtcagtcgccatcatacctcgagtgaggcccagctagataatgacttgtccaagatggcacacgtggaaagttgatctgcaccagaacccggatgactgtcaccttgaagcatcctgttctccttctgtgctgtcccaggaagtgtctggcgggcgtgggcagcacagctctacactgtacgattcactagggcatcctgcgagcctcactagccttctggttcatgcctttgacaagcatttttgtgccccctctgcttactgtgacagtcgatgatgaatcttgcgttgccattttctgctgtgggtaactgcgtgcagtgtcttgccttgctttctcttcttactgtcccacagcttggtttcatgttacaaacagaaaagctcgaggctcccaccccgccacatcccaacttcatttccccctcactgtagcccatttccaccccaccacaaagttgccacaggttttctttgtatagaatatttattttgaagctctattttaatagtatttattttagaaagtctactattgtaagagttcttctgtttgtgaagaaaaaaacaagttaaaaactgaatgtactgatttagaaaatatatataaatatatattgttaaatatacacgggactgccgtttctggtgtgtttgtgtgtttacttccctgacctcttcagccagcaaggcctcaagtttgagaataagcagccactgaaaggggaagagaagatagggcttcctgggctgggcaatcccttctcccagctctaggacgaccgtagaaccatcggaggaaagctgctcttcattatgaagcggaatactgcaaggagctgctagagcctccttcctgggaaagctgtccc

SEQ ID NO: 118040 - DNA, 1027 bp, Homo sapiens
tgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatgaaaaaagagtctattttagtgttaggaagccccagcaggggagtcggaagagcttggaagagctggggagagggtaggggaaaggtttttccaggggccactgggtttgagccctgcttctgtgcacagccacaccaccctctcccgacagccctcaaagacgtagcaactctttctctcaaggtgctaaaggactcagaaggtgcagcacgtccagtgggtaggtacttgttgcatgcaaaagctgtagtgtatctggtccttcctccccagcttttgtgtggggttcttgctttgtgtggtattttgttttcccctctaatgagagggcatggcctgagtcagaagagctaccccaggtgaaactggaagtgcatgaggcagagcgtccgtagcatttccagtttgttctgtataggaacagaggtgcctccgggaaggaggcagcgaggtaggtagctatgataggcacctaatgcttctcaaggacttattttttccttcttgaagactagtagtaacatcttatgatttagagtaagttgattgtaaccataggtatttattgattggaggaagggagggtcatattattttcggctttatttatgtaacatttgctagcttgtaaaaggcgaatgtgaaatattgcatctgcattttccaaggctgattcgtgtagctacccttgccacagttgtgacggatgt

SEQ ID NO: 118041 - DNA, 1041 bp, Homo sapiens
gaccttgggctcctaaccctggcctcttgccccaaactcatttattctagaagcaaggctttggaacacctattgagaataagtgggcaggctgaggtagcattccctggaattcctacgttgtcatcagcctgatccttggaaaaactcctctccatagatgcttacttgcattccctctctccagccctgaccacaggatctccaggggaggctgctttggcaagtggctactctttggtggcagacctgccagacacttaaggtaaactctgccacaaggaaatcgccaattcaaaggtgatgctatggtttcatccgaagagaacatgggggcaggcactgccactaggtaggctttctccaagacaggaaaaacaaggcgtgtaaagaaataccagcatccttttaagtaggcagggccatgggagcaaagccaatagttgatgccctgcgtgaatgggaaatatcagttgactgagcattgaacctcgcagaaaagactggatgctttttggatttagcagtgtaagtgatatacatactggagccccgtggatagccccctttttatccccttcataaacttttatctagagctagctttttattttagacaggttctagataaacctaacagcagaggggcaggatcagctctcctaattagaacatcgttagcatcttgatgcaaatttagtaaatgcaaaagcatttactaaaaccccaccccataatacattaatgcaatggcctttttttggttttgttttaaagacttatctttctcttttaccctccctccccattccctggggttcttaagattggggtggaatcttcccagagtgtaatctttcccttggattccaaattgtatccccttgagcagaggtcttggccttctgctgctatttctttaaattgatctccagcagaattccaaatgtaaaggtcagcaggcaaggaaatggcacttctaatagaaaacaatgtgcactttctaaatttgaaccaagcagtttccgctctttgatttaa

SEQ ID NO: 118042 - DNA, 1283 bp, Homo sapiens
atgtcttgttgtttgacatcttctagctccaagatttgtgcccccacagtgtgtttttctgtccttgggctatcctgttgatgagggcctgggtgttggtgcaaaggaggcctaggaaggagccctccctctttattcagaaaagtccagtgtttcttggagaatcatagtgttccatttggttctaaatccacagtgtttgtcatctggcctctacttaggtggcagttcccttgtgatgacaacctggctaaggattctcgcccaggcctctgaatttggagacaaagttgaaaatttggggttttgaatgtagacatgacagagtttttaaggaagggaaatggctagagtggagaaggttctatctcagggccgaccttatctccctgaaaggagaaagcagtgactcattagaatatgtttttgctctttcaaaagagccaggggtaggtgaacaactttcagaaagctgtattgtcccttccagaccaagccaggggctagaacagagcagatgtgtgactaggcaaacctgctaagcatggccttagcttccccatctgcacagtagagaaaataaactcttcccaaggggacagaggccagcagagctgctagtgagcggccaggactagggccatgctcatggttattattgggctcctaggaggagggcctagttttaagggtgcccctttcctgcacaggaggtgtggggtgttgcgtgatgtaagagggagggtattcttggctctcggggtctggggccaccctgcagatccggacagctgacaaggctggggaatgtatccgggacatgtggctgggcttaagaggctccacagttcagctgtgatcatgattgttctttccaaggacaggccccagtcagtgaaggaagcaagggcacaggggagggagcacagatgtgctggatctggcggagaagggaaggggcccttcggggcaggtggccacttgcagaagagtggtttcccttgtcagtagtctttttttggttgggggaaggggaagtcatttcctgctcctgtcccaggagtaagctaaaatctattattgtaagttcatttcttggtggagggtaagaagacaaataataagatcttagtgtctgtgggaggaagccctgccctaggagtctagggttctggtcccacccagacctggacttggccagtagttcccaaactatgccagtggttaacaggctccttctgactccttctttactgactcttggcttctaatccttctttatg

SEQ ID NO: 118043 - DNA, 1050 bp, Homo sapiens
gctcagagaggggcagtttcagatctccaaaccagccatggacttactttgaggagctgcagggtcacaagcatcgccccacgtctgtgtaaatcctgaagccggggcaggttagccgccgctgtactcgcagacgccggtcggaggaaccggcaaggctccctgcgctccacagcgccagctccgcgctgtcagctcagctcgctacctccgcggcgatgttgcaaccactgcctgggaaaatggcttttttatgaatgggagggaagggagcgccagtgcgcacgcgtgccgttcgcgattctatgaatgggtgggcacaacagaccctgagcgcgcatgcgctccgctcctttttttatgaatggggggcgggaaaagatcttaacccgtgattgctgggactggctcaagctccaccaggagccgtcgttcttttacaaagaggggtggaggttccagtggaggctgttgttgcctttttttttttttttttaatgaatggagggcggcggcgactgctgcagctgggccagctgcgcgggctgcaccccctcccagcctgcgagaggaggtaaaggccaccttcacgccactgcgggcctgggcaggaaccgtcagtgtcgctggggggtgggggacgctgcggcctccggatcccgggttgagagcagggtggtggagggcacacctagatctggggatctctgccccccgcaggcagtcaaaagggggggcgggaggacccctactgggggccttctcttgctctagaccagagacgccaggcgggaggggtcttgaagctgcgtttaccaaaaattaggaaaatgtccatcattcatatcaaagggtggggtgaggattggtgagtgaatctggttctttttcctgaggctgaatctctcgtgagtgctggccgcccctccccccatttcttgggtgtagacagtgactgggcccaggcctcttccggctccagtaccccccggggcgattctggcaactcagccagaggaagcctggccctcgcctcccagcgttcccccc

SEQ ID NO: 118044 - DNA, 1027 bp, Homo sapiens
aacaatagttttaatctcgttttcatattttgcattcctttaaaacgcttctgctgcttttttaaaagtctagaagccactatactagaaagaccttgaaatgtgtataacactagttaaacagccttctgcaatttggcagggcccccagaaaatcctgggatcaagaggttataggaattttaaggtctatgtaagtggtcataggtttatggaagttcctggagcaatacactgtgggaggggtatgatagggaggtgaaattcttactgaatttcagcaagactctattggtcattcttccttcaggagcaaaagtgatccctagaacatttctactagaacagctctgcttaccacttaattgctaaagctgcttttgactttccagactgccagcaaatacattttagaaatgcaaaatgaggtgggggaaagacaatatggccaacgttcttcttctgcaaaatgctgccacagctggaataaggcaatatctgtataaatgtgtgtgtgtgtgcatgtctgtgtgtgtgtgtgtgtgtgtgtgtctgtgtgtgtgttcagtgggctcagaagaaatttatgggtatgttatattctagcaaatcagggttgaagccagagcagggatccaggtgttccctaaatctgaagccaaagaaactttttatttatggtttcagcagacagacattttctttccaaaatctgcgttgtaatctgtatctacaagggtaaaagatctgcacacaaaccaagccctatgttatgatgttcactggttttcctggccaaaaagagggcattctccagttccccatcagctgggagaaatcctttccccaccctctcctgaacaagtgctttccctccccactaagcaagtgaattttaaatactactctaaagttgttggctggtgacccggaaaattccttttgctttgttatgctgttaatggtccatcagtttaaacctcatatccccagaaagtttccttctcttaactagattggagaagga

SEQ ID NO: 118045 - DNA, 1004 bp, Homo sapiens
tgtttggccactgctgtatcccctcagtgcctaaaacaatgtctgacacatagtatcagcaaatactcaaggtattcaataaatattttgcccaaaacaaattaatttagccaaaaattctcattagctatttttgactgtcctttctactagattctaaatttgacagcattttcttcatctcagtccccataactgccccccatccctccctgtttcaagtttagaatgacagttttgaacatagcaaaatattatttgatactgcaatgtgatttgggggtggcctgctgtttggggaattcattctcctctccactccccacaacaaatgggcactcagtagaaaactgtcttaggaaggctggaaaatgtctagcactttctcatcttatccctcggttaggttcctcccgtccctgctccctgaggctgatggacaggcaggcgggacagcccgatcgatcgatgcaaaggtgccctcctccgctcttgtttgctgctgcgtttctgactcacatcttccctgggctgtgggaaagtgttcagtgtgtggcttcacaaactgcagtgcagcagggagagcgggcagttggaaatgatatggaaaagaaaggatctaattaagcagagtaggtgatagtgtcgggaagaaaaagcaagcaagtggcaatttggatatctgcctgcaaataaaagagatgactgtcgttttctcctctggctcctgtttgccctataaatctcagttcacaaatccaagtgttttaattatcgctgtataatacaacatgctgtgctgggactatcttagggaaattaaaacaaaggagggggagacagagggattcaggctaccccgttctcccgtttctcttgtttacaataatccaaaggtgtttctccccccttctgccataaacacaacatggggttttccagtattaaacttatcaccttcctccactcacaaaaaggaacttcaggccctaagctgttgtcaa

SEQ ID NO: 118046 - DNA, 1046 bp, Homo sapiens
agatttgaagccaggactctaaggaccacactttcaactctgaccaagctggaaggtcgactgcctccggcaggggcttggcccaggcctgcccttccaagggctgtggtgtttactgccgagggttttggcatccttcggccttcttggtccctcaggggtcaccttgcaccccagccttccctgtagtatcccacggagcctgaggggctgtccctcagacttcctcacagctttgtaatccacaaatggaaaagtggcacttaaaatgaatttattcaggtgggagctgtgtaagacatgaaaataaggcttttgagctcctccacataaacttgagtgtaaatgaaaagctttttatttggtttctgagccagactttgagaagccagtggtccgtgcggtctggaagcgcatgttatgggcgctgggtcggaacaggggccactttgaatggcaaggagggagaatcgctccagcgaagctggaacggccaagaagctgggatgtcaataaacacaggcaggacacagaaagccttttccgaagagatggaaggcggggaagcgaaggaaaggcagtgcctcactcccggtgcatttgagaaggaaaatgcttgaggtaacccgtgttggcagcttttatagcttcctctcgataatgtgctgggcagaccctgaacaggctggtgttttattttcgtgtaacgaagccgagtggaccaggggcagctctccagcaatggctggcctggggctgtgctcacggagagaggcagggctacctgagacctggggcaggggccagcctcctgcctgctgggcaaactgtggggaaggcggggaccaggatttctgacttcctctggatgatgtttggtttgtcacaatccttagacgtaaggcccctttatgtccagtgccagtgagggaggtggcaggcagccgtgggaaggcaactgctctgagaaggagggcacaggtccacgctgtctaaatgttactggttgtgaactacacaggaaccttagcatggggaacccacag

SEQ ID NO: 118047 - DNA, 1053 bp, Homo sapiens
ttttgctgttctttgctactcaggctgaggccccgaatataagtagatgtgtgttaataagtgtctgtgcatgcatgtacatatacacagacatttcccctgctctctagagtcccttctcccagactggagaatgctgaactgaagaggacctcaggtattgagcacataatcctgactccttattaaacgggatgggaggatcaggccagcttggggaccatctgctgtgtcctgtgtggcctatccccaagggctctgggccatattctcctgtaaatcctctgccttattctcatggttgcctctccccaactctcctccagttgccccttttgcccaacttccagccacctggctctgcatgctgtcagttccatgcttgggtggcagtgggtttagcctgagatgcctggacttcactctcgcattgcttctgttatcctccagcctctgtgccccatggccagtgactgagacacgagaaaaggagaaaaagccacatgtataggaaagacctaggagaagaaatttctctaaagtcccctctagaggaaaagatatttttacctccaccccagtcactccctctcttttgttgccttctcttccccttttattcatagctgtaggtgccagcccaatccacttttgtaacccaaaaagcagacaaaggcctctgcccttgccttcccagacacagtcatggtctcatgatctgccaacctaagcagggctggcatgtgggatttaagtagctctgtccaagcttttacaggagtctgcgcttggaattgtcagagtgcagagcagtgttgttctagatccctaccacccacttcagaaaaaccagatgtgcctgccactctaggttgacctgacagttgtttgcacgtgtgtgcatgtgtatgagagcaactgacagcgtatgtgcgtacctagtggcctgtgtgggcctcctgaacatagaactaagcactcgcttgctgagccctgtggctgcttttggtagaaaagtgaccccagggccaggagctgcacctggtagagacc

SEQ ID NO: 118048 - DNA, 1084 bp, Homo sapiens
agcctctgaagcagcactgtccatttcctcattgcagtcatgtagtttgaatcaatgacagttctaccaaagtctagtttctcactaggtgaacatctggaatgtaaactccaggaggatggagaccttgcaaattgtgttcacagctgcatttccagtgctcagagtagcacctagcatgtcacaggctcagcacacatttgttgaatctttaatcctgacgggtctgccgctagcactaccagtttgtcttcctctgagctggaccatctcatgctgttctttgtgcatataatgctgttccctctgtgcaacatgctgttccctaccctgcctgcttagtaccctctccccttcaggtctcagcctaaatgtcacctctttagatgggctttcctgatctccatataggctgtcccctatgtccaaatagcgtgtctgtgttaaatggtctcataacacactgtacttttccttcaaggcatgtgtctcaatttataattatacttacgtgaatagaactgttttacatgtgacctctccttaaacttttagttccatgagggcagagatcctattttgctcactcttatcctcctagggcttagtagatgctcactaaacatttgtgagcaaatgagttctccactttccccaccaacaccaacatcccccagagtgatagattctaatgcatttagtatttacaactggatgaagccttttctccccatctctgaccctcacaaccacttccttggcactaatcagactccctgcttcacagacggaagggatttattttccctttggatctgccataactcaggttcagggaaggctgtgatctgccctcactgcagctacctagccccaggcccagggagccagggctgctgtttttagagcacctgagtaacttcaagttctcgagagtcatctataaaaagtcttagtcttcaaccctttattctgtggataaggtgaaaagagtggtgcctctgcagactgcctccctccttagcacacactctgccttttgttccttctccctgcttatgatgtcttgttagcactgaaatga

SEQ ID NO: 118049 - DNA, 1048 bp, Homo sapiens
gtttcttctgtttgagatttgttaagcttattgcacctgtgggtttctagttttccttaaatttggaagaattttggctattacttcttcagatatatttcttgccccttattcctgtcctgtttctcatgctccaattatattagcctgcttgacgttgtcccacagctcacagatgtgctgttcattttttttagttttttttttctgtcagtgtttttactgacagatgatttcaattcattaacctttttttttctgcagtatctaatgtcttaatctcatccagtttattttacatctcagacattctatttttcatctctggaagtttgattcataacctttttttgccttccatgtctctccttaacacgctcatgctttcctttaattttcttgaacgtacataattagaatgctgttttaatgttttcatatactaattgtgtcatctgtggcatctcggggtctattcctcaatagggggtatgttttcctactttttgcatgcctgtcaacttttgattggatgctaaatattgtgaagtctacattgtggagtgctggggtgctttgcatttccataaacattgttggactttgttctgggatgcagcgggatacagctgtgttgcttggaattaatctgatctttgagtctagcttttcagctttgtgagggtgagtctagaacagaacttagtccaagtctggagctgacaaactatggcccacagacaagctgccagtattggtaaataagattttattggaacacagctgcacccatttgtttgcctattgtctagggctgcttttatacttcagcagcagaattgggttgctgcagcagcagtggctgttatgaaccataagcctaaaaaaatttgtatctggtcctttaagaaaaaggttgcctggccgagcttggtggcccatgcctgtaatcccagcactttgggaggccaaggcaggtggatcacttggggtcaggagtttgagaccagccttaccaacatgcaaaaccctgtctctactgaaaaca

SEQ ID NO: 118050 - DNA, 1013 bp, Homo sapiens
tgtactggtgctcatattcagccctttgatccttaatatgcttgatttggaaaaggggaagtggttcattgcaccctcaagttaacacttctgagaaatgtatcagtcagaagtcaagcagagaagcaacaccagtaggagatacatgttttaataaacgtatgacaaggaattggcttacataattgtggggcttggctaagtaagcctgaaacccacagggcatactatcaggaaggaagaatcacatgggcattgctgaagcttgtccacaggcagccaaatagggaaaatccagtgaaggaaaagcaattgtggatccacctgctgttggaatctcttttaccaggaaaagctcaatcccttttaatggctcacctgattgagttgggcccatcgaatatcatctccctagattagagtcaactgattagggcctttaatcacatctataaaatcccttcacagcagcacctaggttagggtttgattgaataactaggagaaggtgtgtgtcacaaaaaggttgatgcccatgtatttagccacatagacacatctaaagatcattgcaatgatgtatcaaatgtagattttaggctggatgtggtagctcacaactgtaatcccagcactttgggaggccaaggtgtgaggattgcttgagcccaggagttcaggacaatcctaagcaacatagtgaaaccctgtctctctaaaaaatacaaaaattagtcaagtgtggtggcatgtgcctgtagtcccagctacttggaaggctgaggtgggaggatgatcaagcctgggaggttgaggctgcagtgagctgtgatcatgccactgcactctagccttggcaacatagcaagaccctgtctcaaaaaacaatgtaggttttaatgcaagttattttgtttctataacttggaatgatgagttctgcacaagtaaagtcacatgatttcacttggctgtcttcttatcaactgaggtttccttacttctcccttctt

SEQ ID NO: 118051 - DNA, 1001 bp, Homo sapiens
atcacctgctgatatggtttggatttatgtcgctgcccaaatctcgtcgaattgtaactaccagtgttggaggaggggtttgatgggaggtggtttgatcatgggggtagatttcccccttgcttttctcatgatagtaagttctcatgagatctggctatttaaaagtgtgtagcacctcccccttcaccttcttcctccttctccaaccatgtaagacgtgcctgcttcccctccactttctgccatgattgtaagtttccagaggcctccgtagccatgcttctcatacagcctatggaactgtgagtcagttgaacctcttttctttataaattacccagtctcagatacttctttacagaaatgcaagaatggactaatacacctgtcaaacaggaaagcaggcccacaatgccttgcatgctgcatttcttcctgatttggcagatatttgcaaaagtgtgtgttttcccctatacaggtgaatgtgttaaaataattttacatcagtaaaagcccctcttcatcagcctccttgtttttttcctcccctcccctttccactgtcacagggatccttggggggtctcttcgccagccagaaacctctgtggccagtggtgccatctgcctgagtattacttgcacccactgggttcattctgtctactcggtgtggcaggcagggcttggctcacgctaatgggctggatccacacctgccaagggtgagccaggtgcagagcagtgaggggtgtgtgggtgagcaagtgcggggtctggccactgtgcacagccaggcacattggctgctgtggcaaggcaggcacctacaggcaccaacataggtgttggctctgtgcaaggctgtggctggaccagatgtactgcatgcagcttctgctatgggcacctgtgtcttgatgaggggaacgtggtggcacccagaagcttgtaaacaccaggaaccacagaaccccaaagagggcgtcacagtc

SEQ ID NO: 118052 - DNA, 1145 bp, Homo sapiens
ctgttaatcactgataaacatcctgccttacatctctttatgtacatacagactagataaggctatatggatatagacttatgatatcatcaaaatgtcatgttttatttgatgttttaaaaatgaacaacaaacctatgaaaacattcaatactgctaacgagaaaaatgcaaattaaaaattatttatcatatgttagctatcctatgtgcaaagataaaaaaaaatttgtgcaaagataaaaaaccatttgcaagacttagaatgtgggaactaggcactgccatgcacagttggcgagaaaaattagtggaaactttctgaagacaatttagcaatatgtatcaaaatttacaagatgtattacctttgactcagcaatttcacttctaggaatctacccctaggagatggttgagtaagtgtacaactgtatttttgaggatggtctctgaaccaatggttataggggcaagcgattaggagtaacctatatgtccatggaaaggtgattggttaagtgggtaaaagaatatccgtacagtagaacccagtgcagctgtacatttattaagttgaaaatcagccacaacgtattaaagagtgcagttacttgaaaaaaatccagcaaccactattttgcttacttgtagtcaatctgttggtggaaggggaactcagtttttgaactttctattcgtcaagatcttagaatatatttattacatttgggtctaaaacaggtatattaaaacacttatgctggaactgagacatctgactttgctttgcctttttcaagtcgtgtgacccctgcagtctctcttcacccacagtggttggtgattccctgtctggcggtttccaattatattgttcattgttctctatgtgtgagcatgtttgtttctttagattataaaccctagtgaggaaggagatggaatcttgttggtcttctctccatcccccagacacagagccttgcaaataataggtgctcaccagctaagtaatgcatttaatttgattcttgagataatataaagcagtcagtaaagtcagcctttcttagtaaggaactgtgtaacaggaagtatcctgcttcttattcattcataatctagtgaaatgacaacagggt

SEQ ID NO: 118053 - DNA, 1049 bp, Homo sapiens
aaacaggctagggtaggtgattgcacagagaatactattctattcatttccttcctagccaaaaacaaaaacaaaaacaaaaatactttcctaacagaatttgaggattaattaatgtaatgtgcttagaaccatatctggcatacagtaaatgttcaagaagggtcattatattattatttgtggacatattttattatttacggataggtccagagtcggctattgagtaacaaatggtagggcaagccctcagcatttctaaagagataacaaacacatacttcaaaagactgcatctggagaagctaaattttctaggtcaaggggaaagaaaaaaaagatgcagccaacagaccatcttcctataagctggaatgttggctgatttcgagaaaggaatgtccttgccaggctggttctggaaattgtaacttgcacaacaacagattcaaaagatttttggagacacatcagtaagagaaggctaaaggaggtggcgaagggctgccagagcccctgcagaatcactttgcatttggcgtgaagccctggggctttaatgtgtccgtctgcaggaaggatatttccatttaagatgtgtgcaggtcttcaggatggcccagggccggccggatggtttggaccgtggtgtaccattaaagttcagacagaatgggggccggcagagcacaccattgcaccagggagcactctgtttttccttctggagtggatactgttttctctaagcacttaaaagaattcctgacctccaactgaatgatgctctatgagggggagtgttttgtggatgaataagccagactgcagggaaaaaacatacagaatcaagggaagaaataaaggatactacaggacacgtgtgtgtgtgtgtgtgtgtgtgtgtgtgtgtgtgtgtccgcttgtagttctctctcttcgttatgaagtgtgcaagctggggctgggactgagctgtttggtgacacagctggattagataacagccccacttcctgccagttacactagatgcaagcatctat

SEQ ID NO: 118054 - DNA, 1029 bp, Homo sapiens
cctccgagttagctcatcacacggcacctcactctttggggtgctgggagacatcgcattcctcagcctacagcaggcgtggtgggaagaaatgcccctgagtcaatattggaaggtggtagaaggagtggatgagaacctgggctttggcatccaactgacctgggttccaatcccagctcttctagttactagctctgtgactccaagcaagccctctaacctctctgatcctcaagttcctcatctgtaaaatgagtaaaataatagtacctactacagaggcattgggataagtaagaaagactatccctacaaatccttatcacaatgcctggcatgtaatcaacattcagtagggtgacagctgctgtcattgacagagttgttcttttaccaccttcctccaacggcctccattactcctccatcctttctgttttatttctgtgttaatctcactcagcttccacacccttacttcctccagaagtcatcctttacctctgatattctcctgagctcaggccacagcccaacctccctccacagtcactgctcatttctatcttgtctttctctcccttactttgtttttttgttttttttgtttgtttgttttagacggagtcttgctttgtcgcctaggctgaagcgcagtggtgcgatcttggctcattgcaagctctgcctcccgcgttcaagtcattctcctgcctcagcttcccaagtagctgggactacaggcgcctgccaccacacccggctaatttttttgtatttgtagtagagatggggtttcagtgtgttagccaggatggtctcgatctcctgacctcgtgatccgcctgcctcggcctcccaaagtgctgggattacaggcgtgagccaccgcacctggcctttttttttttttttttttttttttggagacagagtttcactctgtcacccaggctggagtgcagtggtgcaatttcagctcactgcaacctctgctgcctcagcctccgaagtagctgggattac

SEQ ID NO: 118055 - DNA, 1050 bp, Homo sapiens
ggcaaggatgctgtccactgaatctttcccttcagcccccaaacttgctaagttctctctccctggagaatcttgcccatccacctgctcccgccccgttctctgcttctctgcacagcccagctttctgaaggatgtcagcacccccccaacacctctcaggcatccccagccctctgcagtaccccatctagcccacccctccaccaaaacaaccttggaaaagcttgtccatggtctcctcccacacctgattgcggtggcctgaggccgtgtggtcagctgtgaatgttgttcttttttgacttgacttttactgattcagagattcctgctatctgggttccctttaacccccaggagacctggtccaccacactcgccatgctgctggctgctggctgcggctgcggccgagtgtctgcccaagactgggtctctaccacattctctgctggactctcagcccagtgggcagcggaactttccaacccactctggacaattcttgcccctctggtttcaataataacgctggtgtctgggtcttctttctccttctcttgcttagtatcttgccctggcttctctgcctttcaccaccttttggagtgtggtgtcctcaggggcctgtcctaggtggttctgtcttaaatgcatatatgctctctgggagtgctggtctgcctcacattctacccaggactcccaaatcctgccctgtgcctccaccctggtctttgcattcaaagctcccatcacctccaagaaatcttccaggacattctgcagataacagcccacggtggacgtcttgcattctccttcttccattgcctttgcttaattaatgacagtgcagtggttacaaaatagcccaagccacttaatatgccctagtcatattccctttccctcactcccacaggcatctccaaatgattctacctaaatatttcttaaatattccttccatcagtgtctcaggtcaggccagcaaattctcaagccttatccatggcaattgcttctagtttttctctctgtagc

SEQ ID NO: 118056 - DNA, 1054 bp, Homo sapiens
tactttctgtctctatagatttctcttccctgaaaaattaagctaaatggaatcatataatatgtagtcttatgcatctggcttctttcactaagcatgctgtgtttgaggctcatcgtgttgtagcatgtatcagtagtttgttcctttttattgctagaaaatattccattttgtaaaccataagttgtttatccattcaccagctgatgatttgggtcatttccagttttttgctcttatgaataatgctgctatgaatgtttgcatacgtgtcttcatgtgtatatatgttttcacttctaatttcattttttacctaggagtagaattttgctgggttgtatggtaaatttatgtttaagtttaatttaaacttgtgtttatttaaaaaaacctaccatactgttttccataacagaagcaccgtttcacattcccaccaacaatgtatgaggattctgatttctccacatcctcgccaatacttgttgttgtctttctttttgattgtagccactctagtgggtgtgaagtggtatctcgttgtggttttaatttgcattatcctggtgaccaatgaggatgagcaccttttcatgtgtttgttggccattggtgcgtcatctttgctgaaatgtctattcagatcttttttttcctttactttgtctcataaaacttttgatgattaagtgaacagcacttagtatattttctccatttgccctcttttggggactatttgtttccatgtgcttcaaccttagatgtatttaactgatcagtttcaggatctcaggaattaggaagtggttcttatgaggctgtggttcagatttctgctcttgttaggccagtgggcatcgctctgggcagatgccacacaggctggacttcctaattctggcctgcataagctaatgatccaagccctctcaatggacaaaatgagaaccggccaaggaagaactgttatcaccattgagctactggggaaagcaagttgtaaaggggactttgttatcctgtcaaggtcattgcatttctaaaa

SEQ ID NO: 118057 - DNA, 1039 bp, Homo sapiens
ttaatattagcatattttcatcattcccccaaagcaatcctgtagtccttagctaatatctgccattctttccatccctacctctcatccctaggcaaccacttccttaggatttttttttttttttttttttgagatggagtcttgctctgttgtccaggctggagtgcagtggcgcgatctcggctcactgcaagctccgcctccctcctgagttcatgccattctcttgcctcagcctcccaagtagctgggtctacaggcgcccaccaccatgcccggctaattttttgtatttttagtagagacagggtttcactgtgttagccaggatggtgtcgatctcctgatctcgtgatccgcccacctcggcctcccaaagtgccgggattccttaggatttttaactcatgtctccaagtgtggcactctcctatctgcttcgtctcttgatcttgtgaagccacatacccttttccttcagtgcatccaaacaatttgcagctcctcagaatgctgcagttccaacaccaggatgttccgacctggcactgttcttgctcttcacacattcttgtcctctgacagatttactagtgcaacctgactaatgcacactcactgccgagggggcctttaggcctctggtttcacacttcttttgtcttgtctgtcccttggtgttgatcttgctttagagagagtaattggaacgagagcgtgttatttctgcttgagaatgggtaccccaaatccagtaggtagatgcattccttcatttctacagaggaaaaaaattgccagtactatcctgatttggctggttgcacttcagggtttcagctttaaccattttagggactattgacaaaagtaaactttttatatgctgaaatggtgatgtttgggggtgtcagtggtcttaacaggaaagcccttcttcttcactagcaaccttgcattgttctaggaaattccagtccaaatgtagaaagcgtgttttctaccatctgtatgttttctctttctctcatttgct

SEQ ID NO: 118058 - DNA, 1056 bp, Homo sapiens
ctgccagactctcgtgactccaaaggatatcagcaggccctggtctctgcatctctcaactccactcttctctaggctggcgccattctcaggcagtcttttccttcacattggtgggatgacttggccaagattttgaagggaagccctcagcatggttctcattggctctttgttgaagcctgtgctcatccttgagataatccctgaagccgacctgacccagccccagagtagagttgacagtgggtaaaataagtgttctgaaagtcagggagggatgatttcccagaggaatactggggtgctataaatacagaaggaggggggacagaggccaaggcaacgcagttactccacactggcataagtaaattgagcacggtcatctgtggaagagaaagggccctgccttccagatatagcatggttgttacccacatttgaaaattactttgggcgatcaggctgtggtttaataaagtaaccctggacattcaaatttgtagggggaaaaatgagatacttttagtattttagtattaggcaccaccaggattgggcagactgtgagcagcctaagaatagtgtttgggagttaagtgcctagagagtagggaacagggatgtcaggcagataggagggagagaggggactgcccctgttgggacagatgataagaaatgaaaacaaaatgatgtatgagaactattaagtaatgccacagagttctgtaataccccggccaatgattgactgccctgtagcccagccagtacgagagctagttctttatcttccagagtctctttctctttatgatatttacattttgggaaataaactataactaatagagcttgttgtgaatctgttgatgtctcgtataatggattagactacaaaggtgggcaagctttttctgtaaagggccagttagtaaattttttaggctttgtgcgccacatagtgtctctgtcatatcttcttcttctttttttttaaaaaaatttatagccctttaataatgtaaaaaccattcctaactcacaggt

SEQ ID NO: 118059 - DNA, 1185 bp, Homo sapiens
tttactaaggtgtttttctgtgtgtgtgtgtgtgtgtgtgtgtgtgtgtgtgtgttacgtctctcctactagaatgaaaactccacaagggcaaagatgtttgccattgttcatttctgtataaccagtgcttaggatggcatctgctgtatggacaaatatttgtggaattaatgaatgaatgctttgattcttatattggaatgtttgctacatcctattctctctggccaaagaagacataagacttgggtttaaatattgactctgccacaaattgcctctgtctttgagcaaattatttaatctcttaggaccgtagttctcttatctttaaaataaggggttagagtaaatgattgctaaagttcctactagttctgtagttctgtgattataatcgctggttaaaagagatgatgtactgctattaaaattcccacatatatttcctaaaaacagtttgaatttcattggtgggcaaagtgaatcaagagtttcagaaaaaagtctttggaggcaccttctgctttcactaaaacagttctcaagtattacagtgtagttgctttcaagaacgtttctgctagcccttttaggataaagttcagacgtcttgatagggctttctgagccctgtggactctggcccctgccagctcctccagcctcacattgcctatgtgtataagctctctgctccagtcctgaatctgttttgattttttctaatggataatgggtttcccagcatcagtccactgaatatttctgttccttctgcctggtgtctctggtaccatccctgtcctcctttgtttggccagtgcctactggttgtttaggtctcaacacacagagggtgtggacttagggagggattgccaatggggttccgtttccactgggaagctcactagctatagcgtggtgtcagaaactgactagcctggttggctatatcatctgtgcaataagaatccaaaagttgttggaattagattgcagaaggtttaggtgacacagtgaagagtctttgttcagtggacactgggaagtcactgtaagttttttgagtagcatagtgacataatcaaagctttgtgaactaaatagcccggatatacctctaagagcattgtatcatttctctgatccctaaaacatcctttgggagataaatgc

SEQ ID NO: 118060 - DNA, 1051 bp, Homo sapiens
ccaattaaatctagtgttgccagataaaatatgggacacccagtaaaatttgaacttcagataaataatgaaaaattttcagaataaatatgtcccaatataattgtagtttaccttaaatttaactagttgttctgcatttttattggtgaagtctggcacctctaattttgtctcattgtttccccatttggaatcttttggctgcctttatgatagctgaaaatgagttgaggaatttcaaataggatgcagaggtatgattttatttgcatctgccccatagctcctgtcctttgttgttgctaatagaaacctggcctttcacgaaaggtcccgtcatctattaaaacactggttgcatagcagccaaacatttttgttgagaaataagccggacggaaatctctgtgatgacacttccttcaacctcacgctattgccgaacatgcgacaaggaggatgttgggaatggaatcataagaatcctcctgcagcacgtcagcagttcaccctggagcagttagaggtcagcaggcagggactctggtggcatctggggatgtgttcttgggctttaatagcaggtaggaagccttatctgtggaggagtccagcagtgaacatcccattctgcatgccaagggaacgcacaaataggcaacatacaaaaacaaaagaagtcaaaggcctggtccttgatcactgaggagtgtatagttccagagagggataggaccagcaggtatttacacaacacttcctttgtgactttgtatcagcactggtaggtgctttccacgcactgtcatagtaatccttaacagcagccctgtgaacaagatcctgttattattcccattttccacatgaggagactgaagcttaggctgtgggatggagcctgcagccgtaaagtcagcctgacctaaaagttcctgttctgtctctactccttatcaaatattgcaagtataggttgaatcatatgaaattgccagtatgtaacaattttgacctacaaaaaacgacagttttatatggttcaact

SEQ ID NO: 118061 - DNA, 1052 bp, Homo sapiens
gttattgttaagtttcagtgagccagtgcatacggactttgcttattagcacaatgcctggccttccacttttcctgatcatctataggcactggccccttgaataacttcactctgtatgctgggtatacagtaatattgccagcgctgaagcagaagatgcagacactgtgaaatgtgctgtggtcaaccaagctgtccacatgccaggagatttatttcccatctcttcagcaagctctctccatcctgggtggcatagagtagaagctgagagtgtgggctctggacgccgacagcatggcttccaatcctggcctgtccgtcacgtgtagttggtaagtaccttatctttttcatgtattcaacaaaaaaacactgtgtgcctgctgtgggccagccactgttctaggctctaaggatttgctagtgaacaatctgagggacagaatcatgcctttgcggagcttatattctggccttattttagtctcttaaatggaagtaataatagacttacctcctggggttattgttaagtttaagtgagccaatgcatacagagcctgcttattagcacaatgcctggcgtgcagctattacttaataaatgctagcttttcacttatgatactcttgtgcgcagccttgcaccaggcttagaacccattttcatcattccgttcctgctctggcttcagtagcacccaactgaaatattctctccttatttcttggcctctaagtaattcttgaaacctcccagctctaggaacctcttatggcttgcagcctcctcacctaatcatagcactcgaagaactcctggtcacctcctgaaataagcttactcatcacctagctgctgtgatgagttggcattctcatctcctggatgacgttttttggaaaggatcttttgtgaaaggctccccctccccaccccgtctactgccttttccccccagtgcttcctcttcgcttcctgtagtatgagggttgttcgggcagacatcctgaccttgcagttgctgtaaggatctttttaaccc

SEQ ID NO: 118062 - DNA, 1061 bp, Homo sapiens
tgacataattttctggccttctggcaggagggaaagccctctcctcccatagcctgctctgccaggcatgtgcagactgaggctgttaggtcttctggagtttgccagaatagacagccttctgcatcacaggccatgcatgcctcataaaatcctcacatggttccagatctctggattacacaaactgatgttacctgaacaggaagagtagtcatatataggtgataggggagatgattttaggtgtacagtgacacaatgttttatactgataattatatgctgtatttggaaaacttataactaaggatcaaacccacaatttcacaatcattacatagaaaatttactttcattatagatgtaagtaataatgagtttcttataaaaatttacatagtatggacttgattttttttttaaagtgaaggtgggataattgaatgatgaaagttaagaagccctgactggtgttgcatacaccagggttcttacctgtgaacctgtgggaagacttcaggaggcctgtgaagcccttgaagttgtagacaacattttggatttacttaccggtctgccgttgtttgtggaggagggagagtgagtcatcgcttggtttagaaatttagtgttggaactttctgggggttatttattaaaggttccaatttccttccccagagattttgatgtagcagtggaaatggaatccacgaatgtgcatttcacatgcatttagatgaggagtgcaggtggttctcagacctcacattgaggaacactgcttatcaagagtttcaggagaccccaacgttgagaattcagttctgagccatcccaacttcttaggattgttgtgcggtggttaaaactttcttgttaagagtttttgagatctttggacgaaaggtttctggataaatttatatcacaaattagtaagggtttcatagtaaggtggctttcttttccctgatcagtcattttgtggttgggtttgatctttttagtccaagatgcttaaaaaaacaaaaaaacaaacaaaaaaaacccaccta

SEQ ID NO: 118063 - DNA, 1030 bp, Homo sapiens
aaaaagttagagatgacaaactattaacctgttaaacatactccaatcccccataaagctgttcttctaagagttcattggtgggtttaaggaaatgattgcactggcttctcaacttgtcatgattaccttggaacagtctttactggtctctcttcttcctcttcttgccttttgcctagaattgactcactctccatctttctatcacactaactgtttgatgaatcatcaacagtagggcagtttagtcttaatttgctcagagtgctgcctgatgactcagactcacagttaataaatgcagcatctttagttttgtgattatatgttttctggtgacatacatgctgggctctgttaatctcgaaaggggaaggctatcttcattttggcatgctttgatctggcagctcctccagttaatgctgaactttagctcactgttgaacattaactctctgtgagtgtgttggcaagagatctgcagggttaaatctcggtataattcctaaataggaaacaagtataatgtggtactggagatacatacacaaatacacacacatggtgtttgtgtacatatttatcagataccatatatatatatagctgatatatatgtatatgtataatatatatacacatatatctcaccatgtgtgtgtatgcacacacaccatacatatatgtatattcatgtcacaattaaagtccattctaaattacagtaaagcattcgaatggttggattgtgtgtgcttcttactggtcttcatctggaaccttggacattatattggttatatgacagtctctccagtggaggagttgttgaaggctaaaccccatattattccctttatatccctaacctctagcctggtgccaggcacgtgggagaccagtcagtaaatagttgctgagtgatggatgaaccatctagggatcaataactgtgctggtttaccagtgagcccttatttattgaaatatgaatgatgttgataatagcagctatcatttattg

SEQ ID NO: 118064 - DNA, 1114 bp, Homo sapiens
ggctccttgatttaatttgtttcctgcccacaagccacctgaagttcaaagggttattatttttctattgtaattccttagcgggacgatacattccttctgggacctgcaggactttttttggaaagctaaattggcaacactgactcaaggaaaaggcaagtagttaagagccgatattccgaagcaaggtattctaaaaaggcttttctgtccagtagagactccagatcagagagcaggaaacttttcctgagccagaaagtatcatttataggtgtccttggcggaatccctcagaacacagttctcgaatctgcctgtaacaatgttgcctttcccgtgctgtgtgctggcttgggaattgtggaattctgcacatgatgcatctgggtatttagtttctggtggccgaggagagatgatgaggaagcaaagatagaagacctagattttcttatcgatttgctggttaacccagggaaaattactctgtgcttcattgatagaattagaacatctttctgtctcacgagagtgttaatgaccagtcagacagtgttgaatctgggaattatttttcaaggagggggatatgatatgtgatcaaattgtcttttatatatttaacagactaatgaactgatgcttcgtctgtccattattatcagggaacggaggctgcttcctaggtcagatttccagataactggagattgtccatacacttgtcatggtagagtaagactcacatccggggtggaggaggcgctgtacacagttaactcatttaacccctaccacaatcccatcatgttaggaattgtcatactacccattttgcagagcaggaaattgaagtttaaagaggggtaaataagtttaaagaggggtaaataagttgcccggttcattcaattattggatagccatttattgaatttcaactacgtgctagcacgaggattattatcaccacggtgagtggaccaggcttgggttgtccgtaggggagttaggattcttcccagggatgtctggcaggtgacttgtcgccacaccatgttctctctcacaggattttagtggtgggaggtacagggccttcttgaga

SEQ ID NO: 118065 - DNA, 1081 bp, Homo sapiens
gttgttacaattctcaccattaataacttcaaaaagctagagatctgcagagcagagggcacctcacatcaccattgtggagagggtgaggtgcagtgtgatataattggtatttatctctgtggcctgcttgccgcactggattaaaacaaaccaagaatttcaaggctaattggctaaaattatatgtgtaattagagagagtagaaaagctaaaggaaatgaacttacccagtgtcacctggtcaagcaggtaatggtgaacaaggagtgtgtgcccaggtgtgtctggctgtctccactgccccttactgtccaccatattggcctaatgttttccactcatgacactgaggatggtgtcattctcagcatgcaggggatgagctgattcagagcatggtcattgttcccactgctgtcttcccacagctaggaagtggcagaggttaggtttaagctcaggcctttataccattattactttggggagggctaaatggtggatgttttcgacctgatgagaatagtaggaaggggcaattggtgtgaggaaatattggcccagggtgaaccttttcaagtttattggtgtgagttaagtcatttccctagaatgttggccaagcctcaggaacatagcacgtggggatgttattcatgttcaataaatgtcaagtagcatccacagatttgtgggtttgtaaatccaaatggagtgctattattcaggtttcttgcatgctcaggattgctagcatttgtttttgaacagttctaataaaatagctcattactatcaagtatggattaaatacctggctgagaaaagtaaggtgatttatatatcttctaattagtgcaattgagagtgactatggcaatgattaaaaattattttgtggtgataataagttgcggtggagggtaggaaggggaagtgaaggatttttccgtttgtgttacatttccacaggtttgggatgtttctgacagtacgttatggcagtcagtctgtttttccataattgtgatgacctctgagtgaagacttgacttttaaaattaatgatctgatcaa

SEQ ID NO: 118066 - DNA, 1049 bp, Homo sapiens
ctctgctgcctcctgcagcctcatgccctcattgtgttccctaggcctcttcagagctctgcctacctctcctgctctgcctatggcttgtccccttcttttggccctactatttcccgtgtgtgcagcccagtgtcctgcctctgtgcttttgtttaaattgtcccctcttcccataggggttattctccccatctctccttggtcaattcctttgtgaccagtttaactcctccttccttagaggaacatcatcctttcagtgggggcagtttctcctctgactgaattcttattacagatgctctctctctctctctatggtgcttactgctttttctttttcttgcaaccagcattaaaaacaacaacaacaacaacaaaacacacaaaaaaacaacattctgtatttttgaagcatggtagagttgttaagagtaaattaggagtcagacctatacttgcatacaaactttcgaagttattagctatataaggtggaaaagtttcttaatatctctgagcctcagtctctccgtaaaataggtataatgatgccttcctgattgagctcttgggaggattgaaggagatggtataagtcaatgtcagacacatagtaggtcctctattagtcctatttctacctcctcccttctcattaggctgctaacttcttcagtctgcatacattttagttttgtattatgcagagccctgtgcctcatatgtagcaaataaggaatagctattagctggatagccaatggatctgaaaggactttaaagagaaaggattttaagagaatcactggtatagccaatgcttctactgtgcaaatgtctagcattagagtggtggataagctcgatatgcagtgtcaaccaggccacaggaagatttttgtatcacctctgagacacgaatagtttacactacagattaatcaggatggatttaatgatgaaataatttaattgtttcacagatgagtggattttgtatttttgttcccatggaaaatacattttttttttttttttcctga

SEQ ID NO: 118067 - DNA, 1062 bp, Homo sapiens
gggctgcaggcagaggtggcatgtggtggcaggtaggagttgggcatgccccgggaactggcagaggctggagcagctggagcccagagaggggtgtggggaggccagaccctgcagggcctctcaggccttgggagggactttcgtcttcacctccagagctctgggaagccatcacagggctcactgctggtattgacacaactgggtggagaactgatttgacggacaaaagtggatgtggggaggccagagaggagcagttgcagttatctgggcaaatggaggtgttttgtttaggggttgctgatagtgatgggaaggagtgggcagaattgagatgtgcttaggagacttgggaatggacatggcacatgagggagcctgctgtgtgagaggatgacatgtactggtgacttgtgcggcagggtgaatggtggtgcccttcgttacactggggatgcaggaagaggccctcggctggctctctggggagagggtggcagagggtgtttgagtagagagagttttgttttgagtgtgttgagtttgacctaggaatgggggtgtgggctaaacctgaagtctctctggggctcgtgtccatccatgtctcagctgtctgtcatgggtcctctctggagactctcaggtattccacctgtaagccagcttgtgtttccttgcccgctcacatcgtacaacaggtttggagggacactgtgtccagccctgtccgaggcactctttgtgcattgtgacatgaagccattcatgactagttccagaattattccaaatacaaggtgatgaggcacagagagtaactggcgtccaggaaaggaagagattaacaaggcccggggactttggtattcttgaactttaggcagccatgaggccaatcctgttgcaagttctaacctcaatgatggcctttctgagctgtaatcactttcttttcttttctttttctttttcttttttcttttttttttttttttgagacagcgtctcacactgtcgcctaggctggagtgcaatggtgcaacctcggctcac

SEQ ID NO: 118068 - DNA, 1004 bp, Homo sapiens
tgtgtaataacctgatactacaaatgtactagagggaaactgagtcagaaccctggtctttggtttctgaggaaatgatgttctcagcaggtggtgaggcccacagggcaagggcatgggtgttgatgccaaggagacctggtttcaagttctggctgccacttactgtgtgttttggggcaagtttcttaacctctctgaacctgcttcctcattattaaaatggggataacagtagtgcttaggtcatgggatgttgtgagtactcacccagggcatggaagggcatagtgcctggcacacaattggtgctctttaaatgtcagccattattattctttattttagactttcaagccagtgttgggagctcagatacagctacataatacctcttttcaacctggttatgtgacctttgcctttcttccttcattacagctgctggccttcctgcaaggactcttcactttctatcaccatggttacgaactggccaaggatttcggggacttcaagacacagttaaccattagcatacagaacgtgagtgggcatagggacaggcttcttttatctggttaaggaaaaacaaaatatgggcctgattgccctagaaaccatccaggtggcttggaatgtaggtgaggagggtgggtcttgcttgggttcagagggaaactaggggcaggcgtttctagagtgcttggtggttctgagttagaccatcatcctcttctccattatttcaaagccctatttatgttctcggaagtgctgctgctggttatgtttcaaatttgtagcgtctgtagcattggagtcaggatttcctttggcggtggaaatcccagcccaacccagcctccattctatgcatctagctgcctgactacatgagaccgtgtggagtgtgtgttctgggaatgggggctggggacacatgctggcctccagctcaaaggatgttctcttgtccaactcttaggaaggctggcaggaaa

SEQ ID NO: 118069 - DNA, 1028 bp, Homo sapiens
gttcctggaaggttgaatgtcctttatctcattttagatctaaggattctattaggttgatctggattgttaaaacagatactttgtttctttgatttgaataaaattattttcatcctagacaagaaatcgctttgaaggcactagatcagaagtggaatcactgatgaaaaagatgaaggagaatccccttgagcacaagaccatcagtccctacaccatggagggatacctctacgtgcaggagaaacgtgagtgctttgactagcaacagcttgggatgtactcaggcctcttacctagaaggtggaggatgtattcagcagtgcctaccttactgtagatacatgcttggataacaagaacaattttatagttcacctttccaaagagaaagatgatgtccacagaatcttgtctacctttgtttttctttatgaatgggaattcctttgggaacctgcaattctttaaggctctgtggttgctcttctctctctaatgttactctactcttggggttcctgtacccctagtccagctttatgtaccataccctgagcatagcagccttggaaaggtcttacatgctaggcccctgttatctatcagcagtgtatcctttggtagacttaatacttggtgattctgttttcatttgacattgtttcagcaaggcccaaacaatcatgacttaggcctttttcctcttctcctcaactcatttcattccaacacttgaattttatgaaaagtaggaacaaaggctcacttcaagagccaagaagaaggctgcatgcggtggctcacgtctgtaatcccagcacttttggaggctgaggtcggtggattgcttgagctcaggagttcaagaccagcctgggcaacatagtgaaaccctgtctctacaaaaatacaaaaagtagccaggtgtggtggtgtgcacctgtgggcccagctacttgggaggctgaggtgggaggattgcttaccggagtgagcctgttgaggtttataagagctcagga

SEQ ID NO: 118070 - DNA, 1087 bp, Homo sapiens
cagctgccctgctgtttctccaagcctatgtggaccctgaccccagggcctgtccacctgctccattccctcctccttattttatttcctatgaattctttcagtttcagctcaagaaagcttttcctaaccttcctgaccaggtcagatctccttaactttggctttttaaaaacagaatttttcatggttataacttttcatttacttgtttaagtgatatccacgtcccccactttttaaagcaatcaatagttgaacagaccatctttatagatttttgctgatatggtatggtcatccttggaacagaatattaatcttcctcctctttctgcatgtatttggtgatcctttatatatccctattccctcccatttctctgggacacctcatgtaatctttcaaagtggaagctggtccatagccattaaatcagatttatagttagacatcagcaaaatcagaatctcttatgtttgggtgtttgcactcagatattttacagactagagaaagagcagttctgtctgagaaattaatctttgctattcagtggaagacaataggtataaggcctgtgaatataaactgtctcctcctaggccttctgtgttttgtttgctcttctgatattagtgggtggttaaattttaccttatgtagccacactttctgttatttcaacaaactgggcaagcttgctaatttcccctgttagtttagataaaaaagattgacagaggcaggagaaacagaaaccctaacaaattcctaagtgacagtaagaagaaatcagggacagcaacttctgtgtttctgggcaataaactagtgctatgagatgaaattgtcacattcagttgaacaatggaatactactcaacaataaagagaaataagcccttgatatgcacaacaatgtggatgaatagcaaagcaattacgttaagtgaaaaaagccagacaaaaagagcacatactgtgtagttccatttatataaaattatagactatgcaaactaatcaatagttacagaaagcagattcagcgattgcttggggatgtactaggaggagggatgg

SEQ ID NO: 118071 - DNA, 1049 bp, Homo sapiens
caggagatacccttgtgccccttctcagtcactgcccatatctcttttcaaaaaaaaaaaaaaaatcactcttctgacttctgttgccatagatgagttttgcaagtatttgaacatcatagaagtggagtcacacagtcacataatcttttgtgtctggtctctttccctcatcattatgtctctgagattcattcgtgttgttgcatttagcagtagttgactctttttttaaaaaaattgttgtatggtatgccattgttcaaatatacaacagtttatccatttatcaatggatatttatttgttgttgtttttgcaatttttggctattctaaataaaactgcaggtattcctgaatgcgtcttttggtggacatatgcactcatttctcttgagtatatatgtagaggtagaattgctaggtcatagggcaggtttatgtttagttctagcagatattgccaaagtagttccatcaacttattctcccatcagcaatgtatgagagtcccagttactctacattttttgccagtattggttattggtggccttctaatgccctctattcaggagggtacttgttatatctcattgtggttttaatcacatttccctcataagtaatcagtttgggctctatttcttagccttattggccatttggatgtcctcttttatgaagtgcttattcaagtatttattgtattgggtggttcattttttcttactcacttgtaggcattctttacatattctggatatgattcttgcaggagatagatattacagatatcttctctcactctggtttgacttttaattttttaaataaaagtaattaagtaattaaattcatcttttgatgagtgtaagttcttcattttggtgaagtccaatttttcaatattttttctttatgattaggactttttgtgtgtgtgtgtttttttttttttttttaaaactcattgccttttccatctcttgagtattttaagacagataaaacatggagaaccacttctatagaaagtaagcccca

SEQ ID NO: 118072 - DNA, 1047 bp, Homo sapiens
gtagattcctttttcagcagccttccttaactattgtgaccttgagatacaggtatgctaattagctgggaaaaatgagtgtcattagcaaattcaacataggccgggtgcagtggctcatacctataatcccagagctttgggaggccagggccagaggatcacttgaagccaggagtttgagaccagcttggatgacacagtgagacgctgtctcttaaaaaaaaaaaaaaagaaaaaaaaaaagaaaggaaaatatatagaggaaaatgtgcatatttgtttttagttgttttctaatgtaataaggaattattaaacttagagactatcagagcttgagaagaccttaatagtcattttgagcacttctctcatttatagaaaaaaggcccagagaaagaaaattcatttttgtgagtcacacaagtggctggtagcacagtctgaacccagagctgctggcccttaattttatgctccattatgtcatgctattatgtggacatttgtacagatgatagaacaaaagcacattcatttattttatcattctttgtcaaacttactagacactcacttcaccaagtatattagttttctgtcagtgtaaccagccaccacaaaatgattagcttaaaacaacctccatttatgagctcatagttctgaagctcagaaatctggcatgctgtgtgtgtgtcctctgctcaggctagaaatcaaggtgttggttagctgtgctttcacctggacttggggcccttttccaaacacatgcctgtgattggcagattgggtttcttgtggttgtaggacttgagtccacagatccttgctggctgtcagccaggaccccctcccagcctctggaggcagcgccatgttcctcctcttgaggctcctccatgttcaagccaaggccagcatgttgaatccaccctatgcttcacatcactctgacttcttttgctaccagccagagaaaacttcctgcttttaaagagctcatgtgattcaattaagcccatctggatatctctgtat

SEQ ID NO: 118073 - DNA, 1075 bp, Homo sapiens
ggattgctggatcaaatggtagttctgtttttagctgtttgaggaattgccgtactgctttccacagtggttgaactaatttacactcccacaatataagcattttcttttctccacaaccttaccagcatctcttatttttttactttttaatataggaaggcttaactcttaatatctaaacaccgtacttacaaaacaaattaggattaaaataactacatcaaaattattactaaatctcagatctcagcctaaatgtcacctgtgccttctcagagaggtgattactcctgattactcttctttataaaattagcactttccctcttcccaacctctagaaccttctatcaaatcacctgcttatcttctgtgcagcccactatgttttcttgtttataattcctctccctcctttagaatggcattctttgaattagaggatctctgtgcctattttattagaatatctgcaatattttttatagatcatcagaaatttaacagagtggaaaactgaaaggtgaagtgttccaagtcattaaagattaaaaagtaaccagaattcacgagaaagcaaagttaagttataatgattttttaaatggacataaggatcaatgggaaatcaagataaagcaaagctgaaattatggtattttgatggacttagtgtctagttttaaatgttttgttttgactgacagaactgaaatgctagactgtctgtttctatataggatacctggcaactgaagtaagacatatgatattaaaatatagccttttaccctgaaggatataacagttatgttgaggagatgaagacataaaaaagataagcatgaaatgtaagtaggcttaatgcagtttcccaaactttagttttctccctaccccgctttcagttttgatcatatacctgtaacatttgttctatttactaaattcttttctttgatttgattcactttctttatttacaaaatttccttttaaaaaaataagtgcgtatcctactacctatatcagtatcacttgctgaataaggaaaccctaaaaataagttaaa

SEQ ID NO: 118074 - DNA, 1007 bp, Homo sapiens
ggccactttttcaggagtcatttaaataggaattgtttttttagggtattgattgatttctaagctggcaaaccagtgtgatggtctggtttagtgcttcctcacccttttttgagtttggaccctttcccacatggtacaggttcttagcttcccctccttggtggggttgttttactgtatctcttgattgcagtaatttacaatttaatgcaaaccccccataaggctcatctaccacaggtggcgctaatgctctgggtcttgattgttctgcaacactccttctgtttatgacacaatctaaactcttttaaagatatgaagccaatctgatatgaatttaagagtgagacactgctcttcttaaccagattccaaatgtctagagtccaaattccaaatgtccggcattttcttttctaggaaatgttttggtgggaatttcaatgcaaacattttatcagagagccagaatgttctgaaggagcagttaacaaaagggaatttctgaattcgtttgctttcatctcgaagtttctctcagggcatacggtgcctgtggagtataagacagggccataagtaatgtctgtcagctgctggtattttccaaatgacccagttgccagggagaggatggcagctgataaatatatgtacatttctttgcagagccttttcttctcctcttctctatgctctgtttggatctcaggtttagagagatgaattcatcacactcccctgttcatggcacattatcagcacaggtttcttgattcattcattctttcgtttcattttatttattcatccattcccttttagttcttttttctaaaatgtgtgtcttttatcttcctgtgttcttgataaatggtgtgtgttaataaatggttctgggtcttgttttatttcttactttgtgccctcatcattgtgtcaggagccattcgtattcctctgtgtccttttatgctgtggcttctgattactgcataatt

SEQ ID NO: 118075 - DNA, 1003 bp, Homo sapiens
taattattagtaatctaatcagcaggaaactcaagttgatgagagtggaaatcaagctctttgtgtgtgtgcatgcatgcacatgtgtgtgtgtgaaaaagaagagacaaagagagatgggggtccccaggcagtgggcaatgtgataatttacactagttccagtttagaggtttagagcagtggttgataacctgtatttcttgaattccttgttggagaaacagttgtttgaaagagattccatttcttaacacagtgttatctgtttataggctgtaaataattatcatcaatatgcaattttaatacattagaggctaacagagttatcttgagctcataatgtttgactttgcaatatgtaaatatcgtatccatttgaacttagacaactaagataaactgagaaatactggattacacatgtcatatgtaagacctttatgtgtaacatctgtgtaagacttaattccaagaaaaggagtttgctggtttcaaacaaattggagaatctctaacgctgggaaaaccaaaggaggaacatttactcagattgaatgtggaggttttgctttgccatttaccaaaagaagtaattgtagtagtgggtaaaattttgattattttctggatgtatttggaagcgtccattttattcttttccagtaaatattacttacctagaaaaggatgcacttcctacagtgccacacacacaaaaaaaggttcaatgactgatttgcctctagagggttatgtccactaattgggctgatggctttacatgcatgtatcttctgaccactggggtcatcactgtcagatgctaggttcttttcaatttttcaaaacttttatcgatgttcagagggtaaagaaatagcctttgtctagggcagaagttcgtcaatgcctagaataagaccatgttcacaagcctactcttgaaacatcctagttcagaatcaatgtctgcagctccccgtagcactgtgtaaaa

SEQ ID NO: 118076 - DNA, 1050 bp, Homo sapiens
tagattctccttgttctgctattttcctgattcctgttagaatcattatcttacctgatgattggaggggtattgtacataatttgagccaactttctggtattcttaaagctttcatttagtgaacctataagcctgcattgatttttcctggttttggtatttggtcatggtcctgggagaagccggatttactcctggataatctgaagcatgctgtggttcttcccttatgactctcatgtttcttctacggctctccttctgattcacttgccttgatataagaggacccccctccacttctgctctgtagtctgatttcattgcctggattataatcttatgacagctctgggtgccccagaaagtagcccccaaaagtgtgtttgctggagtggggttggggggttgcagcatggcctttcccccacacccctgggtggcttgggctatgttgttggtgggcagagggccaccacctatcacattgtttccccagctggattttcctcaggccttcatctaagctttgcctagtggatatcctggtggcaggagaatgttgactgagagcctaattttctgtgctgttaaaaatttgtgtcccttttttgtgtgtttttaccatgatgataaaggactgcaaattcagcatcactgtttttctcgtcctgtaaccttttttgttcttcttcttctttttttttttttaaaccacatttaaagcaaacttagtaaaacagagaacacaatgaaggtattatacagcagtgctgtaaagcacggaattatagtagcatgcttcacccacttaccgccgatccagccatgaactatccttccttactctgggaccttgaatgtctgcatttctttttttatgccccttatttcccataccttttcacagagtggcataaataaaagcaatcaatgacttctttctgaagaaatcaaaatgctttatgatgatttctaagacctaaaggcttacataggattaagtggaaacagcccagactttgaagactggagcctactggagta

SEQ ID NO: 118077 - DNA, 1052 bp, Homo sapiens
aattgaaccatcagacatcgcaaagcaacctcaagggcgcttgtggtacctggcatcctactacatttctctaggccatttcttctcttctagatgatcatctcagatgttgcttttcattccacagagaaaatagatacaatcagaagagaacttctgcaagctaccaccacaatatccacacctgtgcctatgtttctgccatctctcctgtgcgacaggggaacccagtgctcctacctaaaggcattccctttcctgggacactagagccgattgactccccgttggatctgtaaggacttgggtgcttgagtagtttctccctctttcttctacgccattaacttttctgtctctactaaatctttcccatcagcacataagcatgttgtaatttatgcaatcctttgaaacatgagaaaggaaaaagcaacaactacaaagaatctttctcaatcccatatccccttttaggtactatcccatttttctgtgcttttcccagaagaactcaaatagttgtctgtgcttgctgttcccaaatcctctcttcccactcattctttcttgaacctcaggctttttatgcacactagtccactgaaatgcctcattatcagtattgctgatgacctcatgttgctgaatcaatttcagtgttcccttccttaattgctctgaaggatttaacacagattcccactctctcctccttgataagctttcttcacttggcttccaggacaccatactctcctggttttcctcctgcctccttgacttctgcttctcagtcctgtttgctatgccccaggactctgtccttcaggcctcagacctcatctcccctcctgccatcctctctccttcccaatgaggtcttcctcgattgttttaagattgcagtctccagctccttcactccctacctactagaattgcttaattttttcccataaccatgtcagtatctaatatactatatatttgatttgtttactcgttgttttcttctccccgaaatgtaagctccacgaggttggcaattg

SEQ ID NO: 118078 - DNA, 1011 bp, Homo sapiens
ttgcagcactgttcacaatagcaaagacttggaaccaacccaaatgcccatgaatgttagactggataaaaaaaaaaatgtggcacatatacaccatggaatactatgaagccataaaaaagaataagttcatgtcctttgcagggacatggatgaagctggaaaccattctcagcaaactaagagaaggaacagaaaaccaaacactgcatgttctcactcgtaagtgggagttgaacagtgagaacatatgggcacagggaggggcacagcatacaccgggacctaacagggggtagggggaagaggaggataaccttgggagaaatacctaatgtagatgacgggttgatgggtgcagcaaacgaccatggcacatgtatacctatgtaaccagcacattctgcacgtgtatcccagaacttaaagtataataaaaatatatatatatacacacaatggaatattattcaaccttagaaaaggagatcctgctatttgttacaacatggatagacctagagaaaaaaaaaaagagagaaatgaaacttaagataaaagctttcaaaatagcaataccttattttggtgctagtgaaagcaccaaaaggaaaaataaaggtcctagggaaatgggcatattaaaattttctaggtgggaatgtaaattgacatagatctcatgggtgacagtttggtaatatctattaaaaatatttatgctggctaggcacagtgactcacgcctgtaatcccagcactctgggaagccgaagcaggtggatcatttgaggtcaggagtttgagaccagcctgaccaacatggtgaaaccccatctctactaaaaatacaaaaattaccctgcaggtagtggcacgcacctgtaatcccagctacctgggagacagaggcaggagaatcgcttgagcctgggaggctgaggttgcagtgagccgagatcacaccactgcactccagtctgggcgagagagtgagaacctgtctcaaaa

SEQ ID NO: 118079 - DNA, 1051 bp, Homo sapiens
aagtagatgatttatatgtttttatacatggggccagcaagtgaacaatcgagttttatagctaggtcctggtggcctgggtatggagttcagatacatcttttgagtagttgtttattcaaaaatatgcctacgtctttagcaaattactcacagggtcagcgactgttgaccctgtgtgtttgttagactttgagtgtaagtgacaatataaacacagccatatagatgaatatacactagtgcatttttatttctgtttatgccctgtttcacttaatgtgagccatatgtttaatctgatcggcctttaatactttacatctaaagtgctgaatttccttacttggttttaaatatccagatctgcccatttaaaaaattatgtctatttaatgcttatgtttgcaaatgtattaaagccatcaagaggttttacatttgccatggagaaaaatgctaacgattgcagtttaagcagctgccaagtacataaattgtaattaagagggattagcagttacctggacttgcaaaacagggattcagatgttcaaaggttagtaatttggcagatagttgctttggttggttggttgttctaggcaaaatggaaatgataaagcgtgtcatatcctgaaatagcaaaatagcctggatgctgaagatttctgaaatgtggtagattttctgactcctgtggcatctgacgatgacccaagttctggctcctacagatgaggagtctataaataggaagataggaaggatacagggtggttggtatctctgtgtacacgatttgtctcattggtaccttttcttttccttcctcccagtgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaaggtaatatgtaattgatcacttgcagtgaagaatgtacctggggggaagctgc

SEQ ID NO: 118080 - DNA, 1050 bp, Homo sapiens
cccgggtgccctgggcacacctgtttgctttggcagatgacatgtttattcacatggattcctgttgtcacacgggctgcagaaggtgtgtaatgtgtttcttgggttaactatgtgtaattactacacgtgactgaaaaccacgttgataatgtggctattaaaaaatgatgctgtggaaagctggtggcaggaaaaaagttccagctagacccattaaatgaaaacaagccattctaggcgcatacttttggcactatcaccaagtgaacaaagcagataccattaagtatgatgtgagtctgcttcgttaaaaaagtacatgtctgtgtgtgtgtatatgtatatattcctctgtgtagcagatcgattggacatttacacaccaaaatgaatacaactggagcgtggcccatacgggatatctgtgtgcagatgcaaatgcttttctagactttctaaattggagagaaatgcatatttcttatatattcacttggttttaagttattaaaaacaaaactccctaattgcacctttcatgtactatctcaaacccattttgctgtgagtcatggtataaaagtaggtgtgtagtttccttctaatgagcaagaatataagccgtctgtacgtggactccctcagatcccagtcaactgtaagttaacgggaaaccaacttttcctaaaagcaagtctcacatagaaaagagggctgtcttgtgagtaatacagtgtccatttaactctgatcattcaaccccctagtcaacattcatcagaggcccattcctcctttgcggtttctgaaatggtgttttagggccagtcttcctcattgtgcctccacgtctctttcctgtggatcagtgcaatcccaggccacccacagtgacttccccattctctcatgaaattcagttttattggcattttttccctttgcaaagaaaagggttattacaggtgctgcagggagtcagtctgtccacacagaaccaaaatcagaagtcgttttgctgaagataatctgtcaaaggttttaata

SEQ ID NO: 118081 - DNA, 1224 bp, Homo sapiens
atcttctctggtgaggctctatggaattggaggtgggacatggcctgatcaattagagcaatattagaggcaggagttttagaataaaaggtgagtgtcacagaagccaaggggatctgggtgaatgtgaggggtctgtggaggcttttctctactctggcaatctgccagtcaaaagaagatgcaatttatggtgccatagtagggccactcttagaaaaaatcctggcttatattaaaggggagatatatcctgttatgacgaggaaaggggtttgctttaaaatttcgagtcacctgttcccccttgactcttcctttcccacttttaattcttaaccttttctatgttgtttcttaagcttccctgggatcagagatcttgatccagtcttattctttatacatttttgtgcatgtagcaatagactgtccctatgcaataatattaatatgggacttgtggcttttcccccccagaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactgtaagtatgatgtccagctgcctaccccacaagggctttggtcagccattccacctagaatttgctgtctggctccatctgactttggaccattatcccctgaacattatttaaacctcctccctaaactgggagctcagctggcttgttgtgggtttttaaagcatcatcatctcagagggagtcgttattcttaacatactgcttcttagccttggtgatttttgatttactgtcctgctgagatggctttggtgatagctattgcctgtgctggctgctaggcatgaaaagcaatttctgtaagttttacaaacgtccagggactgtagcagctctgtggccgagtttgtttcactcatctatgttgtctcggtttccctccccactgactatgttggaaatgttcaatgccaactccatgtccacttccataaggaagagcccccaggagccctttgtgtcttcacatcctcaaaccttagcatgactatgacttcttgacagagactatgaaagagaagaaccctttttgctttatttttcagcattgagcacccatagtcaggacaattagtttgggggctggttgt

SEQ ID NO: 118082 - DNA, 1085 bp, Homo sapiens
tggtctctataatctcacagctggcctgcttcacttttatacctaatgcctgtaggcccatagtagattaaaaatggccatagaatctttgcaacccctcccattaagagctggagcccttgaatctaggctgacctttaccctttgacttattttggccaatagaatgtggaggaagtgacatcatgtgccttcccaggcccaggccacaatgcctcacagctttctctctcattctcttggaacccagtcaccatgtaaagaagcctgttgtagcctccttaaagatgacggattactggagagagaagcccagctatctctctcagcgcagctcagcattgggaccaccagtcagttgaatgcagccacctgggttagtcaggcaagaccagccaaagcttcccagacaacctatagattcatgataaatatcacattgtgattattggaacccagtgagtttagggtggtttaatatgcagtgatagtaaactgacacaagtcctgtgagtttgtgaccgcggagtcatgggcagctgtcttgggatggggctgagctgtctgcatgaatagaaaggtatggaagagtctcactatagtatagtgcagcatggagactagcctctcggttttcagaatcttcttggaaagaaaacaacttgtaactgagattctaagaaatttgggaaacaaaatttatggctaatggctgaggcaaacaagaaaggtggctcaaatattggaatggaaagcaggaaaccctaggttttagttctggcatcgacattgcctggctgatgatactggtctctggacctgagcatgcccactaccaccatcttccactgtctctggtggaagaaatggggctgatccacctccaaggatgagggtcgttcaatgggtgcttactgagggctgcagaaataaatcattctctccttccacagtgaccagtggggcatcatgccaactcctttctgggagagagtgattttaaaggaggaagtaaacaaatgctgagaaagaagtcagggaatgccccaccagggacataacatgctgcagtaatttccccaaat

SEQ ID NO: 118083 - DNA, 1846 bp, Homo sapiens
ttaaaaatgaagaaaatgttatcttcctacttagccctggacacagttgattcatttaaaaaacaaatttctgggaaaaggctttcattatcagtgcccattacaggttattagagaacaaatggcaaacaccggtgtgctggggctggcctccattcattttaatgacagtgttgtggagagtgcatcttagaatgtgactaagcagaaggaaaagaatctgaaaaggactggccccttgtcttctgtgagagccatgaacatgcaaaaacagtggctcagcagctctgagagctcctcagacacaggccactgggtggtggcatcttttggtggcctgccagaaacagtggggcagccagcatccacctcacgagctttgcaaaagtctccaacttgttgtgacattgtccaaaacctatgagtttggataagaactgtttcttctgccaggaatcacattgagcggctggaaaattccacctcagtttgatcttccagtgcctggttcatatcctgagaacaaattttgttctcaaaggttgaaatgaagtctccatgagctatggtgatgataatggtggtaatgacaatgataattcacattaaggaagccccagtgtcccaggcattttacatgtgtgtacttatttaatcaacataatgccggaggtactgttgtactccacattttgcacatgaggcatagagagattacctaacttacctgagggtagaggtgggatttgaacccaggtggtcaggttctagtactgccccacccacaaccactatgcttagttgcttctgcgggcaatggttgggtattggcaagctacagaagctgggtgtgttgggaaagagactgaagcagcccagtcatgtttcttctttttcttgccctccattctctggtatcgttcaagtatcagatgctgggggagtttggggagacaacaagagcatgggagaataggaagcagagaatgagtacctaaaaacagaggtcagcgggccagagtttaagagaaaaagagaggggaaaaaagagcaggaaatccttgaaaggagctataataaaggacagagaatataaaggataaaaatggattccaaggaggaaaaagaatgggaggaatgtttattgaccatctgctgttgccaggcactagcctagggcttttccatatgttatctaatcttagaacccagttagatgaacaaccactatcaatattcccattttacagatggggaaactgggtttcagggggataaagtgacttccccaaggtcacagaaagcagcagtttgagctgaggcctgtgtgacccccagccaacaagtcatccatcgtcttgagggctagtccctcattcctggccatggtttgtagccctagatgagagccgcacttgagatcttgagatttgacagatacttggagatcatactccaaggaatatggccattcctttgctgggaggcagttgctgtgtacttgcatcacaaggaggagaggggaggggagaggaataaagttttatgggacacctccttacttcccaagtttcaaacttttatcaagccaactctttaaactttaaatatgttgccagaggtgctgtcacttccttaagcattccataactctccaatctcaggtaagctatttttttcccatacttgtgagatttcctcctacatttgcccatttctgccattaaaaacaaaactaaaaactttccctcaaaagctgaccatctgcttgtcactacgctttcttccaaattgaagaggtggtagcaggatgtttgcaagcccagtatttatctctggcgtaggc

SEQ ID NO: 118084 - DNA, 1067 bp, Homo sapiens
aggcacagtggctcacgcctgtaatcccagcactttgggagggtgaggcaggtggatcaactgaggtcaggagttcgagaccagcctggcaaacatggtgaaaccccttctctactaaaaatacaaaaattagccgggcgtggtggtgtgcccctgtaatcccagctactcaggaggccgaggcatgggaatcacttgaacccaggaggtggaggtttcagtgagctgagatggcaccactgcactccagcctgggtgacagagtgagactgtgtctcaaataagtaaataaataaataaataaatgaaatatgacacgtgacaatgaaacagaattgtctttatgagatttatgtcttctcttagccagagattagccaagcatttgttccttaaaaatgaaaagtcatgatgcctgtgtagtgagccatctgctgctcagcagactgcataagagacttgccagccacttctgcttttatatttatgaactgacgttcacttcttagatggtaggaattaatccagtgggactctactttgaaagtaagtttcttatgggaatttacctgcaggcttggcaggcgaaccctttgggcagaatagtgactcccaagcaccatggcatgtttgttttcgagagtttttgtgtccctcctctggttcttcttcctgggagcaccacctccatgctcatatgcattgacatagaagtcctttcaccactgaatgtaaagagccagcctaaaaatgagaaattaatttaccttcgccccagggtagcttagagacagcttttaaattttgatgttaaaaagcacttggaaagacagttcattttggagcctgcggaaggaattactttagttaagggcttaacgtaaacctaagtagcagaccattaggcagaggtctacatttggcattgaaacttaaatttcaatactataatgaaaatttccaccataaaagagactcgggtgtctgattttcatcgttatgcaattttcagctcataatctcagaatccgtaaatgcctttaggatctaatttgcaaagagaatta

SEQ ID NO: 118085 - DNA, 1024 bp, Homo sapiens
ccattggggagctttgctgtgcagacacagtgacagggctgtgctaagacaggaagtaatcctagaatgaaagctctagaacctgagatgtagtactttttctctctttccatttggttgcatgatgatgcaattctgtcttcattttcacttctgtgtggatcagtgccttaggatttagagatggtacaaataccaagtccttaaatctactcttcattttaaaataaaagcagcattttttcaggacaagccaagcatattctaattataacagctaccatttagtaaacactatatgccaggctttaatatactaagtatattgtatatattatctcctttaattatcaccaatcctatgaggtgtaagtattattaatgatccccattttgcaggcaaagaaaatgagggacacagaggttaagttgcccagggtgacacagctaataagtggcagagccagtaattgaaggctatctgaccctaaactcctgcacttaactgttaattcagtattcttaagaatattgttttcttttagaaatctgcttatcaagtatgacaagttttctctgaaaacagataacccatgaaactattgagaagcttccaagccattttttcctcttttctatttaatgtgtatttatgagatcatggaatggcatttcacctgtttcaacagcttctagggcaattcaagcaaattttctggaagtctgcttggtttgtgtcaggcatttcctggtcccttgtgtctgccgggcttgtggaggaggcgtgtggaagcttttttctgagccatccgccctgtggaagccacacaggcaaggccagaggagaacagtggcacaggcattcagaaaagcccagtttcccgacgtcagtttgcctgaggtcaggcggagcaccagcactttctggctcttagaaaatgactcaacccctccaacctgcagcttacccctatgcaaaatcagggctgcccttgcaggactgttgggacgagtcagtgacagg

SEQ ID NO: 118086 - DNA, 1048 bp, Homo sapiens
ttattaattcagtggataagaagcttacacatatttccagagccaaaaagaataataaaatccatgcaaacaaataaaaggttttagaggaacaaagtaatcacaacagtgttttgctactaagtacaatacgtgggggcattcacacttcccagtcatttccagagctgacctagaacacaataggaaccaagatcagtggttcccatctctggttgctcatcagaaccacaaggccagagcaggaatagtattttgaagatatagcttcttaggccccaaccctgccatagtcattcaatttcttgctaatgttaggacttgccattttgtaaagtacatttgattttctttcatttttgtaattttgtcatttgtaatagtccttcccggaggggagtctcccttccttcctatagttttctgggagaatgacagaaaatttgagtatatatagtagagtaccattttgtcatgataaggctgggtgacaatgttggaagaaggaagagctgacagagacatgctgtggggttttggggatgacattgtggaaagtttaccctcactaacatttcaggtaggtatatttgaaagtgtagactgatgatttctgaagggaactgaatgagcttgtaccactgtgaccatgaataccgttgcaagtgaattaacataaatatactgacaaaaagtgagtagaactttagaactgttacatctcaggtagtgaaagtgagggtaacctagaaaaaggaggtgtaataactgtagtatcaaacagtgtgttgcatcctgcaaatagctagagatgtggcaggttacacagaagaagagaagtccctgggctgtttgtttggggcttgtgtagttccccgtttccaaaatggaacaagcgacatactcttttaagggtgcacagagacttcattgaaaaggcaagcatttgtttccctaaacagaatgactttttagctttaccaagaaacaatttcttgcaggaaaagtatgttttgctgttatcagctactactgggaattctgctac

SEQ ID NO: 118087 - DNA, 1024 bp, Homo sapiens
gagccctcagcagtctactttgttgagatctcggctcagatgtcacccaaaagaagttgccctagccacagaatccaaattacacccacacaccctccccacccaggcacctgctttcacactgccttgattttagttgatttcatagctcttaataccacctaaaattatcttctttggttgtttacgagtttattttctgctttacacactcataagtagtatttcctaaattttttccattaggataataattaaaatattatcaaaaagcatgtacttccaataagtgtttgtttttatttacttaattataaagtgtatacctgccttagtaattgctatattacacacattagaaaacataaaaaatataaatgttataagaatcagatatttaaaatgccaataggagctttgatatttttctcctccaccagcctgtgttctcgcccaccctaccttgaagcctactgaacttgaatgtaagctgcctgagagcagagggcttgcttggcttgttacctgctgtgtttccagtgcctacaactgtgcctagcatgtactaggtgctaagtaaatatttgattattaaatatttattgttgagtagtaaacaaggctaaggcacaattcactcttccaggctcctaatagctaaggttttactacatctttggaggacagaaggaggggggggaaaaaaaaaaaaagacctggtttctggggttcagaatgccttcctaatacaatatgtgctgaataaggatttactgtaatgattcaaatccttcaccaaagaggtaattacagcttccttggtaagagcagagctcaggcagacagacaggtggtttctagtttctcttataacagatggcacaaatggaccagcttctgaagctttttgaggaaatttgctcataaacagttttaaatatttttcttttatatcttccaacacatgcttcttaaagtaaaaatgcttcagtagattgcaggcaagggcacatattatgaatag

SEQ ID NO: 118088 - DNA, 1020 bp, Homo sapiens
tcagtggttgcctgtggctgagcatgggagcagggcttaactgcaaatggcaggaaggacctttttggggtgatggtggcattataaaactgaatatggatgatgcttgcacagctccatcagtattctaaaagttgtacacttaagtaaggcagataaatttcatggtatataaattatacctcaataaagctgttttaaactctcccaggagtacaaagcattccttaaatgttgataactgttgttgtttttattattctgtaggtagtgtagacaaatgataccaaaattaagagagaaacattaaatgactgtgtacaccttgcttgagtggacaaatatgcttttcattcattaaattggctcttccaaataattaagtagatcttgggaaaatatatgccacacttttacaagagggtataaaaggattagtggccgagaacagaaatttccaaaatgtgagctgtgtgacactgagatagctgaaatagctttaagtggtgcttgggtgaactttattctatatactaataataatgagatattatttgcaatgggctaaagtagacatttgttaaagagatcaatctaaagaaaatattaagaaaatatgtattaaaattacatgtgatacacagatgtgacaaacgtcatgaaggtgggacactcatgactgagtttgggcgccaccacccagtagccaggagcaagaacaatgccagtgggtggctgagaatgaatactgaaacacaggcattcatccaagtttatgcccaatgtgcctgtctccctcccaaccagaaatgaaatgtctgaatgtccccttccatcgtatttgtcaggcctgtcttaggcaagccgacaagtggccatatgtggagctgtcgtgacaacaccagaatgagagctgtaccgttttatgacatcagataattctgactcagaaatgtctgccttccctgtctgccagcagtcttacccttggtttctggtagatccatttccattctttta

SEQ ID NO: 118089 - DNA, 1067 bp, Homo sapiens
acctcaacagcaccccagatgttgattttgaggttacagatacattttagtaagtaggtgaatttgcaaataaggaatatggaaataatgaggatagactgtatatatccctaaatgcaacattttattgttttgagttcaacttcatttgctcaaccacatttaagtcatttatgttgctgtagttcattttcattgctgtagagtgcaccattgtattaatacacaaaaattatttttttattccactttttctaaaattttgaatttccattttctgcttttacaaataatttgctctacacattctaatacatgtcttccagtgtacacataacacacctttctctggggtgtatgtctagcaatggaactactgggtccaagggaatggtatcttcacctttgctagataatgctacactatttttgaaaatgattgtagcaatttacacccctcctgcagcaaaatatgagttacagatgagaatgagatgtacctcattctcataaacctctggtatttccagcattttgatgttagctatttagtcattctggtgggtgtgcagtaacatctcactgtggttttaatctgcatttcctgcagcacagaaaggttgagtgccttttcttttggattttctcttttaacatccctattcaggtttcttgcccatttcccacttggttgtgttttactcaccagtaagaaatctttacatagtctggttataaaccctttgttcatttttatgttgtaggctgcctttttacccttttaatattgtttttgatatgccctctctatgccctactggataaattccaacccctgtttgggaaccttcagtttctggaattatttcttctaaaatctttattgtttgcctttggcatttaggtctataatccatctggaacacatttgttatgtatggtgtgaggtaggggattctgtcatttttttccatatagatatccagttagtctagcaccgtgtataaaagagcactttccactagtagcataaaatcgtataggcccatgataaattcctaacagta

SEQ ID NO: 118090 - DNA, 1144 bp, Homo sapiens
tctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctc

SEQ ID NO: 118091 - DNA, 1044 bp, Homo sapiens
tatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtacttattaaatggcactttaatgttttcttttaaaataacgcactgttctaaacttcagtattgactattgactcgtgcatagaatccaatgctgtaattagaaagtaatctgtgactagaatagacctttgtccctgttagtagccctgttgccatgttcaggcttttaaaaaatgcttttgtgtcaccaaatatatctataaagaaaacaaaatttctgttcagaggcctctgaaacttggctttcttacatgtggttggtttatgtgacaatccctatgaaatgagtggacgtatgatttttgaattaaatgacttttccatttggtggtattttcttgagtttctgatagagtttgactcaatacatgctttaatatgtcttcaaataagcatatatacatgatgatcaaaggtcacaagtctcggctcctgcggtttttggtgacaaccaccgtgcttatttctgatgagctctgagaagctttgctttccatttaggaagaggtcagatgctaggaaacttgagaatttgctcctcaggcatattaaacaattgagcccgaagagtcatagtccacttcacatttctaacgttcttctcttagaatacatattgttttattc

SEQ ID NO: 118092 - DNA, 1352 bp, Homo sapiens
ctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaac

SEQ ID NO: 118093 - DNA, 1028 bp, Homo sapiens
gtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaaca

SEQ ID NO: 118094 - DNA, 1084 bp, Homo sapiens
atccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactacaaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaa

SEQ ID NO: 118095 - DNA, 1997 bp, Homo sapiens
ttcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagataaagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctctctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccatt

SEQ ID NO: 118096 - DNA, 1090 bp, Homo sapiens
gaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtct

SEQ ID NO: 118097 - DNA, 1056 bp, Homo sapiens
actaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatataagcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatt

SEQ ID NO: 118098 - DNA, 1052 bp, Homo sapiens
ggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggta

SEQ ID NO: 118099 - DNA, 1540 bp, Homo sapiens
tttagaattgtactaaaagcaaactgttttcttggatatttgttctttctccccaaaagatgatttataagttttcagagctaagaaatgggaaggaagagccatcctagcatggcaggtaatgttttactgctaacaggttttctctgcactgctttatttgccttgaacctcttactttgttctgtcagctgggaggctggtagattttctattaggtagcaaatgcttctcatcactaaacacatatcatgggctggtgttagtgcagtctgtggatgggcactacatttttaatcaagaaatgtttttaaaggaaagacaaattggtgaagtaatttctaattcagtattttagggatgagtgaccttttaattgataatgatatttaacagagctgtacagtgctttgggggtcccacagacatgtttaaacaagaaaacagtaaataaggaagccagaaggaaaagttataaaactattaagaaagaaaatgaaaattctaaacttcaattctggtgcctggctaaatttgatttttgtatgcctcagtgtttctctatggacactgggaaatcaataagcaacctagctacgttattatgttcgtaagtggaagaactaaagaactacaaagacatgttctaggccaagaattctggtggtaggtagagtgggaggttaactagatgatctccaaggtccttctaattgcacttggcagcagcaagcatttatcaagctagacactgggcatatggagatgaagaagatgaatatccccagcagcatggagagcactctgatgatagtcatccctgcctccccctccctcagtttgctttttgaaatgtgagcttgaaagatctcaaactccttcctgggaagacataactgaaacttcatggaggaaagtgcatgaatgaatgggaaacaagatttgattcaactatttggaataagaaaaggggcaacaaggagtctgaaacaaatgaaagaaaagatggaaagaattagttgactagatgaggactgagtacataggaatgagccaacaggagacttcagcaactaatggatgaaagtattatgtgcatgcatgttgtcatcaaatatcacatgatacaagacaaggagaaaacatgactttcaccataacctcagtttgtgtaccctagttgcaagatatttttttcttctagtcacttaagaatatccttattgtctaggagaaataatcctctttctgggctccccagtgtataagcccaaatctgaggaaaatttacctgaaatgttctttccccagatacccacatggtttactctctcatttaaatgtcagctctgtaaaagagatctctgactgctctatctgaaatagtagaatctttcacagtctttccttcttcttgacatcatctatttgtgtcttatctgctcacctgctacaatgtaagctccatgagagcagtgatactgtctgccttgcttactcctgtatgccagcgtctagaatagtgtctagcacatagtaa

SEQ ID NO: 118100 - DNA, 2167 bp, Homo sapiens
atttaaatattaattacatcccaatagagctgcatgcttaaacatgctttttcagagtaacccaagtattaatttcgagtgcttttaaatattttttctttttagcaagtttcaacaacattaatcctgtctataatgcagcaagttcagtgaaagtacctgttgttttataatttttttttcattctcactgtagggcaccaaaaatatatataaggggaaaaaagttttaatgatatgattagttgtaaatgtttacgcattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataagagcttccttaattttaagactatttaaattgcagattttgcttttttatttttttaaccatcccttccaaagaatttgatttagatattcagtagtagaaacagaagaaaaatactcaactaaaagtccaaagacctagtttctaatgctaagggagacagtccatggcctccaactaggtactttggagtcaaaaatactttctttacaactgtgtttgaattgttttcaaaacacctgtgtgtgtgtttctaaaattccacaatccttttaacccgtcaatttgatgagggaagtaattagggtagggaatggtataacaaagttggttctttgacattttctttatagattatcgaatgtaagacaaatagatgtgaatgcagatttggtgtttttataagataaggatttaaaataatgtagttggtgatatataaaaataaactattgctgctgttagcacccgagaggtggggctcttgggttctcagagcttgttttctatgttcgttacagttattttagattagaacttaaaagaacttgagagtttccctaattctaccccctaattttttcgaatgagaaattgagatccatagaaagtgttgaggtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagagaaaaagaaaaaaaaaaccaggaaaccttaacacttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagc

SEQ ID NO: 118101 - DNA, 5249 bp, Homo sapiens
acgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatttatatgtgttctctaaagattcatgtgcttttttatatgaataagtttaagtggccttttgaaagtaggaaaggtagacaacctaagtgacatctgtacgtaaccatttcaggttttttccttaaatagtggttttcagtatcccattggccaacggtgaggattttatttaacatttttaaaataatgttgctcattaacagatatcttaacgaaaaattatataaattcaggagagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaaaaaaaaaaaaaaaaccaaaaaaccttggttcttacatgtcttaatgtgaactacctcctaatctattgtttaaataattatcctttatttagaagaacactacttcaacctgagttgaaggtttaaaatcttttcagtaaggagatttgagatctttattattgcataagctgttgtgttttaaatgctaaaagacatgctgtgttttaaaattttcaattgcaaatttttggcaatagaattcgcatacttggttttcttaaaagagttaagtacggttgatttgactaagctatctgtaggaaactcttaaattgatttataaaacatgtaattatacaaagaaaaataaaacatcttaggaaactcttggggattattaatggattttgccctgataatcatcatggcatggttttcattttccttactataaagaaaaggcaagggacaaaacttattttccatttgctatgaacttttaaaccctataaaatctgggatatagagtataagtagatgaacatagttactcttaaatcactaaaggtgattttaatgctttaacttttatagtacttcatgacataaagtatctttacgtatttttaatttgggtcccataaccttatggaggtagtaggcaaggcaatgatgatgcggctctttagaagttctttaatatcaaatgaaattattatttttatgccaatctgtgattgggaaatataatcagtagtctgtgtcctaacaagaaggtataatactttatacagggtattttgttaatatttgaagattttataccttatggcattaacttagcactgggaactatgattacccaaaacaaagcttcatccaaataaattgaaacagtgtttcttttaaaccatcattgaattagtctattgtttccaaacaacagccctgatatagctaaaattagttgctttctcttctctatatgttacatgactgtagccaaacatttgctatgaccagtgaccctgagtgatcagcaaataatcaacacattgagaccacaacttgaatactgaccttctgactttacgaagaaaaatattaaatgccactaataacttgaattccttttaaattaaaaaaagttataaattgcaatttgactttttaaaatgccacctaaaattgtttttatcagaatacttaaaaaaaaatcctcactttattctctgggggtgggaagaggcaattccttccttccaccacaacattgaattatcacataaaattgtaaaattatgaatattatgattgagcttagtaaagcattttctaagttcatttatagtaaaacaagagaaaccttattctcaaaatctattctttaagtaaaacaaactagtcattctaacttaatatgcttttaaaaatactgaagttcagtacatttagcataaacttattgacgaaggcacatttctgcattatttgattttcagccttgtttcatttaagcattaatgacagaggtagagaacagaaatggttttaggtggtattagagcttttattgggattatgttgaaattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctaccttttttctttttcttttccttctaaagattctggcaatgggtgtttcagtgttttttaagcttaatatttctggtactcatttatgtaaagtgatttctgaatgttaaaggagatttctttttaaatatattttcacttatttttagctttatgatgagaatcttattttttaaatctgtaacttgttatggctacatgattagtaaaaaaagtttttaaaacacactgtgtattcaggtgtgtcattttagtgtgaaatgactaatgcagaaatatgtgactagcatgtggtcagattttattgaaattacttacgatgtttctatggctagtccccttgtatttttataattggtaacataattcatatgttattttggtcttgtctatttgtgttacatgtattttagtctgaccacttttgctacttatttaatgtttatacattttatgaaagacttattctgaaatataccttgcataaatgtaggttaaatgcaaattgtattaatagtgaaatggatatgtgggtagagatcactttaggggccttttgagatttagtgaaggaaagattggatcaaaagggtttactttaatgtgactgcctaatgtgaaagtcggaacatctgcattaattggttagttacataaatcttagtctactctggcctgcaggtgactgaaacagcccaggaaatcttaatttacattaagcttagacaaggtctgaggcttaggcttagttcttaaagcacattcttttttactttaatgattattcctaattttaatgagcagtgggttctcattgtgtactagtacttaggtgggcaaattaaataagcaaaataggtttgtgctgaatagcatttacccttctgaggacatcctggtaatattttcatcaagagtaattgtgtaatgcaatatttacaggtatttgccagattaatgggcacttgttttcatatttctgagtcatggaaaatatacattgatgattcctgttgcataaagagttttcaagaaaattttgttgaattaagctataactacaaaaaaaaatccattacatattgacctttagaaaggatttttaaaagcccatgctgtccttatttctgcagcttcagagagccgactgctcttattttcttctggcatattctattaatacttgggttttgtatttttcaagtaaataaaatattcctattgagaatttcaattttaaaaaagaaaaggtctactaagtgttcctttccctgttgaattatgtgtgatcatttctatgctaaactagattagggtgtgacttgtgatggtgatttttgttcattttacatattaagaaagaaatagaattttattgcagttcaaaattatttgtagacagtggttttaacccccagacacctaattgtgacaggttgctttccttagtgctcaatactgttgtaaatgtctct

SEQ ID NO: 118102 - DNA, 1003 bp, Homo sapiens
tatcggaagcagtgtgccagtaacaaggtttcaaggttgttggaaacgccttaaggaagaattgctttatgtgctttaatgaatacataagaatgatgtcattaccctgccaagcatacagtgtttgtttttatacagtctgaataaaacctagcctccccactctctacaatctaggctatcattactttgcacccctaatgaagaaagaattaactttttaaaaaattaactctgcttctccaccatccaaattattgaagtttgaattgtagtacattactaatacttgaatttcagtaagttaatttgttcattaataattaaatatccattttgtaactgggcaataggtaaaatgaaacattaaatatttaaattgtcaatttctatggattggtagagtacttaaacttatgttattattaacaaatatgtatcttaggatggtgaccatcaaaaccaaagaatgcagtttgatagtatgcagttctgattttgcatcacaggtggaaatatttctgctgcccttgagcacaaagttcctactctggttaatgaagaacattatctgctgatggagcacaatgtcctgtgtttgtgtaaataaattaaaatgattacatactcaaatgaggactaattaaatagagagctgttctaatttaaaagcacaaatactttcttgagcacattaggttccaaaaatcggatattacatttttttgtgagcttaactaattaggcttaccttgcatgtatgaatttggtttatttctgcaactagcactaaatctgctgattgcttgcagagtgattaattatgcattaaggtgttttcaatagcttatcagcacttgtggcacacacatgaataaagaaaaaaatgagaaaacaaataagtactcagcagaaacatttaacatgcttgtaaattatacttttaatctagttggatgacttttattttcctacaaacagaaaaaatagttattttctattt

SEQ ID NO: 118103 - DNA, 1256 bp, Homo sapiens
gtctgatggggggcaagggtgctacttatatcttatgtacagaggccagggatgctgctgaacattctgacagtgcacaggacagcccccacaacaaagatagcatccagcccaaatgtcagtagtgccaagaatgagagaccttatatttttaaaaagtaaaacatagttctaaaaaagctgtttatcccatgaaatgattcaccatcattgaatttactgtgaggtacattttagcatttgaaaaaaaaaatcctgattatttttgcatatgtctacttgcagatttaaaatgtaaatttaaaatgctttagaataggttattgtagtattcttacataactaatctcatctgcttttttttcttctcccccctttttccttgttgtttacagaggaatggtaggaatcattctcactgctgggattattggatggtgtagtttttctgcttccaaaatatttatttctgcattagccatggaaggacagcaacttttagtagcatatccttgcgctttgttatatggagtctttgccctgatttccgtcttttgaaaatttatctgggatgtggacatcagtgggccagatgtacaaaaaggaccttgaactcttaaattggaccagcaaactgctgcagcgcaactctcatgcagatttacatttgactgttggagcaatgaaagtaaacgtgtatctcttgttcatttttatagaacttttgcatactatattggatttacctgcggtgtgactagctttaaatgtttgtgtttatacagataagaaatgctatttctttctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccgggcgtggtagctcacgcctgtaatcccagcactttgggaggccgaggcgggcggatcacaagggcaggagatcgagaccatcctggttaacacggtgaaaccccgactctactaaaactacaaaaaaaattagctgggcgtggtggcgggcgcctgtagtcccagctactcaggaggctgaggcaggagaagtgtgaacccaggaggcggagcttgcagtgagccgagatcacaccactgcactccatccagcctgggtgacagggtgagactctgtctcaaaaaaaaaaaaaaaaggagacac

SEQ ID NO: 118104 - DNA, 1023 bp, Homo sapiens
aaaaatagacacaatttttacattttcatttgttgacctcctaacctttaacagtttgtaaaatgcttagtgctatgtaagtgaatattggtatcattaagaatattttctataaaaattatgatttttttattgtagataataagcttgatcttagtgatcatttcaaccatgatttataaaaattggcaaagtttgtacctgaggaatttcacaactaaggttctttagctgtcacatgaaaatttaggaatttaagggatattaactgtacagagttgaaatacctctgaaaaatttaactttctttcatttatagacagtatgctggctatgactattcgcagcaaggcagatttgtccctccagacatgatgcagccacaacagccatacaccgggcagatttaccagccaactcaggcatatactccagcttcacctcagcctttctatggaaacaactttgaggatgagccacctttattagaaggtaagatttgttgcaacacttgatagtactcaatagtattcagctggttagtgaaaattaatcttaatttggagaaattgtcttttcctttaaaaaaaataatctgtagaaaaaagttttctgctaaacaactcattttaaacagagtatatgcgaaaccacattgggccagaggggaccagatttttaatagatcttttaatagtgataataaagtatgttactatgtcagcatcgacttttacttcaggttattgactaaattctgctagtgggaaaagtgagaagaaaaagtgtgctatccattattctgtgtggaaataaactggcagaactagtgacatcactaaaaaaatggtgattttcaaattgtgttccaaaacctaggaagtggtagttctgaactttttttttaactagataactctttgaaaatctaatgaaaggtatgaacactctcctcagaagaaatgcacacatatgcatagagacgtagttttgtatacagttaaatgggcccccgggtattcc

SEQ ID NO: 118105 - DNA, 1621 bp, Homo sapiens
atagggtaaccatctcattaggttgtaaagattaaataatacatacaaacactttagcacagtgcttgaatcacagtaaatgctgacaccgaggcattgtaggcattgtagtttgtggacaggagaggggactccgtctgtctcattttagcgcctcccagtcttcctccatcacctaggtctgagaaactcctcctcctacctacgagtaagcagcaattgctacgcctgcgctttcctggttccacccctaaccaggctgccggaagcactttcctctttggcacgggccagccgcaggttgggtagatactgcgcaagctccatactcgtgtctcctcctcccgcccaccggtgcccaacctgctaacacgcctgcgcgagcgggcgtgccccggaagccgttctttggccctgtgacacgtagcaacggggctggttcagggtctgaaacagagtttgggggttgtttgggattagtgaagctactgcctttgccgccagcgcagcctcagagtttggtgagtgacccaggcccgtggcacagtgttcagcttctctccacacccgtgcaaatgggcttgttgccgtctttcggcgccgcgccctggtcctttcgctcagaccctcgctctcattcaagcccttgccctgacgcggtcccctgcacctcaggcgcgaccttccagattctgcactttttcctggcaggccgcaggccttattttgcaaggaagcagtcgccttgtcagctgtaaagcccagtcctaaggtgaaaaatcatctttgttgttattgatattttagaccgcttatggaaccacaactcccacgacctcgcccctaatggaaggcatatcagctctttaaggtggagttgtcttactgggccgcaacttaaaagaatatacattttcttactctctctccgctaccgtcgttcaaatgctgcgtactttccgcccccatcccctctccgaattactgaaaaaatatttgttgtgtttctatttgcttaagcagactgccaggaacgaattcagtagaaccttgggcataaggaatatttgccatttctcttttattacagattatttgcaatgtcaggctttgaaaacttaaacacggatttctaccagacaagttacagcatcgatgatcagtcacagcagtcctatgattatggaggaagtggaggaccctatagcaagtaacttttcatctttggcaattaatttagtctacattgcagtgaaaacacatatttagaatatttggttctgcctaaaacaatatgtgaacatgtcctttatcaggagtatgatctttcatgcataatcttcttcctctagagagatatgtgacactggcttggcttcgaaggtattgttctatttaagagttgagtgtcttctgcaaactcttcaggtgtaccatgaatggaaaagtagcttgtttgaagaactgttttctagtaacagtatttctgtatttagaagatgatgggagcttcaggtacctaggagataggctgttagttcataggaccagtgaaaaattaaagtattttgttagtagttaaatcagtccaactctgagacttttatcagtgctaattgaa

SEQ ID NO: 118106 - DNA, 1103 bp, Homo sapiens
cccgcatccagtattttcccctttggatctatcctccttgctgcaaatatgatgagatttctaaggagtgactgaccatgtcactcctttgcttaaagttcataattgtcttacaactgctcttgtattcaaatacaaactctttaacatgaaccacatccttttgtgaaatcgcttctgcttccctcctcagcctctactgttgccattctgccctctttgcatttataaccttagccataacagatcttttttagttcttggatacttttgtgtacttgcatgttcattttttgtgagtgatgttccctctgcctggaactctgcctccatctgctttggttagctaaatgttcagtttcccaatccagaagttacttcttctgggaagactttcctagtccaccatacctggattaggtaccccttatctttgcctcttaagatcctatttttctatatcacagcacatataataatgtattctacttggttatttacctgtctttccaactgtaagctttgtgaagccagaagctatatctgtcatcttcattattgtacctgattcagtgcctggaacaaatgtaggtatagtactttataaatatttctttagaatgcatttttaaaagttcttactgcaatattctgttttggtcatagatgctactgtcttgaatatactattgtattgtctcttaatagaagaactggagggcagtgatggtttgattgatgctttaaataataataataatgttattttctaactttcactgagtgctaagcattttacatactagttggatttctcactgaaaggtgctctactcttcgcacctgcgcaaagattctagctctagggaactgagaaaaacacttaccagcagcaaagactcctgtggtctccttttagttggttcatccaagcaggagtaaattgaagctggatgtgaccagggtttaaggagcaacccaggattcagaaaagtgctgcaaaattgataaatatccccaatagaaaaagagctctactagaaggcaactgtactgtgagaccgacaaggttgccttcttaattttcttactgccaaagtatt

SEQ ID NO: 118107 - DNA, 1397 bp, Homo sapiens
cacaatggaagtgattaatagatggtttcctccccctatccctcaccttgatttcaacctgtggcttttcggaacctagagtaatatatgatggatttaaaaattaagaatacaacttaaattgtatatctgatcactgtggaattagaataaccttttgtgaatatcagcctagagagtattccctttcatggtgacagaaaatggttattgagtatgtcactgacaataggatcattgaaattgctccagaaatgaaaacaagacattttgcttcacactgtgagtagctgtgttatgtggcattcaaaggaaataagattgctaatgggatgggagtctgttactgtgtgacccattcaaaaactgccccgtgtgaagaaattcatacttctctccttttattcatcagttccattccagagaagaaagttataataatttcctcagtcaaatttacagcaactttttattctgagtaaatctgatataatctgattaggagttagttgtattgatgaaaatagaaagcaactcattgaacataatttggtggcaaagttaagagactgtcagccgggcgcggtggctcacacctgtaatcccagcactttgggggactgaggtgggtggattgcctgagctcaggagtttgagaccagcctggccaacatggggaaattccatctctactaaaattacaaaaattagccgagtatggtgacgggcgcctgtagtcccagttactcgggaggctgaggcaggagaattgcttgaacccgggaggtggaggttgcagtgagccgtcatcacgccactgcaccccagcctaggccacagagggagactctgtctggaaaaaaaaaaaaaaaagaaaaagagagagagactctcaggctgtttggctgttttagacaacattgtggactgtccaggtcaacaatgagaaaatagagaaaaggacagctaagctctggtagtggtaacttttttgtaaaggggactctggagcagcacagaaattctagtaattagactaaaggaaattaggcatatggatattaaaatgtggcagaggcatggaattaaaaccaagggaattctcttgacttggagaagagtttcagagttctgaagctaccccaaacagagaatgagctggatcacgttgaaaagcacatcaagcactggtcaggcatcagtgctaattttcttatggcttaagcactcatttacatcagttaaagacattttcctatgggcatatgcctgccaaattacacagtaattcaaatggaaggtagaatccagtttttactaattttctttctagtcaactaggtgagatttttttttccttaaatagagggatatctgtgtggagttgttcaattttg

SEQ ID NO: 118108 - DNA, 1071 bp, Homo sapiens
tctcactttctcttccccaccttttgtacctgggcaagaattctagatgaattgttcttcttgtggataacttagaagaaaatctacatatgtgaataatggatttcacatctgtctatttaatacccaaggaaaaacagctgattagaatataaaaataattgaattgaatttgctcatgtcctgaactttgaaacctgatttctgtaacttatatggtttcagatcacctaaacgcaagatgtgctttaaacgtaataggaatggaaatgagattataagagccaatctggaagatgctattagatgtatcagatcaatatttcctttgattctagctccgcttcttttacacgtttgagtttcttcttcatttttccttcataaaatgtttagtaatacttttcttgctgtaggaaaagtaaaactatactaccatgggtgtgcccctctttgatttaaatgctacatcagcaagaatgtgtttggctgcaagtaagaaaaaatacagccaaaacagctttaagcaatgaaagatttattgactctaagaagaaggtctgaagtcaggatgggttcagggttggttaagcaatgcaatcaaggacaactctacaaggccggatatctctccttatagtcccaagttggctacagaggttcagacatttcatcagatatatactacatatgttgcagaagaattgtacttcagtaggtctccttttaatatggagtaaaacactttcaagatattcctaccatatcccagcgagagataggactaactagatttcctaggctaagaatccctaagcctagctgggaaggtgatcgcatccacctttcaacatggggcttgcaacttagctcacatccgaccaatcaggtagtaaagagagctcattaaaatgctaattaggcaaaaacaggaggtaaagaaatagccaattatctatcgcctgagagcacagcgggagggacaaagatcaggatataaaggcaggcattcgagccggcaacggctaccctcttttggtcccctccctttgtatgggagctctgttttca

SEQ ID NO: 118109 - DNA, 1101 bp, Homo sapiens
ttattgaatacttattctgtggcagtcactcttctaaatagttttgggatattttcttttttaaattttacgcaaaattaagtaagttttatgtaaaaattaggttttattactatccccttttaaaaatgagaagattgtggtgaagatagtttaagtgacttgcccaagagcaaatagctagaggcagtagagcttcaaacccagcttttctgaccccagagcacattcataggtgatcattataaaaagtgaagagacaggcaggtttagcactgcacagtggtcaagtgtcttcaagcttaatagtatcactttatgaatttcaaagtactctgggcaggtgtcagggagaagaaaaaaatgaaaagaaacaaaaggagaaagagaaataagtttaaaacaagaatatatgttgtcacagtaagtgtgtaataaatatttttgaatgaagtgaaatatgaaagacaaaaacaaaggaggattttatggcaggtggtagaagatggtgttcaaccatgactttgggttctatctttggtacagaagaactacagacttcaagtatgattgcttttctaggttgcagcttcactcatccctggctatatctagacttgttaacaaatttataaatcttcacccactgatttttctttctggttagaatcagcccaaatgacttttagcttcctgaatacttattatcgtacgtcaaatacagtatcaaagaaagaataacttaactgtaaaacaccctgtttttctgattctagctctgacattcaacatccttggaaaaatcagttgctctagtgtatagaatgttttcaaattgcatgagagattatgccacagttgtatgtgatgaaaacagtttttaataatttgatatggacagaatgattaaaaagcccacttggcctcttctttcctcattgttctgtctctttaaacttggatccctttgggttggctgtaagcagtggaaaagaaatgcagcctatagaatgagcagcaggatattgtggaatatggaaatcatttctatattgtacagggaaatctaattacctctatcgatcattcatccagtctttc

SEQ ID NO: 118110 - DNA, 1016 bp, Homo sapiens
agcactattcacaatagccaacatataaaaccaacctaggtgtccaccaatgaataaataaagaaaatgtattatactgtatatacacaatggagtactattagccttaataagaaagaaatcctgtcatttgcaacaacatgaagctagagggcattatgttaagtaaaccagactcataaagacaaaaactgcagtatctcacttatatgtggagtgtgaaaaagtcaaacagagagtagaatggtggttatcagaggctgtggggtggggaactggaaagatattggtcaaaggtcacaaaatttcagtgagatagtagaaataagttcaagagatgcactgtacatcagggttacttctgttaatcacaacatattgtatatagaaattgctaagacagtagattttaactattcttaacaaaaaaataagtatatgtgttcgtgcatgtgttaaatagcttgatttagctatctcacaatgtatacatctatcaaaacatcatgttgtatacatcactatatgctatttttatttgtcaattaaaaataaagaaaataaagcagaggcataatatgataatgtcctcttcttaggattgcaataatatcaatggcaaacaaactaggactgttgattctctaggcttggggactggtaccaaggataagagaagggaataagggcagacatatgaagaaaccgcaggtgataggacattgtgaggttcattcatattgaatacgaagtggggatgtactggcagagaatgataactgaatgaatactagggaataaatggtgtcagctaatactcctcccaccccaaacactggtgacacacaaactctgtctctggttctctcccctgaaactggtgctacttggaaaagagtttcattccagcttgtctgccctggaactctttgttctctggtttccgtggttgcagaatctagcaaattgaacacagttcctacagagcactgaattgtggatgttaaaatttacga

SEQ ID NO: 118111 - DNA, 1014 bp, Homo sapiens
tttattaagtatgtcatttctatgcctttgttatattcttgtgtaatttaaataagatgtttaaagtgcattaaaatcatctcacatgtgtcatcaatggcaggttaacttcattagattagccctagtcaaggcaacagaatagacttgtgtttttcaattattcaagtaaacagctaatgtaccaggcatggattgagctgaaccaacgtgttatttggcctcttctctctgcttcactgcatatagacagatggttgttttgtattaaatgactttttacaatgcattaatcttatgctaacattcgtcataggagaaaatgcaagcatccgtgaaatgggatttggcgatattaattgtggcctttctcttagatgccttggcttcagagtgaatattcatttacaactcatggagaaagggatgcatcctggaatactgacgtttggcaattgtcagatgaactttctgctttcagcatattttgtgctcaaaagtagattctttttattatgaaatgtttgaggcaggtatatgccttttacgactacccatgtcttccttctctcctgcccataaggttttcccatttttatgcctgctctttggcctaactccccacatgttcccatggatgacaagaaagatatgagagggagtctcttttcatatttaggctgtgtttacacattgggttagactttggataaagattggaggattagtaaatagatatttcacgtactagaagaagaggggcttacttgaaatgggtttagaattgtaataagatgaatttaggtgtcctataaataagctttgtgactatagggactgtgagagaacagagtgcattactgatggagggtttgggagttacttttggaggatatctttaagaatatcattataatagattaaagacaaggagttcatttgggagcttgggggcatgttccagtcctaaatatggttgttattttattttcaaaggtaacatcttcaacaagt

SEQ ID NO: 118112 - DNA, 1053 bp, Homo sapiens
ttgttcttatgtttttcatgtaagcttgttgccactcagagatattatttccagaaatgtgtaaagacaggatatgataaaacagatacgtgtattagattggcagaaaaactaagttaagagcaaggcaaataatctttaatctcttcttttctacagagctcaataactattgacttgccctctcagttgattggaaagggccctctgttgtgaactgagtgtagctagggtgtgtacttcatgccttccgaatggcagctccatcactaaagcatcccagttgcacagtaaccaattccagggaaccccaaatactttcataaagttagtagcaagaggagtttcttgagatttctaggcattgtcaaaatactgatgattggtcatttaagactggtatattttttaggtagttattgaccactctatgggtagtactgtggatagtactgtggtactatggtcacatttgttctctctttctctctctttcatttgtacagttcctactttagactctgtatatgctcatgactgtgcagtccattgtaaatactcaatacatatttactaagtgaacaaatatgtatgtctgcaatgacagggaacacatttccatctttttatattccctgaatttcttagcttaatgcactgcttataagagacgcttagttaatgcatgtaggtgaagaaaaaaagaatgaaaattggcacattccagagtgctttgatggtttatttggtaaaacaaaaaaacaaacaaaacaaaaaaaacagccattcctcaaagactcagaactaacaataacaactcaggctccatcagtctgaatgtgctaatgcacatgagagtacttggtaagctttaaagtggtattattgttgttgtaaaagacaactccaggctcacccaactaaaatagcttacatctgtagagccctttaccaattacaaagcactttttttttttgagacacaatcctcctctgttggggtacagtgcagtggctggttcatggctcactgcagcctcagtctcccaggct

SEQ ID NO: 118113 - DNA, 1142 bp, Homo sapiens
ctttatgaagacacagagctaattaatctatgtcaaattgttttttaaatacttgtcttttggtataattcaagttcactcttgcaggaattaatcactcctttgccatttgtaattgtcgacctgacaggcatttactttgattttttttgtagtataaaaagtgtttatggtgcaaaattaacattgttagacaaaatgtcaccttttgggtgaaaacactgagcatttttacctcttggtgtcaactcagactcttctgattgatgcatggagctattcctggagaaaggctccagctggtcaagtattccctttgctaatattcagaaacacacagcagggttacacatgaggcctagggggtatgtgtgtgtttgtgtgtgtgtgtgtacctccatgtacacataagcttgtagaattggctggacaaaaatacatataaacctttcctgtcccatcgactgcaactctcaaaaacattcaagtacgatcagtttaaaatctatttaccaatcaactcaataagcattaattgagcatactatgtgctcagcactgttataaatgccggcatagaaagatgaatgagaacctcaaggagtgtgtggcattgtgaaaatatgagccaggtaaatgagtatttgaaatcatgagatagtgtcacagataacgataagagcaggtaacagcatcagctgcaatcagggagggaggggattcaagcaagcatcatagaggaggactcgcttgtgataggtcttgaaggatgcattcatcaggtggccagggtggtattccagacaaaagaagaaggtggtcaaaggcacagaggcatgaaacagcatggagtattcagggtattcagtagggtgttctgtgctgctggagacaggatcctgaggtgctagagaagtagcccttcttctggtcaatcttgggctccatgaaggaacaactgaggccaaccactggctgtcttttgattaagatttttggactctgtgaaaacccaggagtcttaggtaattttttttttgagatggagtctcactctgtcgcccaggctggagtgcagtggcgtaatctcggcttactgcaagcttcgcctcccaggtttaagcaattctcctgcctcagcc

SEQ ID NO: 118114 - DNA, 1151 bp, Homo sapiens
cattaggagggagaaatgcaatttcaagaattatccgtagtgatagaattcaagtggactctgaagagttgcttcagaaaagagggcaaataagtattgattggtgagacatgtttatgaggtgataaagcctgtttgctttctcttgcaggagagctgtatccatgtctacttatttatttatttattttttttttgagaatcacttcttggccacagcacatcacagacacagtttctggaatacaggtttgaggatacagtgttggcagcttcaagaagagaagaccttcttgccaggacataaaatgataccctcctctgggagcctgcttcgaatagtgggactcagggagataagaccttcttgctggatttttatgacacaatctctttataattttacaaataaaggaaaaaagaaccatgtaagatatgtgtgcccttcctcagggtgttctgctggttgtctgatgatggtgtcagggcagctaaggacaggataaaggcctggagagggtgcttgtgcccttatgttatcagcaccgttgttcctaggattcgtgaggggattctggaaccaataagggagttgaactggtacctgattcacgggtggactggaacaaacaggaatgtaccagacctatgttgaagctaagccgtatttataacaatgtttaagattctcagaaatcaggagatttttatcctatccataagtaatatgtaactgccataagtatagcttttagaatgtaatatgtaaactgtgatttggtcctctggaaaaaaaaaaatgaaatgaagagtgggaaggcagtttcttttctgctaattcgttctgtgatggtgagcaagcaaatcattaacctctctgttttttattgggcaaatggggataatcaggcacaggtctttccgccaatgcgttatgatgattaaagaaggtaattttgtgcagggttttaagtcaacagacagacctgggtttgaatccaagtgctggcacctacttgctcagtgatcatgaacacaattttaaatctttctgaatctcatttaaaaaaatttgtgaaacaagatgatagaattaattttgtgagattgttggactgatttgagatcatgcctatgaagtacctagcaca

SEQ ID NO: 118115 - DNA, 1034 bp, Homo sapiens
tgttagtgactcttagaggtgatgtgaagggtgaggaaaatgtgagcaagcatgaggtgagcccctgctggtatttcctataggtcatcagcctctagctgaatgtggggaggtgcctcactgcgggagtcccattatgaggggcccctagtcagatagagtccatatataaatcagtagctactttttaggacatgggaagaatgggaggtaatggttaacaaaagtctgttgtgtgccagtagctttatatgttgcctcatttaatcttcaggagtgatcctgcagtgaagtgtacttattctcttccctctacacattttcaggcacagaaacacattcagtgaggtaagtaagcactcgttgtggaatgaggtggagaaatccagatttaaatcctaggtctgccacttgctagctacatgactttgaacaagtcatttacctctccgaggctgagttttcttacctggaaatggtgagagcagaactgtcttacctcacgggactattgagagggttaaatgagataatgtaagtaaagtgtcagcatacagtaaccccataataaattatcattagattcaatattgaggtttggtgagattggtttttgactgaaatatggctttgaaaaattctattttgttgaaaggaaacacctgacttgaagacacagtagactgaccttttatgtaaagaagatcattgacttatagaattgcatgaacctgtggggaaggagaagggtagagatacaagataaaagcagaattatctgggcagctgttagatttatttattatttgagcatcaattggattcatttattctgttaaagacaatttgttgataaaatgtacaagcatgctgctaaccactttatctcagaatagggaagaaaaaagggaaaattatgactgagcttaagtctgatgaatagtgaaaaaatggctgataaaggggaaataataggaaccttgttgcttttcacttgggcacagttgagagtacaggagttggtactgggatgg

SEQ ID NO: 118116 - DNA, 1055 bp, Homo sapiens
aatttattgagtgtttaccatgagccaagtgctacactgttgtatgaacatttagttttcccagttaccttctggaacagagactgtggttactcccacctttctgttttacagatgaggaaatagaagcacacaaaggtccaattccttgcacaaagtcatcagccagtaagtggcagagctggaatttgaatccaggtggtctgacctcagagcccatcctctcaaccgccattcactttgattccctgacaagggaggtcagagtcccagagagttcagatgaaggagacaagacaaatgcatggcttgtctctatcagcactgggtgtacatatgactttgaagtagatacttgttagactatagggaaaaatgtcctcatcttcaaaacacttaatatgagacttgctttcttagtgttcctctactctcacacccactagttcctctaatctctccaaagagatttgggagctgtgttctctccgctgtgctggatggaaattccaaccaatctattagttttctgaacctcttctctcactcttttgtgctaaattcaaagacaaagacaatgagaaaataggaatttgtggccactataaatcttcatgtacctcgtataaacctatggcaggcatagaattgaaagctgctacagctctggccaggctgcattgaaataccaaaaacaaattgtgtatttgtatgtgtgtatatagatatagtatatatatatatatagtgtatatatatagatatagtatatatatagtatatatatatagtgtgtgtgtatatatatatagtatatatagtgtatatatataagtgtatatatatagtgtgtatatatagtatatatatagtgtgtatatatatagtatatatatagtgtgtatatagatatactatatatctatatacacacacatacatatataaaaatataaatataggggctgcatctgcacattgtgtggactaagtgcctttaggaacacatctgttgtaaatcaaaaaaaggcatcattacttacaggattgggctt

SEQ ID NO: 118117 - DNA, 1331 bp, Homo sapiens
tatgctgtgcctttagaaagattgttcagtgtgaaacaaagttttgtctgtatgtttaacatagggattgtgtatgaagctttagagaaaagcttcttggcccttgattaggctttctcacttcccacaagtcacacttttctctctcagaccctaaactttctctctctagaatgaagtgatcataaaccccattttataggatttttaaaggattaagtgaggttacatatgtgaaatatgcctggcacatagtaaaacctcaatcattgtcagctttaagagacattctctgctaagaagtatatttttataggtaatagccttttaaatacaaacattttagatataccgtggtacagggcaagtttgtggtatttcttttaaaaatgatatatttttatcattttcttgaattataaaattactaaatattcattttcaatttttaattaaagtgcaagtaagataaaatcattcataattctaatactcagtgtattcacatttaacattttgacgtagatctttttatatgtctgttcatgtttgcaaatgtatgtatatgtatgtttttttaaaaaaaaaaaaaacaaagttgggattatttagcccaactatttcatttgtggacatatttataaacatttttttctgtgtcattacatattccttggaaacatgatttttgatgcctgcataatattccatcggcataatagctgttattgttggtttctatttttcttcactattatgaataatattggaataaatttttgaatataaatgccatataaatatttgtgtacatttcttgttgctttctgagctaagacctttcatgcttattgccaaattttctcccaagagaattccgcaaatttggcactggatatcatccatattctggctgtataacttgaatgaaagacttaacttcttaaaacttccatttatcattaataaattaggctaatctcacttcataaaattgttgagaagaaaacaaaattgttaggtcttgtcttctgatatctactttgaagactactgaaagttaatgattctgccattaactagttgtttgactttagtccacctccatgaattttttttcttttcttttcttttttttttttttttaagctcaccacaacctctgcctttcagattcaaacaattcttgtgcctcaacctcccaagtagctgagactacaggtgtgcaccaccatgcccggctaatttttttgtatttttagtaaagaccaggttttgccatgttggccaggctggtatcggacctgtggcctcaagtgatctgcccacct

SEQ ID NO: 118118 - DNA, 1033 bp, Homo sapiens
actctctttagtaatagtagctaacatttagtaaatgcttatgtgttaggaactcttcatattcctgtgatgtgtgataactcatttacttgccacagtagttgtaaaagaaagatactatggtcgttcccattttacatgtgaggaaaccgagttatagagagtctaaataatttacctaaggtcatatcattgataattacctcagactcaattttaaaaagagattttgcagcatgaaatgaatattctttaatttgaataagactgttaatattatataaactataagttacttttaacaaaatcttcttataataggtagttattgaattattaaggatattattttttattgattataagtggtaattatgcagctagaaatgtctgtcgtttacatatccaagcatagaatgacatcaaagatgtgttttttgttttttttgcaggacagagttcattcaaagaggcaggatttcaatcacaggggttggatttctcaactgtgttttagaaacttttgccagcacattcttacgacagggagcccagaaggtaaccatatttctgctttgaaccaacattaattttaaaaaacaataggagttccaatagggttattgaataagactcatgagcagacataatgagaaaaacatatagttaataaacaaatatatgcaaaaataatcaacctcaaaattattacataaattcaaatcaaagtaaaactaaagtggcatttatggctcattaaattaaaaatatgccaatgaagagtatgtgaaaatttggagcatacttataatctaattaaaagaaataatcagaatgaataataatgtatagtatgatgacaactatttaataaagataatgatagttaatatttattgagcacttactatgtactactgactgctaaaagaatttgtattattaactcattgaatcctcacaaacctttgcaggagctgttattgttgtcctaatattatggatgaggaaaatacagagaccccaattgtcc

SEQ ID NO: 118119 - DNA, 1065 bp, Homo sapiens
agtagcatgatttataatcctttgggtatatacccagtaatgggatggctgggtcaaatggtaattctagttctaggtccttgaggaatcaccacactgtcttccacaatggttgaactaatttgcacagatgtgagtctttttgtatttatcctagttgaagttcattgagctttctcaatttgtatgccaatttcctccctcaaatttggggaattttcagccattatttcttcaaataggcactcactctgcttctttctcactctcttctcattctgagattcccgtaatgtggataatgatctgtttgatgatgtcttataagtcccttaggctctcttgacttttctttattctttttatttgttttttggttcctgactcaataatttcaaataacctatctttaagtttgctgattcttctgcttgatcaagtttgctattgaatgagccactctagtgaattgtgttttagttccattattgtattcttcaactctggaatttctgcttggttctcatttttctcatagtttctttttgttgatagtctcattttattcttgcgctttatttttcctgatccatttagttgtctattttagttcatggagcattttaagatggttatttcaagttctttgtgaggtaattcatagatctctgtttcttcagtgttggtttctagagatttattttgtttctttgattgggccatgtttccttgtttctttgcatgcattgtgatcttttgttgaggtttgggtatataaaaaaacagccacttctcccagtcttatggactggcttcatacagggaagaccttcactagtcagcctagcttgagattctgggggcctctcaaacctttttgagggatgcatcttctctggacttgtgtgtaatttcccagtcacagaggactgcccctgttctcaagagcccatgatcttttgttacccttgttgtctgtctgaggtactgcaggctctctagtgtaacaagccaccatgcttgcttttgaaagtatattgccatttcctttagcactctgagtca

SEQ ID NO: 118120 - DNA, 1051 bp, Homo sapiens
aaatctaaggggtgaaaactgcttagacggaaggtatttatgtcagagtggatgggataactcgtgtgtgtgtgtgtgtgtgtgtgtgtgtgtgtgtaagagaaggggaggaaagggaagggggagagggagagaggaattctgaaggcttccttttattgtatgcatgatctaaatgtagaggctactgctattagtgaggtctaattaagaggttttaataaccattttgaccaaaatgacagtttgttggatccagtattttctcagattttttttgattgtttcagtgcatgtgctcacatatgcatgcatataaacacatgccaactatacatacaggagacgtggctctcatttcctttccacagagatgtaaggttgagaaaatgttttctgttttgaatattttttattacaaagaaattgaattaattcatttaacaaatgctcattgaactcattcagtgtaagcactatggtgaaaatggggaataggagattgcctaaaagcattaaggaatggcaaggagcgttttagtcagtggcgcagatgtgactattaatctataccgagtacttggtgtcctcagaagacaagccaccgttaccttcagggtaaagcctaaacttctcagcctgaggccatttgcaatcttgtcttcaattatcctttcagcctcataccctaacatctcccacacccaccttatgctccagtcattcctgtgggaagaatttatcaagccccataccatgtactgggcatttttagataacttgtggctcctcagacatctctcttccttcacgcctccttacctgggtccttgtggttttcctctgatggaatgcttcacctccaattgctgacacactcccacttgcctgtgtgccttttccactagccagtgagatcctggaggagagagaccatctccttctctgtgggcctctagcagtcagtatggcacttagcatatagtagccatgcagtcagtgtgttgaacaaatgaatgaatgaggcaaagttaagtgtaatccaaatctg

SEQ ID NO: 118121 - DNA, 1110 bp, Homo sapiens
cagggtgggacaggagtctgggaagttgggaggcttctgttccaagagctttgaatgttaaaactggggtggggaaggggttcattcccttcattgccaagtggtttatggtgattgagttccacctagaagttaatgaattacagagtcttggagttgcctcgggctggattttcacagtggttatttgacttctcagccactgtgctttttttttttttttttactttaaattggaataataatggtggttgtagtagaacagcataattattactaatgttagtactgtttactcacatttgttgggtgcttacacatagtactttgagtgctttccgcatattgccttattcaaccttgtgagaactcatgaaataggtattattaaccccattttagagaagagcgaacttcacagagcttcaggaacttactacgtgggtgggtaggcaagctaaaacaagatgtgaatgtaaatggtctaattccaggagccgcgccttcgttccctgtcttaaaggcatgtatatgtatatatagtgtgtgtgtgtgtgattttacacgtataaatacacatgttcatgttaaggctgaaactacatagcatgtattgagagctctgcaaattgcattggttttctgtggaggcagttatgtaaatgggttcagacagacagcatgggagagactacatagtctgccatcctggagcagcagtgagtcaagaagtctctgcagcagcagcagagccagggagttggtcaggagtgagtgggcagtctgacttgaagaccccgtgtttcctttgggacccttatttctgtgtgcttacaggagaatgctaaaaacatgattagaactgaggtcatcacaacaagagtatctgtggaagctttttttgcccctcaaagacactttaattagattcccatcatgaaaacaattaggcaagatttgccatacctaaccagtcaataattcaaggacaggatctcattaagagcttttgctttcccggaaactgccgttttgaggattcagcactggtgactgcgtgctctggggattaattcctgatccatatttcccctgaacttttttattttc

SEQ ID NO: 118122 - DNA, 1027 bp, Homo sapiens
gcctcataatcatggtggaaggtgaaggaggagcccagatacatgttacatggcagcaggcaagagagcgtgtgcaggggaactgccctttataaaaccatcagatctggtgagacttattcactatcatgggaacagcacaggaaaacccgcccccgtgattcagttacctcccactgagtctctcccatgacatgtggggattatgggagctacaattcaagatgagatttgggaggggacacagccaaaccatatcagatgtggaacccagcttggctcctgccgattagcttgcaaattaaattgctgtgctgtatgtggaacaaatggcagcttccgtcacttccttatcatgaattaaaagactgtcacattcttcagtgtaataaagctgatatgacaatgaaaatgaactttcttttattttccagatggtaaaacttgttgcagtgtagcagcaaattattactggctttttccagagtgtgtaccctgcctttgccctatatactcactctgaatctattatttaaaaaggcattcaactttgtcttgtgtctcaattcttaaataatttaaggacacctctgacttgtacaattctgcctttgtagttttccatgtcttcacctaggaaaccatacatttctaggtattggacagagtttaaaatgaagaaaatattttacctgatattgttctgcatgtgagcttgtaagtgggctcgattagaatccatcaatttaagaaggccataaccagccttagaggagacgcgaaggaggctgataatttgcttagtgtttagcagttaggtaaattaggccagagactgtatagcctacataaatcctgggtcatttgcatgtcctcaccagcacttagtaaggtcatagtatgtttgattatcaaaaacgtacagccactggtgagccatcatccatgtatcaggattacttgtcctcttggttatccaagactgagagtaactctggatgcagtcattatgttgcctgctcttcct

SEQ ID NO: 118123 - DNA, 1084 bp, Homo sapiens
agatctactgatctatggcttttggtttgttaggagttgccttccaagttataatatactacggtttttaaaacctgaagaatgtttgctcttcttacatctgcctgttgaataccacaggcaaaatattagctgcatgctttcaaagctaagtgacactgtgaaaacaaacaatatgatactctttgttcctaaaatacaatatttctcaataaactcttcatggaggaatgttatgaaacccaaaatagtttattcattggatgctgaactgtatgtactttccaagaactatagtgtcaatgcacttgacagtgtattttggtttctttctttgtgtgattcttagctttctagctcttatcacttaccactgtttccttccttttacttaaaatcatctacaaagagaacacaaagttgcatagatgaatgtagcagtgtagaaagtgggtcttctctggaatctcacttagacctttttaatgggcttgcctttcatgagctggattcagagaacttcttaaatttcatctgcctgaaatttaaactcattaaaaaggatccagagagctattatattgactggattttcttgtttatatctaaatgaggccagagaagtaaagatttttcttaccttcagaaggttgactttctttttatgctgtggtcaaaggagtcatagtgaatagaatatcaccttcataggtggtgatttttgtcatttgtttctgatgtatcccaattacccaaagagatcctggaacatagtaggtactcagcaaatccttgctgaatgaatgaatgaactgactcttttggggattagccctgtgcaattttagattgaagtcagtatgggattcagaaacatgtccttactttggatactgtaataaaatggacagattaaaatattgataatttctttgctttgacagaatgaccctgggtgttatttattttggctgggagcctggtgtgctgaacaaaatggtttgaatgtttactcttaagctcataaaggggatttatgaagggctatttccatttagagtagaaagttgattgggtaattaat

SEQ ID NO: 118124 - DNA, 1032 bp, Homo sapiens
gtctcggtggatgtgcaccaggtgtacaagtaccccttcgagcaggtggtcgccagctttctccgaaaggtaccgccccgcttccaccttccgtatcccgcgctgcctccgctgcttgcccctctctcctctccttcatccacgcggaagctggcaccgccagtgtctctttccagctgcgggctttgcttcagggatgtgtgggtcgagagggatttcctcgaagactccctttacagggagcgggaaaaggggccgtgcttggcatcacgttcacacctgccccagctgaaagaagaggctttccttttaggaagagcctccgggaatcccagctcgtgagctccgtggagttgcagatgaccgacgtgtggagctttccggttcatcactgaccccttaaaagcgaggggaggccattgggcagtcatcctggtttactcagcatgatggttctgctgccccatccgctgctccttattaaacagctgtgggacatcgtgcaggttgcttactctctttgtgccttagtttgctaatctgtaaaatggggaaaataatagtaccgactcatagagttgttgtgaggatccaaatgaggtaacttgtgtaaagtgcttagcacagttgtgacctaaatgaagaaactgaggcaaaatcaatataaaaagagagttcattcgagccaagtttgagggctgcatcctgggagtgaaggtgccctgagtatacattctgatgagcagaagtcgaaagtgggtttttaaaggagaataagaagcacttcctaagttgtttaccaagaatttatattaaaataacataaactattgattgtctgtacattgttctttgtatcacaaattccaggaacttgaagataatgggtaaggcagctggtcaggaacaaaatgcctttaaccagttgctcccaggaatgggttgggtgaggaggggaccactaaagtcctatactcttgtctctctgggcttgattgattttgcatatttcactgtaactcacacaatctg

SEQ ID NO: 118125 - DNA, 1344 bp, Homo sapiens
agcctcccaaagtgctgggattaaaggcatgagccaccatgcccggccactgctttttttgtttgtttgtttgtttgagatagagtctcactttgttgcccaggctggcatgcaatggtgcgatcttggcacactgcaacctctgccttccaggttcaagcgattttcctgtgtcagcctcccaagtagctgggatcacaggcgcccatcaccaggcccagctaatttttttgtgtttttagtagagatggtgttttgccatgttggtcaggctagtctcgaactcctgtcctcaagtgattcacccgcctcagccttccaaagtgctgggattacaggtgtgagccaccgcacccagcgtggcttttatttaataatctgaagaaaatatttttgtttagatataacaaccagcgtatttaaaacgtgagttctcagactgctccagggtttgagtgactgtaattaaatgcttatattgataatttattttgttgtagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtatttttttttaaaaaagaaaagtagtaaattagcagcttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcac

SEQ ID NO: 118126 - DNA, 2708 bp, Homo sapiens
ctttctggttctcagcttctcttttgtgaaaaagggtacaaaagaactacttcagggatatagaactaacgtcgatgaagtgcttagtacaatgcctaatacatagtagagattcagtgaatgatggtggttgtggaagagaaaatgtagttattgttagtgtccatcattggtgttgatatatgtagttgtagtcatctttacctaggcatttggttataagcatgagcttgtacagcttttctttcatatttgagtactccttagtcatgattttaaaataccagaattagatctgtctttcattgggcattgaaaacgtagcagagattcctcctccctcagcagtattcaagttaaacaatcattttcttgttgttttcctagcctggtgtgtccgtttctctggtgaatccccagccatccaatggccacttctcaaccaaaattgaaatcaggcaaggagataactgtgattccataatcaggcgtttaatgaaaatgaatcgaggaattaaaggtaagttgttccccaaaactcccatttgtcagtagcttgtagatttggtgagttctaagcagaaaggaaaaagaaaagaaaccggcttgcttatggacagctgtgtattattatggaaaaagtactgggatcagaatcaagaaaactattctttttgggactctgtggctaggtagcttagtggctttgccatgtcacttaagctcaaaactgatttttcatttactaatgtgaggacaatagagggattagatagttttcatctttctttctagctctaaaattgtaatgagtgatttctgtctctcagagatattcagaatcaaggaacacatacccttaatattctaaactaacctgtccagcaggtctgttccttgagaaggaagagaaacagagtaaaagttattgcatgtcttccatgtattaaccatttaatccttttacagttctataatgtagagggtattcttattatttcccttttatagatggtgaactggaggctaaaaaggctaagtaacttgcaaagtttgtttagctagtaaactctagatctggaattcaaacaggtctgtttgactccaaagctcatattctttcttctaaacaatgtgcctccaggtaaaatatgtcagtaatcttaacttattatcaagaataagtctgcatcttttgtgattagattcaatgtaataatttatggcttttcttttcgtcatccagccaggtcctacggtgagcagagtgtgaagggagatagtgtgtctctcttatttttcttctgagctatgaaaacaaattaatgttgtgattctctattttgtattatctgtcttttttctttttgatagcaatcaaaagttgattggccactttccatcactacaaaaattttctaaaaagatttataaatccctaacaataacctaatttatggaactatattagggtagtaacatgaattaaaataggagacttgaaatagctcttgggaattcattctgtcatttattttgtgttctctcgaagttgtttcccttctgtggatacttattgagacactaatatatgtagtgtttgtagagacaactgtgtatgtagagactcctttgtatgtactggggctttggggagtccacagagtgctgttcattaggagctgcatctagtaaaggagtagggaactaagctattgcagtgtatgataatgtaaggagaaattgctgagtgtagtaagaaaggtacaggtaaaatgtatagcacagaggaacgtgagattatttccacttgcagggatcagggactaatttatggagaaaatactgtttggatggggccttgaacattatacccataaaggtaaggggaaagggtatccaggagggaaataccagttgcttttgtttctctgtgtacagagcatcagcagcaacagtatactagggttagggatgttgttgtttataggtgtattttttaattgtggtaaaatatacctaacataacatttactattttagtcatttttatgtgtacagttcaggaggcttgaatacattcacattgctgtgaaaccatcaccaccatccatctctacaacttcgtcatcatcccaaattgaaaccctatacccattaaataataactcccattctccttccctccagtccctggtaatcactgctctactgtctttttttcttttaagttttatttttgacagataaatgtacatatttatgagtacagtgtgaggtttggtacatatttacaatgtgtaattatcaaattaggataattaacatatccatcacctcaaacatttatcatttctttgtggtgagaacattcaaacagctcctcttacagctattttgaaatgtaccatatattattatgaactgtagtcatctactgtgtaatggaacagtataacttattcctcccatttaattataactttgtacctgttgaccaacctccttccagtcccctctcttccatccttcccagcctctgataaccatgattctattctctacttcaatgaaatcaacttttttagattccacatgtgagtgagatcatgcgatatttgttattctgtgcctttcttatttcacttaatataatgtcttccagcctcatccatgttgtcacaaatgacaggacttcattctttttt

SEQ ID NO: 118127 - DNA, 1030 bp, Homo sapiens
ttggggattttttgtttggatattattaattcactattctctgaaacagctttaagaaggtggtatctcagaaaattaaaattttgttttttttgggtaacttaaagggatattttcacacatttggctgattccctgtaaagtgaattctttgggcttgcatgttaagtcagtctaaataaacaatcataaaaccgtatttattttataaatctgaaaaccttgtgccttcccatcttttcagtgctgccataatcttataatactttaaaagataattatttggagctagtaaatttcattaacaagcaaatgtaggtaaaggaaatcatgagtccaaggcctttcctttaactcctgaaatctgaagattttatcagttgagagaagaatgattactttggaggaagtatgttttccaacatattcttactgtgattttgtttttccataccattttggctattaggaaaatctggagaagatggggcctcgtattctggatttgcaattagaatttgatgaaaaggctgtgcttatggagaatatagtctatctgactaattcgcttgaggtaagagggccagggattgtaataaccagttaactgtagttaaaccataatccagctcttttattttataataaacctttttataaatttcatcttctgtgtttagtatctttgttaaatatattagtcgaaaatatttttggagagaagaaaaatgggtgagtataaaagttgcaggaaaaaaagtgatatgtcatcttatttcatcaattcttaatttacatataatcaattatacattaaaaaactgtatatctggctattctactgcaaattatttttaagagaccttatattcaaatgctttccaagcctctcatgttatggagtactctgaattgttgccttttttcccccctcccttttgatttgcagaattggattaattataatctttggtttagaattgctgcactgatatattggttcatgatatattatggttcatgatatatt

SEQ ID NO: 118128 - DNA, 1043 bp, Homo sapiens
aaatattcaacacaaatcacttctttttctcttctaaactaaaaagtatgtgttgttaatttatagagaataggagagttccttctgcattgttcattgagctttcacttccccgtgatgctagggctggacacttttctgctgttctctaaggattgatagaggccaccattctatgcctggtcacatctactgttctgccttattcttgagacttttttttctacattactctccctccttccttttcttaggccaataacggaaaactgcctgacaacaaagtcattgctagtgaactaggcagtatgccagaactgaagaaatacatgaagaaagtcatgccatttgttgccatgattaaggtaagctgtggaccttatgcagctgtgaccacatgagcaatggttagatgggacaatagaaggatggggaaaagccttggacatagtctcctgccagaaatctgctaaaatagcacttttcaatcaatgactgagagaaatgatctatcagattttgggtttacttgtggaattgctgagtatgtgaaaaatattattgtgggagaaaaattggtttagaatggctgcactgaactattcccttcatattctaccttcccttctttcaaactcttttggcttacattaggcttatagaggcttgcatttcctagaccctattcctggaaccaggattcaacatttgtataggtatagcttaacagggtaaacattggttatagtggttagaccagggtgtctcagcatagctctgttggtattttgggctagatagttcttgtggggcactttcttgtgcactgtaggatatgtaatggcatccctggcttctactcattagaagccagtagaactacctttcctgctagttatgacaatgaaaaatatctccagacattgccaaatgtccgctgggggcagaatcaccttccacttcttaccattgagaattattgggttagacccttagttttcttcatatacgtcgctgatgtattactggatttcttgacaaaa

SEQ ID NO: 118129 - DNA, 1129 bp, Homo sapiens
caggcttacagataaatagattggctggtttaataactcctttccagccatattagctaggctcttttgtatttttaaatgcatgaacaatacagaaatgtgctcatgatctatataccaaataaccgtacttgaatactggatgtattagcaggataaaaactgagtgtatgcataatttatataataatgattaaatttaggcaaattagcattacataattttctttgaaagtgagcatatgtgtgtgggtattaatatgcttgtacaaatggatgctaattaagaatgtagagtcagacttcacagcttgaattctagggaacattagatcaggggctgtgcaagtgtgttatgtgtagtcaagtttgaactctgagcacacaattacagatggtatccttggtatgaaactataatcaagaaccgtaaaatagttatattgtctaatctcactgaaggtttttttgtttttctttttttaaaagcctgactcaattatgaatgcttcatggcctgtggcaggtcctgttaatgaagttttaatacactcctcacagtatcttatggaagtaacacatgaccttagactacgactcaagaactatatgatgccagctaaagggaaggtaaagtttttttgtttttttttttaaaggattattccttaaaagttattgatcagataacatttaacaataatgaaagttaaaaagattttcattaatggtgaagaccgtggtggtgtatgttgggggagggttcttctcatttttggtttatataaaagctattgaatgtttttcctttcttttaccgtctagaagactgacaaacaacccctgcagaagccctcacattgcaccatctatgtggcaaagaactatccaccttggcaacataccaccctgtctgttctacgtaaacactttgaggtgatgctctcagtagacttttcccccctgatggtgttgtatgctccctatgttgtttttgtttttaggatgttggcaatgtctgggagaagaaagataggcagctttgtttcattccctctaggcagacagcatccttttgttattcttggtggctcttaaatggatgctgagggaaaagctgctgttttcc

SEQ ID NO: 118130 - DNA, 1373 bp, Homo sapiens
gtttcaaaactgagaaaaattcatatgcatttgtacacataaggcaccagtgtgtattctcatgtattaaaatgtattttgctacctctaaatgaggctgaaatgttgataagaaaaccacaatgaaaggtgtgtctttatccccactttatcattttctatctctgcctcattaaagatcactttatctcattaactcaacatgcctgagaagaaacacatattggtgcttagtggatgcaaatcaatatggatggttcgaatattttaacatcacggttagggatgctactttttggtgattttaatttttgttgttgatccaggacagtcctttaaagcatttgttaatttatatatgggctttgcaaggtatccaactggacacataggacacagttgatactcagtaaccatatttttaatgcattgaatttttttttcttcttccaggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccaggtaatctgtagatcccaatcattttgtgttttagagttacttagtcctggtgcatttttgttttctttttcttttcttttcttttttttttttaataaaataaactaatgataataatagctagtgttcattgaaggcttacttgtgccgggtactatgctaagtattttgtgtccattatctgactttaacctcaaagcaaccttatttaatacagatattattagctctattttataaataaagaaactgaagcttagaacaattaagtatttccttaaatgccttaaagctagtagttgcaaacttgggatatgaacttgcttctgtctgtcttgaaagtctgttctcataaccattttaccatgttgtcttgttttcgagtagggcaaaatggttaaaggaaaagtagattaaaagaaaaggataaatatctttggagtcatcctacgcactggtattataaagatgaatgagacctgatccttattgtctagcaagagagacaaacacccagtttctaagcacaataatagagacaaggagaattcagagatgtcatgtgacttctgggtttcttttttttttttcctgagacagagtctcgcactgtcactcaggctggagtgcaatggcacaatctcagctcactgcagcctctgccaggttcaagctattcttctgccccagcctccctactagctgggattacaggtgcctgccaccacgtctggcc

SEQ ID NO: 118131 - DNA, 1760 bp, Homo sapiens
cacccggctaatatttgtatttttagtagagatggggcttcaccctcctggccaggctggtcttgaactcctggcctcatgatccacccgccttggcctcccaaagtgctgggattacgggcgtgagccactgcgcccagccttcacatatatttttaagatctttttatatccatacgtgtagccccacctaagtagttacgtcattgtatacctgtatcctagtttatgtagccagtcctttgatttgttttcacttcccattacaaaaaggactatagtgtatatccttgcacttttatcttagcaagcctttatgagtctattagcttttacctcaaaattttaagccagaactatcatctttgtttttttattttctatctttaaacatttatctgtgaagtgacaaatggcctacagctgtgagagcaaatggacatctcctcctgaactctgagaaggtaaggcttattgcatcttaaaagtttaaaattctgtggaaggcttttcagatttaggttgttgcacttttttttaaatgtatgtaagaaataatgtgtccaggtgtggtgcctcatgcctgtaattccagagctttgggaggccaaggtgggaggatcacttgaggccaggagttcaagaccagcctggacgatatagtgagaccccatctctaccaaaaaattagtaaataaataagaaataatatgaattaatcagagttaaaaaccttctaattagcatatttaggacgaggcataaattaatttttttttttttttttttttttttgagacggagtctcgctgtctcccacactggagtgcagtgacgtcatatgggctcactgcaagctccgccccctgggttcacgccattctcctgcctcagcctctcgagtatctgggactacaggcacccgccatcacgcctggctaatttttttttgtatttttagtagagacgggatttcaccgtgttcgccaggatggtctcagtctcctgatctcatgatctgccctcagcctcccaaagtgctgggattacaggtgtgagccaccgcgcctggcctataaattaatttttatctttaaaattgagcaaggggagtagatagtattaattgaagagagagatagggaagagttacctatttgtaacatttgtatttagagtggccaaaggtgacacaaattgcaactgaagtaaagagagaaaaagagagacagagacagggacaggaatcataaagagcttagcattgtgacccagaagagttttcttttcctttttttttctttttctttttttttttttttgttgtgatggaatctcactctttcgcccaggctggagtgcagtgacacgatcttggctcactgcaacctccacctcccagattcaagcgattctcttgcctcagcctcctgagtagctgggattacaggcgcatgccaccatgcccggctaatttttgtttttttccgtagagatggggtttcgccatgttggccaggctggtctcgaactcctgacctcaagtgatcgcctgcctcagcttcccaaagtgctgcgattacaggcatgagccactgcactcggccatttttttttttttttttttcacaaatccacttttattgacttttcgttagtttaaatccttgaggggtacagcatcactccgattctgtgtccaatagccttagcaggaagattgtttaggaatttggcatgaaccatgctactgttcccgt

SEQ ID NO: 118132 - DNA, 2285 bp, Homo sapiens
gttattggtggtatagcatttttttaaagtaatttttatccttgaggaatgaagattgatttgacatagtatctaatgtatgtttatttaccttcctttagggagatgcacttatttacatggaaccagagaaacaagtgatgtccaggtcgtcagatgaatgtgttgtggctctgtgtgaccagtggttagtctcttatagcaagaaaattcccctagtcaatttgctcacctttgacttaaaaaaaaacatatcaatttgtccactcccaggtacttggattatggagaagagaattggaagaaacagacatctcagtgcttgaagaacctggaaacgtaagatgggagaaagtgatgaaggaggaaaaaggagatgaaaaatgtggaaacagtaaagttgaaatgcaacaaaaaaagtgaaccagtaaagatacactttgtcttttgctcttttctagattctgtgaggagaccaggaggaattttgaagccaccttaggttggctacaagaacatgcttgctcaagaacttatggtctaggtaaacaaacttgaaatttttctgtttggataactttgccagttacacagaaaatatacatttttacctttcccccctgccctcaattctagtgttttctgaattgaaagcagtaagtttcctctggatggtcatgaaaactaggatatagtccactatcatctactgtgtggtagaaatatgccctctctatatagattttgtggtgtgacttttttatggagagactccaagcttcaaccatttgtcttttttttcttttttagagacagagtcttgctctgtcgcctaggctggagtgcagtggtgcgatctcagctcactgcaacctctgcctcccgggttcaagcgattctcctgcctcaacctcccgagtagctgggattgcaggcacccaccaccatgcctggctaattttttttgtacttttagtagagacggggtttcaccatgttggccagtttggtcttgaactcccgacctcaggtgatccacctgccttggcctcccaaagtgctgggattataggcgtgagccaccatgcctggcccattttgtcttttatctacaattttatttttattaattattcaagaataatttaagagcttcctaaataagtagctttgtaaatgttatagcccccttcttaaaaatgtggattctatagatgaaatgtctctcaggttcctcatgcgttactttttatttttcaggcactcacctgccttgggatgagcagtggctgattgaatcactttctgactccactatttacatggcattttacacagttgcacacctattgcaggggggtaacttgcatggacaggcagagtctccgctgggcattaggttggtaaacagataagggaaaggagcataatttgtcagtaagagttgtgatatttgatttatgtatttaaatgttttaataagatttatttcacagaattttgtcatgatatttttgcttttttactattgaactgggaaaaattaataaatagccccttactgtcatcatctattcttcattcttatggaagctgttgtccttatttgttcctgtaactacattaagaaagagattcctaatccatgtttcgattcaggtactgattcttccaaagaaattacatatatatatatataaaatagtttgttttatttttaatacagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaaggtgaatgataaaataggtgtggactagatttattgattgtcaataggggtgtcttgtggcttcaaatatctaataaattattgtggaggggatggtatagatttgccagttacattctttttcttatcttaaatatgtactaaagcagaaaggccacctcctatctcttacatccagaaatccacatacctaccccaggcaccaaagcatgtcatatctcaggtgcattgctggtctgctagtaattcatttgacctgttaaatgcaggaataattctagaccattagaattggaaagaaccttctctttagagcagagcgccccaaggttccagcattagttgtg

SEQ ID NO: 118133 - DNA, 1019 bp, Homo sapiens
tttttgcttatgggtaggacttgtcactaggcttcactgggggagatctagaaagggccatttgggccttggcgactcccggttgttaagtttttttagtattggcttttgggtttgttagatttccctacagaagattctgccaatctctagctcaaaaggtctaggtggccaggcacagtggctcatacctgtaatcccagtactttgggaggctgagaccggtggatcacttgaggtcaagtttgagaccagcctggccaacatagtgaaatcctgtctctactgaaaacacaaaaattagccgggcatggtagtgtctgcctctaattccagctattcgggaggctgaggcatgagaatcgcttgaacctgggaggcagaggttgcagtgagtcgagacggcgccaccacactccagtctgggcgacagagcgctgtctcacaacaaacaaaaaagtctaagcaactgagcattttggaagttggatgggagaagatagctaggaatgtgtaccaacatctagtatgctgactttcacttaattcccctatttttactatgatacttgtaactttgtctctagttcagagactttcttttaccttttccagagaattagcctttttttttttttttttttttttggttctggcataggtaggggcagtatatggggttctaacctctattttattttattttatcttatattatcttatgttatttttttaccacttcccagatacccacttctttaaatgactttagttggtgctcttcttttcagtctcaccttatctctctctctctctcttctctttctttttttttttttttcggagttttgctcttgttgcccaggctgctggagtgcaatggcacgatctcagctcaccgcagcctctgcctcctggctcaagcgattctcctgcctcagcctcccaagtagctgggcgttacaggtgtgcgccaccatgcccagctaattttgtatttttagtagagacggggtttc

SEQ ID NO: 118134 - DNA, 1050 bp, Homo sapiens
cttctatgagaatctaatgccacccatgatctgacaggaggtgaagctcagggggtgatgctcgcccgttcctcacctcctgctgtgcagcctggttcctaatgccatggactggtaccggtccacatccttggggttgggaacccctggtttacatcattttgctagtttcagtatgaattacttaggtaattatatgccagtggaggatagagtgttgggaaaggtgtgtgtggtgggggaagggcattgggggtgttggtacacagagtatgggtggttcctgtggagagtagaaggacaaatttacatctggaagttagtcactctgtgattacttaatgtgtggcagtgtcgtaatgacatatacaatctgaaatgacttaattggacattagaggcaaaaggacttgtgccctacagagctgtgtgtccagtcagtgtgaacacgttcctgattgctgtttgctgcaggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtgtaagtaataattttttttagtttttatttgctttactccatgctctgtgattttcttaattagaaaaaatgtagaaaaatttaacatagtttcagctatacattgatttgagagcttaatatgagaatgtattctatttccaaatttctaatttttgtttttatcatgtcctttgcctaaaagcattttcagaaattgtctttttcgtgccctctaggaatctctatggagtgaatttcttgacaagatatttcaaattagttcatattattatgcagtaaacttcaaagatttattgaatggagaatacctggtcccttcttttgctcttttagttaaggagttcatattttagataagcagttttattcagtccattaatttatttattaatgtctactaaatgccaggtgagttcaacaaacatgttctga

SEQ ID NO: 118135 - DNA, 1050 bp, Homo sapiens
gtagatttttcaaagcatttttcatctgttatcttgtgtgttcctcaggacagtcctatctgagacgcaacatccttattttaccaataaggaaagaaaggcttagagagattatgactaccttgggtctaaccattagtaagggagcaaactaagtttagaaagcacattatctctgacctctggtctagtgtcttcctttgatgactactatgtgggacatgccctgggatggaattagggttgattgtgtcttctcaccttcattttggcaaacactattttgggcgattactccaaatctctcctaacgtactagacttctgtgtgggtatagttagcacaccactggcaatctcttctctgcaaaaaaaaattaataatgcaagaacccattttagggacttgaatcagatctctcacatagattagtaggtttaaggcaagtcttttttttccttcaaatttttgtatcgtttatttgcttagggtgttggacctcaggaatatactttactcaaattgaaggtgcttgagccatacccatctaaattaaggtaggtttgccagagtaattgctttatcatttctgaaccatcagatagttgttacagagttgacatgtttttacatcaatatttgtttttttttctcagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggtaagttggatagcagattttttattttaatgcgtaaatttcaaggaaaatttcaacaatgaatattgagaaaagagcattacaaccttaaaaaatgaggtgtacatgcagtaaactgtgtaagtcttgtgtgttttggtgcattttcatatgtatatacacttacgt

SEQ ID NO: 118136 - DNA, 1756 bp, Homo sapiens
ctcaactgaaggctcagatgattattagcattttatagcaatgatgtattttaaaattaaggtatatacattgtctttttaaatataactttattgcacacttaacataattcaatatagtataaacataacttatatatgccttgggaaatcaaaaaatttgtgtgacttgttttgttgtggtggtttagaaccaaacccacaatatctcccagatatgtctgtatatttgtgtgattatatgagatttggaccaattcctaattttagaataatatatttcccctgtatgccactaaagaattagtactgttattgttagactagaacctaacattgcctatgggtctcataacaatgaatacttcactatttgttgaattagaatgtatattgacatattaacaattagtagaaaggagctttattcaaagaatatgaagaagcccaagtttaacttgaatatttaggaatacataaaggtaggattaaatgtttcttcttaatttattatagcttctatatgtttgttaatatgtatatgtatatgcttaaaaatatactttaagtaaattaaagtaattgtgatatacttttaatagtggaacttggaaaattatttttaatagttgatctgattctaagttagaagagtaaataattgattcataggaattcttatttaaacaaaatttgtgtatttctcagtaattgccttttaaaattttccttttataggtagactggcgtcgttccttcatcaccactgatgttaatccttactatgattcatttgtcagatggcaatttttaacattaagagaaagaaacaaaattaaatttgggaagcggtaagtttgttatacttgagcataataaagcaaaaatcagttgggcacagaggctcacgcctgtaatcccagtgctttgggaaactgaggtgaggggattgcttgaggccaggagtttgagaccagcctgggcaacatagcgagaccacatctctttatataaaaaaaaaaattagccaggcatggtggcatgcacctgtagtcctagctacttgagaggatggggcaggaggattgcttacatgaataaataaataccttgtagcctaccttttcccattacctttcaggttttaaaatatgttgtttctattcttttgtatcctttgttttccttttttccttaccagtgtcttaatttctctgagctgcttagtgtttatgacagatataaccagggagaatgggagggtgggcttttattatcttactaaagattatgttcagtattccctgccaagcagaaaaagtaatcatttgatttgtgttttattttatactttgttctacaaattaagattcttccttgattatgtagattaatcaaggaagataacttaagaaatgaaaataagttatcttccttgattaatctacataatcaacttcctgatagtttcatttgttaagtcaatttatgttttataatcttttgttcaataccacaaagccaagatcagtgtgtatttttcagtggtattacctttgacgaagatagaaagctttcattaaataagtaggttgacagtggaactaccataagagtacacataatagacacagatatctactcagaaattctagttgcaagacatgtaagaaattaggtgcaacacaggcaaatatggtaggataaaacgtgaatattataataatgtttgtcactttttgtttattttttaggt

SEQ ID NO: 118137 - DNA, 1035 bp, Homo sapiens
tagtgaattttgaggtacatgatttatacctttttttaatttaattttatttttttgagacatgggactcattcttgctttgttgcccaggctagagtgcagtgatgtgatctcggctcactgcaccctctgcctcttggttttaagtgatcctgtcacctcaacctcccaagtagctgggattacaggcgtgtgctaccacacccagctaatttttatatttagtagagacatcatgttggccaggctggtctcgaactcctgacaagtgatctgcctgcctcagcctcccaaggtgctgggattataggcgtgagccactgctcccagcctccgtttcagttttctgtagtggagccacataggtatcaatatattgcaaaaaatttcagagtcaattttagttggcaataaaaacagtaaaaaactgaaattgtgtctaccttgattttgaacttcattatctctaatattcgttgtaggcatgtgctgataagttgaaaagagaaatagagctgtatggttgcccccctgattttccagatgaagaagaggaagaggaagaaaccagtgttaaaacagaagatataataattaaggataaagctaaaggaaaaaaggtttgatagtggttgatatttatgttggttgaagttttatatttttctgatttatatgtgcattcccagtactagcacagtgcccaacacataaaatgtactagatcatttttttaaagtatcaaagcaaaaaattatctttctggccaggcgcggtggctcaagcctgtaatcccagcactttgggaggccgaggcaggcagatcatgaggtcaggagatcgagaccatcctggctaacatggtgaaaccccgtctctactaaaaatacaaaaattagccgggcgtaagccggtcgtaggccgggcgcggtggctcacgcctgtaatcccagcacttggggaggccgaggcgggcggatcatgaggtcaggagatcgagaccatcctggctaacatggtgaaaccccgtctcta

SEQ ID NO: 118138 - DNA, 1046 bp, Homo sapiens
taaccactagagtagctgggattatcagcgcacgccatcacgcccggctagtttttagtagagacagggtttcaccatgttgcccaggctggtctcgaactcctggcctcaagcagtccaccagccttggcctcccaaagtgttgggattacaggtgtgagccaccacgcctgacctagtatattatctttactcaagtattttagctcaaattaaacctctagtatttgttacaaggctatttaattcttaatagcaacctatcaatgtcttatttcttgtaaatctaaagtaattttcaattttagagagttttaaatttgtagatttataaatttacttttaaatattttttaaataaccttaagttatttatatcaagcatttccttcaccccacttccttattgtaaaaggaacttaacatttattcttctgtactttcttttttatactgttgttttgcagcaagggcaagtattttgtaaccttcccatatccatatatgaatggacgccttcatttgggacacacgttttctttatccaaatgtgaggtaatgtttccctatgtttgctataatggggaggaaggtttttaacgaatattgttttgaagaaaatggcagctatagaatttattatttcctgttaagagaacttaaaattccttaaagcataattttttatatttaagtaatttatttttatttttatttatttatttttgagatggagtcttgctttgtcaccaggctggagtgcagtggtgtgatctcagctcactgcaacctctgcctcctgggttcaagtgattcttctgcctcagcctcccgagtagctgggactacaggcacgcaccaccacgcccagctaatttttgtatttttagtagacacgggatttcaccatattggccaggatggtctcaaactcttgaccttgtgatccaccagcctcggcctctgaaagtgctgggattataggcatgagccaccgtgcctggcccatttaagtaatttaatttttatatttaatttttatgtgc

SEQ ID NO: 118139 - DNA, 1042 bp, Homo sapiens
cagtaattgttcaaccatttctttgaggtttgaggtacacaggtcatgataatcctaattttttttttctggcggagtcttgctgtgtcacccaagctggagtgcaatggcatgatctcggctcactgcagcctccgcctccctggttcaagcgattctcctgcctcagcctcctgagttgctgagattacaggtacccgccaccacgcccagctaatttttgtattttagtagagatgggtttcgccctgttggccaggctgatctcgaactcctgacctcaagcaatccacccgcctcggcctcccaaagtgctgggattacacgcatgagccaccgcgcctggctgataaccctaatttttaatgttcatttaaatttcaagataaccatggaaaaatcagtctttatcagtgagcagctcagttctgtgaacccaattcttttttaaagcaagcgtgctgaaatacagagtggattattctctttgtgtccaataggaaagaaaaggaacagccaaagtggactttttgaagaagattgagaaagaaatccaacagaaatgggatactgagagagtgtttgaggtcaatgcatctaatttagagaaacagaccaggtgagtaatagtttgtgaagttctgcacattgtatttctatatatatatatatatatatatatttttttttttttttttttgagacggagtcttgctctgtcgcccaggctggagtgcagtggcgcaatctcggctcactgcaagctccgcctcccaggttcatgccattctcctgcctcagcctcccgagcagctgggactacaggcacccaccaccatgcccagctaattttttgtatttttagtagagatgatgtttcactgtgttagccagggtggtctcgatcttctgacctcgtgatccacccgcctcggcctcccaaagtcctgggattacaggcgtgagccaccacgcccggccctgtgcattgtatttctaaaaccgttggctttatagtacagaaacagcttggtggaaccca

SEQ ID NO: 118140 - DNA, 1071 bp, Homo sapiens
atacaatgtctaaatgctgggctgttgaatgccactgacagtaaaaaatatctgtgcatagtggcaagccataagtagcacctcagtcaccgtatagtaattaactgcgtatcctggcatcccgacaggcaaccagctctaccgggtgaaaaggttgatggccaagggactccaacctaaccagggcgcactcgcggcattctgcgatcccgcactgcatcatggactttgtagttcaacatgccagtgacgtcactgccggttcccctctgagtgggcctatcgggtagacttccgataacccgtttttctctgggaattgtagtcagttagcgcctgctgggtgtctgctcgggtggtctgggaactacaattcccggcgggctgtgagatgccttggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggtgagtttgagcgagaagaatccgcaggggccctggagccggactggccagtctctaggggctctccatgtgctgtcctgaagggaaagtccttttctaaaagagagccacgcttaaggcgtgcctttcgtagagactttgctttttcttgctagtttatgaaccacgaactgatgtctgttaactttacggagtacttggatatcatatttgttatttctctggagtttctaaaatcgaggtggagagccgggcacggtggcccacggctgtaatcccagcactttgggaggccgaggcgggtggatcatttgaggtcaggagttcgagaccaccctggccaacatggtgagaccccgtttctaccaaaaatacataaattagccgggcgtagtggtgcgcgcctgttaacccagctactcgggaggctgaggcaggagaattgcttgaacccgggagagggaggctgctgtgagccaggatcgcgccactgcactcca

SEQ ID NO: 118141 - DNA, 1705 bp, Homo sapiens
gctaaattcaggaaataagtgcatcactaaagaaatttctgcaagtttaaaaaaagatcaggcaagcatttttcagtaacctgcatttctatcaaaacatgttgtatttaatggggaatgttttatttatattatataaaatgtataaatatgtattattcactgctgcttgtttggcttagtgtaaaactttctcttggtgtgtgttttaaaaagcatggtgggatttgtaaactctggacaatttgtctgtcttactttaatagacattgttgtgtgaatcggcatttaatttctagttccgtatctatctctaattcactctgtgacttaggataagttgtctaacctttttctattaaacagaactaaattttatttgccttttacctacgtcaccaagtctgttatgagtattaatgatgtagactttaagtggtttgtgtacctctgaatcattctataaatgtaaacaacattttatggtttttggaatatgaaaatacatgaaactttctgcaaaagtattttgcttattaatgttaaacaccactgccacttaaaaaataataatcagtctattacaagacagactagagtctcattgcaggtcctataggtaggaacaggaattgctagtcaaagtcatagacttgatgtgcagtttttgtgatttctggccatatcagtgtcttttaaagtgccctaggagattgaatatgttgtcagcttggagagtgatagaaaaggcagcaataaggttaatagactaagtttattttattggttcatatttatgggttcagtgatcatgatgcatatactttggttgaactctagagtttacatgttgctgtatgttggcagtccttatcaaattgaactctggatagtaatctctgcagttgcccaaatgggaggaaaaataattatctagcaatttttggagctgaccacctggtaaataaactaccagcgttaaataagtattttggaggtatattcttaagtttgggaagtactggtaattttcgaagtgtacttagttgcttcagagaattagtgtgtctctaaagtgctgtgggacttaaggataccattcactatttcatagaaaagaactttggccagaagacttcttggcaagttttagtctactaacttaagaacatatttgttcttatgtcctttggtctgccttttaaagatgtctgacttcatccttcctggcccaataactataggctaaagccagaagttgcctttttagccctgtgtttcttgccactgtcttctcttatcctcttacagtgttgctacttacttccttattaatctctttttatacaatgtattattttgtactgtaattatttgttttcgtatccacctcttggccatgggcgtgcagggcaaggtctgttttgtttaaagtaattccattaccaagcaatatgcttggcacttagtaaacactcagtatatgtttaaatgaatgaacattctcatatgtatatacaggtaattgacaattagaaaagtaagaattttttagtagtctaattttgtgcatgtatttagctagtggctactatactaggagctatggtccaaatatccaaatggtatttgcaactgatgaatgtatgtatatattttcctcccaaataaatctagggttatttcttccacatgatactcattc

SEQ ID NO: 118142 - DNA, 1025 bp, Homo sapiens
aaaggtataccatgaaagtctcttacctgttttatatccaccgcgttcccacctagagtacacaattttgtcagtttttatttttttcagtttctttatgcagatagatagaaacacatataaatacatactgttatatctttgagatcaggtattatcagtattctttctttttatagccgctgtgtactctgttgtatagatgtcccatagtttatttaactagtctcttattcatggaaatttgagttgtttccgatcgtttgctattatatcctccaacaaataatcttacatatatatcattttgcaagtaggtcagaaggatttaaaaacctgaaagtgggattctcttccataaggtaggactcatttttagtcctactagcagtgtacaagatgtcctgttttcctgagctttgctgacaatgtgttgtcaaatttttgttttttgtttgcgcaatatgtaaatgttatttcttctccttagaaacttcaggttttgtggacaaactatttgaaagtctctatactaagaactaccttccacttttggaaccagtaaagcctgagccaaaaccactagtccaagaaaaagaagaaattaaagaagaggtaatgcaaattttttctcctgcttttgggggcttcttagatcctgtcaccagtatccttagttggaagttgagccttttaaaagtaattgtgtattgattcaagtttccggattttaggcatggtacagattcttcatcaggatttcatagttgcttggactgaagagttgaaaagtttcagatagcttgtttagagatccaagaaatatttcagaaatattgaggaagtcagagaaatcttatctagtgacttttagaaaaagaaaacttggttaaatatagagagattgactgaaagtgaactgttaacaaatcctcaagagaaatcattaggtaacacattttcatgtatatggagaaaccagttgcactttttgattatatagagttttaaaaaatagttaatgt

SEQ ID NO: 118143 - DNA, 1069 bp, Homo sapiens
atgttgcccaggttggtctcgaactcccacctctgcctcccaaagctctggggttataggtggtctagatatacttactgaaaatttgccccatctgctctctttaaatatccatatgatttttttctcagtaatttgagtagtgagtcacatacttcatgtcttttcacccctaagtaaagtacttcagtgtgtatttcctacatataaggaatattctcttaggtaactatgatactgtgatcaagttcagtaaatttaacatccatatagtactttaatgtattatctgtgttcagttttatcaattgatcaagcaatgtcctttttttatttccttttaaaaaagttttttgttgttgttaaagagacagggtttcactatgttgcccaggctggtcttgaactcctgagcttaagcgatcctcctgacttggcctcccgaagtgctgggagtacaggcatgagccactgcaccgagtcccaagtgtttcttttttatagcatgttcttttcctctccattttcaggattgattctaaggattaggtatcatttagttatcatttccgattcatttttaaatgctaggctgattgacctgatccaacattaaaagaaaaaatgtggctatatttatgaagatcaactgagactgctgtctgttttttctttttatatcatgccctgtaattatctcatcaagttctttcaaaattggagaggcttgttgaatgtgtcttaaagtactggaaataggaagaagcctttctgttttttacctttctgtttttttttttttttttgagacggagtccgctccatcgcccaggttggagtgcagtggtgccatctcagctcactgcaacttccacctcctgggttcaagcgattctcctgcctcagcttcctaagtagctgggattacaggcatgtgccaccatgcctggctgatttttgtatttttaatagagatggggtttcaccatattggccaggctggtcttgaactcctgacctcgtgatccacccaccttggccttccaaagtgctgggattacaggggtga

SEQ ID NO: 118144 - DNA, 1048 bp, Homo sapiens
tgtagttcatttagtagtgcataaacataattgtttatagtatttctgttagataatagagtaggaaaggagtctgaggtggcacacatctttggctaattgtctttttctggtctgtgcttagttgctctgaacagggtatagagaagcaaatctagggattacccattttaactttcttccttggtcttcggctacattgggttccattagtggttttctaattagactgttgatcaccagggtaagagaatttggatcattggcaccaactcatcctgcttctggaaaaacaacttggtagacatgtgccatgatttatgaagcacactgccttcattgcctgttttctttacctcatctttttccttaaattttattttgtgaagaaattcaatcatttgtcctgtagagttttttactgtctggattttgctgtctgcatcccagtggaataatacatcctctgtatttcctgtgaattaggatagagaatgttttttaaatgtagtctagtgagtgtgtagtgattttgctgccatatggttgccatattgtggctgccgttttatgttgcctgaattttattaaattattatctcctaagtccattcactcacttcctgatttgtgtatttgtcagtgagcttctccattagataggtatttgtttaactcttgcaaataactttatttcacctttctctggtaaagactatatattcggtttgagataaacttgttcaaagacaataataaaaattactggttctccaggaggcagaggttgctgtgagctgagatagcgccactgcactccaacgtgggcgacagagtgagactcggtctccaaaaaacaaaagaataaaataaaaaaataaaaattactgttctctttgtatttctggtcaattttgacggttaggctttaagagaaagccttaacatttccattagttccaataccatttttccatagtttacatgaattacttagttttatagcattcattgatttaaccattttttcctaaaacgtttcctatgg

SEQ ID NO: 118145 - DNA, 1068 bp, Homo sapiens
ttttataaacagtcattattatgtgttttccccaagagctcaggggtgggagcagtccccttagagaatattaatgaaatgttccatttggttaggggtgcttagtattaaaatcatccaagtcatttttttatgacaagtagtacaacttgtatattgaatcatcagcctaacatcaaaaattggtctttgtttaggaacacttttttttgagccttttttcttttctatttcaaattttctgttttcccctgcccacccctccccatactttggattcacctctttttttcatttctccccacccagtataattgcaggagggatgttttttctctgtatatatttgattagaggaattatgtggtagatttgcaactttctaaaaaagcatagatatgcatttggatgactcaagagtagtatttatactatagatttgtttgcagacttggtttctatagcctgcatatggcttttatatctgtatattataggacacgtgagaaaaaaagagaagacgggaaatggagagactatgaccggtactatgagcggaatgaattgtaccgtgagaagtatgactggagaagaggcaggagtaagagtcggagtaagagtcgaggcctgagtcgcagtagaagccgaagtagggggcgcagcaaagaccgggatccaaataggaatgttggtgagtagatgagtgtccccctaaaaactctgtagttatttatctgtctctatcacaggggtgcaagaaattctcttaaagttgtacctttaatatgtctgagcagtgtaaaaactggaattgtctcaagaagctcaatatccattttgttagaaaacagggctctattctggggatggagtcaagggagtttgattaaaaaggagctattcaagtgtatcattgtacatgtctagacttaactcattttgtataatggatacaaatatcctttaatcaataaagctatcacgtgaggaagagggttgcctgcttttcttctttgtttggttttctaaaagtaattgatttgctgtaagggtgcttgaagtttataa

SEQ ID NO: 118146 - DNA, 1071 bp, Homo sapiens
ttcgccatgttgcccaggctggtcttgaactcctgggctcaagcagtttgcttgcctcagttcccaaagttcagggattacaggcgtgagccaccgtgcccagcccatatgtgaatatttaatataatcacataaacagtataattgtgaagctcaagctgagatttcatttcccagataaagcaacatcgttttatatatggaaattctaaaataaagaacgttatctcagcgtgggaacatatctatttaaaagttaaattcaagaataccatttctcccgacattttgctatgaaaagtttgtaacaaataggaaagttgaaggacttgtacttgtatacttaccatctaggttctacaattagcattttactgtatttatgttagcacatatctttccgtttctccatttttacttttgatgcttttcacagtatgttgcagacatcgtacacttaagcatgcttatcattaacttgaattctgtagaactttaccatcaccctagaaagtttcctgaagcctcttctcagccgttctccaccttcacccatagaggcaaccagtcctgccttttttcaccttagattagttttgcctcttctagaacaagtaatgttcttttaattgattatacaactcccagtgcttaagcttgcatatattaaattctttaattctattcagaaccaaattaggtattttaaatgtgagtatccaagttagtactagtatggtatttttttcttttttttaagatgaagtctttctctgttgcccaggttggagtgcagtggcgtgatttcggctcactgcagcctccacctcccatgttcaagtgattcttctgcctcagcttcccaaatagctgggattacaggagtgtgccaccacacccagcttatttttgtacttttagtagagatggggtttcaccacgttggccaagctgatctcgaacttttgacctcaggtgatctgcctcggcctcccaaagtgctgagattacaggcatgagccaccgtgcccggcctatgatggtccttttttttttttttttttttttttc

SEQ ID NO: 118147 - DNA, 1036 bp, Homo sapiens
agtttattttgcatcctaaacatttctgtatctctttgatgtcttggagaggcaattcagcaaactcgttaagcccagtttcaaatcctggttttatcatttactatctttgtgaccttgagtaagttgcttagtctctctgtagctcaatttcctcttctttaaaatgagaataatattacctcattaaggttgttttgagtaataaattaatacatctaaagcatctaaaaaagtgcctagccactagtaagctataaggattcattattatattattgtagttattattgtctcctgaaatttcaaactctgaaattgaacctattaacttcttaaatctgtaccttctaccatccctgtttttgtcaatggagtaacacccacctaatacctagaattgaaaccttcacaggactgactcattgctttgcttttttacatctggttaatcaaaaattctttttctttgaagtagccctttctatttcttctgtggcctctgccctcatccacgctagatcacttcacatttggattattactgcagcctacttgacaccattatgttttatgtttaacttccctaagtcataccacataatgctgctaagctaattttcctgagaaatccaaccatgaaagttccttatgagaacttttcggtggctaccatttctttctgagccatcagtaaacccctctctaggacttctaactcctttttttttttccttttctttttttttttttttttttttttgagacaaagtcttgctctgtcacccaggctggagtacagtggtgcaatctcaactccctgcaacctttgcctcccgggttcaagcaattcttgtgcctcagcctcccaagtagctgggattacaggcatgtatcactatacccagctaatctttttgtattttgggtagagatggggttttgttatgttggctagctgtcaaactcctggccttaagtgatctggctgctttggccttgcaaagcgctgggattacaggtgtgagccaccacg

SEQ ID NO: 118148 - DNA, 1027 bp, Homo sapiens
ataaatctcatagatatagctaattaggtccaatattttaaatattttttaagtacagttgtaaactctattatgctgaaagtgttagggaaaatatattcaaaggtttcatctatggtgtcagctatttttttattaggaggacagtctgtctcagggatgacccagaaaaaatgagttgagaatggtggcaaattacattatctgtattaatttcttttttacttatacaggaagcaatgaagttacaacaagatatgaggaaaaaaagacaggaagtgttagaaaagcaaatagaatgccaaaaggtaagacaagagctcattatttgcatgctagaattgatgtatagaattgattttaaaagtattattcataatttttaaagacttctttatattaaagtttattaagcatggttttacctttttctatttatttcgtagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggtatctatttgcattttttatttaacatagggttattgaacatctgccatgtgcttgacaccttgaaagtacaatgggacccttaggtagctaatatcctaacagggatataggcaaacaattatagtacttaaaaaaaaaatcctaattatagtaccttttttttttttttttttttttttaagagacaaggtctcactatattgcccaggttggcctcaaatgcagtcctcccaccttggcctcccagagtgctgggattacaggtgtgaaccactgcacccggctgccacaatttttttgttttagtgtttctgtagatgctctgtaccctttttgggaagaggttgataataccctgtttgaacaaagatgtgttttttaactgaatattttggttctctgctgaagatgac

SEQ ID NO: 118149 - DNA, 4387 bp, Homo sapiens
tttgtctaagattttagatttttatataagatttggaatatcagtgtcatggggaagctagtatattcacctctcacaaacaattggatggatataaaaacaaagatttaggtgtttggtcatttattttcctaattttttatagaataaaattaattttaatttatcagaaatgtatctcatagtcttttttaaattttctgtactaaatgtccacattattttcctgatgatattagagtagaaatctcctattaaaagtagcaaaattagcaggggagaagaattcatattcatttacaaaaatattttgggcttttttttttttttgccctgaaagatactcttgcatgcatcccttatgaaatctagcctgggctttgtatactagcctgtttgtcctttggcctaaaaagtattttacttaccattcttgtgccactaagcagattttaacctctctttcttcaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattggaaaaaaaaaagaaaaaagatgaaagtattacaaatttaaaagaatttggaaaatttatgaaccattccaaaaattataacaatcaccaaaagagctgtaattctggcttgttctggaaagaaagaaaatgtgtgtgtatgcttgcttgtgagagtgagtgagtagtggctatgtatgtgtgttttatgttgtgttcataaacatgagagaacatcactcaatatgaagttgggttcgaagtcactggctattaaatattaagtaggataactttctcaacagagtagcctggagaatgaaagagaaggtattaaaatgctacttgtaagtaacctttgatagccacattattttgttcctggatggttcttggtatcccagataaaaaagcacaaaacagtttcttgaaagcaattattttaatgttgtcttgaggatattcattatgcctgccatcagtaggagggacattttccttaagtagaatagggagaagggaaaaaacacctagaagagatgatttaaacataaatcagttctgaatgtgacaaagatttgtaaggacaaacgggaagatagtgatgttatgcactaaggactgggtggtgatgagaaagagaagggaagtgtatcacctggttttcccattttaaaaaatgctattataaaattccccctccaatgattatgcattgtttaagaaggaacattctttgaatttcagcttata

SEQ ID NO: 118150 - DNA, 1292 bp, Homo sapiens
tcttggacagtgatccactagtatatcaggctgacctagtcaactggtggctattattgctgatcagctacttaaaaagatgtcatacacattaagagggacagaacttgctttagatgctgtatgttatttctgtaaatgaagatgccaagaaaacatgtatggcagttattcacttttaagtgaaattctaacagttgaagatttgatggtggaagtaaatcccaaagggggcaggggatatatataaactattttatgctaacctgaagttttccagtattataattaactcacttcaaattcatctttgagtcaaacatgttttaaaattctttgaaagcacacttttaaagtatttttagtcctgtttaaggtgtactgaaaacttatagaaagggcctcaaaccttactgaaaaaactgtttttcactttaacacacttctatcttctgcccccaatactaaaaagtcaaattttcaactttttactgagagtgaaataagatgtccattttgaggtcaaaaaaatcatatgaaaaggaatctcattctgttgaactgtctactgaaatttttcttagagttccatttatttactgtaattttcagtttccaaatacaaaaatacaacaattcttattgaaatctatacgctggtagttttagtacacaaaaaaaaaacccaaacaaattatttacaaaattatacagtttaagaaaaaactttgtacaaaaaatatataaatcctttgttccctctatcacgtttaaactgtcaggactcaaaatattcaccacaatgaatctttcaaaatatatactgactgagccacagacatcaagaaaaatttcattagagatgatggaggagtaaggagcaagattgtgtattctagatacaccattctgatgttttccttcttttataagcttattttaccttcagtgttactagaaatataacaataacctagaaaaaggaagtcctcattattatgaaagaaaattatatgaacttaaaaatgaccctggtttgacacatcattccaggaaaacatgtagaagaataaagattatcagaacgtgggatttaacttcttatagctaagtaaatctagaatcctgatggttttaagttcttagtgaatagtttctatattgagaaattgtctttacctcagcaaacaaaatccttgatatagtggtcaccaagacccttttggagacaacaggaggtttcaaattttcataccacacatatataaaaacacagatgtgtatatccttga

SEQ ID NO: 118151 - DNA, 1379 bp, Homo sapiens
gctttgttcacttcattttagcctaagaggtcatggcgaaaaagaatgagttctgagattgcattttctgtcgcaaaaggttgatagcagattatgaattcatgataaaattaaaaactgaaatcaggcaaagagagaaatggttttgttcatgcatttttttccctgctagcttcacaatggaatttttatatctcataataataaaattctaggcattgcaatgagtcctttgcatcggtgatttcatttatctctcatgatagacatacaaagtggtattagcatgcttacatgaaaccagaggtacgctgtaagccaggattgaactcagggagcctgattccaaagtctgtgctctacttgtcaccatacaatatgcctgccccgactgaaattcgtgctgtgaataaatgttctttgtgtactaacgaagtaatcttcaaactgcagaaactttgccacaatgctctattgctggcagggccttgagaatgatctaacatgaccctttctatcttttttattttatttatttatttatttatttatttatttattttctgagatggagtcttgccctgtcacccaggcttgagtgcactgttgcagtctcggctcactgcaacctccgcctcccgtgctcatacgattctcctgcctgaacctcccgagtagctgggattacagatgcctgccaccatgcccagccaatttttgaatttttagtagagataggttttcacaatgttggccaggctggtctcgaactcctgacctcgtgatccaccctcctcggcctcccaaagtgctgggattacaggcgtgagccaccgtgcccggcccgaccctttctatcttaaagcttattttataggtgataatgtggtcaggtagttgacaggggacctcttctctaatccccctcttgttctaaaattgctacagaggtcaaattgatacctctttcttggctcttgccatcacttctcataactctcctctcctttctcagggctgacctctgcacctccttatattacatgaccctgtccatctcagtcctcaggtgattggactgtaggtgaacacctaaccttggggaaagcaatcactagtgggtagaatcagccaggctgtcttctgggaatctggacaaagaaagagagagttgagaaataatgctgtctcctttcttaatcagagtgatgctgtttagaaattcctgaagtcatcagcttcataattacatcctacagatctgctctgttgattctcagcctagagcagtttgtatatgttgccccatctttgcttcttttatccccttctctcttttcagaactctttacttgggagtcactaaaacttttgctact

SEQ ID NO: 118152 - DNA, 1716 bp, Homo sapiens
gtaaaccctttacttaggtttgtctcatttaatcctcacaaccaccctttggagtagttgctattaacattttgcaggccacagaccagaggggtcttcagttgttactcgcccatcttacaggtgagataacagcctcgtggaggttgagtcagtagaataagattgcataggcggatttgtggctccaggaagtggcttgaactcaggcagtcaggtttcagagcctgcaatcccaattggcgttctattcgtctactactcatgccatttccttgaacagtgcagtgacctttttttcccctggaacctcagtgtctatgagtttgtaattaaaatttggtaaaatgagagtgacctggagaaatcttttggtcagtggtttttgaggaaaagaggtattatgctttatgtgtatttggtactttggtttttttctgtatgggagaaatggcatttcagatgttcagctcccattctgaattgtgctgttgtcaacgtttgaaaatgaaaaagagcagggtagattatgaagactctgttgatactgtcttgaacttaagatgaaattgtgtaaggaaatgggtattgttattcaaggttttagaagaggaaaatgcctttcagattctgtatggtcgcacacacaaatctccactttggcagaaatgaaattttgttttatttcagagatgaatctgaaatcctttaaactccatatgtatacagtattaatgagtgatcaaggtgaattgtcagcatctttaaatattagcgatgccaagtttattcctgatttcgatcttaaagggaggttacttagctagtttcagatggatttattagggaacattcttttgcattttagaaagtatctttctaaagctttaaaaaaatccaaatggctttattaatagtctagacactgttgcacaactgatttgaatagagctttaatttgcaaatgaatttgccctgttgcaaatattttataccgtagcctcttggattggaagttgcttgcagagcatactgtacagatctttattttagcatttctcatgaaattaggtgtgtatgtggcctctttgatggcagaagttggggcttaatttttgcattatatttgtaacctgaatgtacttcatggtgtgtctgtcataaccgcctggcaaatgagatgttctgtagttatgttgtaaataaatgaagataggagatttaaagatacttcacttattgggccgacatttattgtgtgctacatgacagttgctgacctaggtgctggtaatagtgccctgaaccagaccgaaaaaagaggtttgtcctgcaggagcttccagcttaagtaagagccatctaaattgtaaatgaaatcaaccacatcaaatgattaaatctgcctgtaagtgtgaagtgacttacacaaggtcactgggtagttggcagggtctggactaaacctcaggtctcctcaatcatagtttatacaatttgcccccatatatcggtagcatctttttatttcttgcccctccagttaaagtattgtctttagcattggggagattgcatatctggatagagaacttctattgtagaaaaataccttatgtttgtatttccatgatgttcttgtgaaatatttttgttccttctattcatgcaagtaggcttttgtttttcagaaaggttgtaagtggtaggaatgca

SEQ ID NO: 118153 - DNA, 1119 bp, Homo sapiens
tggcacaatctcggctcactgcaacctccacttcccaggctcaagcaattcttctgcttccgcctcccaagtagctgagattacaggcgtgcaccaccatgcccggctaatttttttgtatttttagtagagatggggtttcaccatgttgtccaggttgatgttgaactcctgacttcaaatgatctgcctgccttggccaccaaagtgctgggattacaggcgcgagccaccgtgggccacctgaatcctggctttagtactgaaccagttgtgtggccttggacaagtgacttctttgctttagttctttatctataaactgagattaatagtatccatctcattgggttgttttgatgattaaaagacttaatttttgaaaagagcttagagcaagcactgcctggctcatagtaagcacttttaggagttaataattctctttacaaaagcacttgggggaagagatagataatactatctcatgtgatattacttatttgcttaaatgctgtggagaaaatacattagggtgttgagagtgaggggtggtggggcagtgtgccctacagggaaaggctttccctttaggtagagactactaatgatctgccaagtgacccccctgccccctttaaaaactttggaagtaatttcaaatttacaaaatgtcgcaaaaataaagctagggtgttattcaatgttaatattttacctcttctgctttactatttgcgtgcacacgtgcatcctctttgttattctgaactgtgagggtaaggtatacctatggctttttacccttcaatacttcagtattttctaagaatagagatattattttacttaactacagcctaattatcaacttcataaatttgtaatgatataatactttaatctgttgtgcatattccagtgttgtcagttgatctggcaatgccctgtatggcatttcctcctgttagtacagaatccaatctagagttaaaattgtgttgttattggccgagcgtggtggctcacgcatgtaatcccagtactttgggaggctgaggtgtgcagatcgcctgaggtcaggagttcaagaccagccttgccaacatggcaaaaccc

SEQ ID NO: 118154 - DNA, 1141 bp, Homo sapiens
gctttaaagataaaatatggttccattcttgtttttaataataactgacagattttatgataccattgatttttgcttccgctgcaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaagtgagtaccactcagcatgtgtttttatataggggctagagacatgaacaagtaggggactacatttcatattgatcccagtgtttctggtattatcctttaataccagaattatttaaaatacatttttgacactaaaacttttgggttagaggaaaacaggaatttatattaacaggagaaattatttgcccagttgcagtttatgaagctaaattgagaaagtgcaaagttagctgttccacttggccaacagtaatgccgggcattgtgggtttgcaaaataagtgtaagtcttggtccctaccttacagtttccagtattcctaatcgaggaggcaagaataacacgtgttaaacaattagatattggtgtgcaaaactatacagtgagaaagatgtaagaatttgagaagtggataaatgagtgggtggactacatgggtatttatcatgaaggaaacggagtagggtttaagcaggttcacaggtaaggaaaggattttcaggtaggagaagcaacatgaataaaggtcaggaaaatgataaatgtagtttatgggtttttaggaaacttctgaggtgagagggtgttttttt

SEQ ID NO: 118155 - DNA, 3493 bp, Homo sapiens
ggtgatgagctagataatttaaccatactatatatagtccatgtctgttttcagagtagtgtgtcagtaagctcatagctgtcttgtgtcctgtttgtcagttttgctttactcttcagtgattgggaggactttattcccagaaatataatatagcaaaatcatattctttttactgcttttaaacatcaattttgatgttgtctacgtattccagtgtgtgtttttattttacttgatttagtatcataaagtgttgtcttactgcaatcttaatatttctccatctattatatatagtcacttgtcttttttagttaagatctgaggctgggttagtatattttgaggcctagtgcttcactagctactttagcaaatgaagttagtgggaatttacccactgaagtcttagataccattctcccagtttcccattattttattgcttttgttcttttcctgtcgtgactcatggctgctaatcaaattcagaaaatgctgtgctggaaagtaagaggaatgggttgtaaatattttttgtcatctccattggtgttcttttccacttgaaatttgatgcccttatttattttcctgactatagtactttggatcacaattttagcaattatctgaatactataataatatttaaattttaattttctgagctacagtatagatctgtggggtaaatgggactaaaaattaagaatatattttaatcccagttgagcataaactcattttgtgcaagtttgtgaaaaatgatgaagaaatcctacttctcagggaagttgggaacaatgaccagatacattttcagccagtatagtagattacaaatgctaaatggtatatgtatgggactgggcaaatgttgcatgtactttgtatttttcacactgttataaaattatattaatatgatactgtaccctaaggctaggtctatgctagaccaacaattcattcctgggcccctgaagatacttgtttggccctgctgtctatttagccaaggtgagtccctcattaacaagtacgaaattgctcacatcttcccagcctaagtgagtttttcattattagaagctagaaaaagatactgacagattttgttgtcagttggattattgggtgatttgtattaaatagtgtgcttttgtttagaacaaagttggcataaagattgggaaagcactgttttcattttatttcatttgacaaattcattcttagtccgatacaggtagacatttttttctttacatcaaaaaaagatgaagtatttgttaccaatgaattaccaaaatgaattttattttggaactagatgggttatgaataaataacaaaattgttttgtaacatgtgagaattgaaactgaaaagtatgaaataaggattttagtttttagtttgattttaaatgcaattactaggaatgggatgttttattttcgatatttaaaaataatgtgttagcagaacccaaatgatcctgaatttcacattttcctggtctctcacaatggaaacctcagtttaaaaaaattttatttttttaaaataatgagagaaacctgagttgtttttgattccattcattcatatccagttagtcattagttatttgcttatctttttctgttcttttcttcctatgcatctgtgaggttaattcatcaaatgaaacctgtttattactcttccatacaggaacctttagtttgctatatacccatttaccttcatgaaatcacataaataatgtgaatgcattcttataaaaagttcaaagtctaacaaaacgtatatattaatagtaaaatgtgaaagaggcattcacagagggtaactaccattaatgtattttgtcttgtattctactagataattttctctatatttacctaagttctgcccttttcctatccatttaagggcatactccttagccttttgttcaaggctttctaatttctgcttctggcctacctttccagccacacaactcactagttttgttggtatgcctactgtttcactcattaattgcttgccttcaattttctaaacaattccttttggttctttactctttgccttattcatacttttctcactggtttatttttttcttctaccccttcctgctgtttttcttgttgaaatcttaatttttcaaggcgcagcatcccaatataaacttttctataccctctcacagttagaaatgttctttgggtcttgatttttactcctatatgtttatcccattttactttgtattcatttttgtatttcatttaagtattttcaagcttcttgaagataagaccttttgacaaatttcttgcagtgcatagaatggtcccttaaatacttaaattactgaatgtgtaaatgatgaatgaatatagtaaaatgatttatgaaggagtgatacatgtttttgttttatcttttatcagcacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtaaaccaacagattataatggtctttccagctatgttttcatattgtcagttagtttgttctcatgtgtctgttgcgtttgaaatttgccttgaatctcacctgtttgaaacgtttttgaaagattcatggctaactgcaatattttctcttaagttttggtaaatgtcctttttttgttgttgtttacatgtcctaaaattagagccacatttaaagctacacttattttggataatgccctcaatgagttaaaaatgattatcttttcatgtaaataatgttctaaatgcaatatttttgaagggttgagtttatgaagttgagaaatcacgtcacaatagctaacacaagttggatgatttatatacagtgcactgttgtaagcatgttacatgcattaactcctttaatttttacaacccatgttacgagataggtacacagacaggttaaattacttgcccaaggtcacatagctaataagtgatgatgttgagatttgagcctgtgccctccacatccagatagtaagcttttaataactatgttaatactgggaagaaaatgtgagtgatttaactataaaacaattcatataaaacaggaactagaaggttcccttgtaacaattatgaagtaaagcataatgtgcatcatttaaaagtttaaattgttatggtgaattaatgtgttatattgtcttaagagaagtcattaaaactagagaaagaattaagaaatattgtggagtggaattcttaccatag

SEQ ID NO: 118156 - DNA, 1054 bp, Homo sapiens
tgaatagaacttaggcctcttgtctctcaagttcacattccatccacttattgctactttcttatactcctttctgtgtaagaatacagttgtgatacagctatttcttagatttgcacacatcttaattatcactattgcactggttgtctttttctttgtgaccactctgaaaaggacaccttcagatataccttgtcaagaaagaaaccaaaaatttcaggttttttttttaatttggaaaaccttgtatacattgttgatgtagtgttagataattaaatgcccattatgtggtgtttaagaaattcaaatcatttaaaaagaaaacaaaagatgttttccctactattagggattatcccttttctagattaaatttaagacaagcagctggatacttttctctatgtgtaatttttctgggaaaactaaatcatagatggagaatagcctgatatttgtcacaacctctttttgtaattttggtctgctttagggttaaggacagtattaagaccagatcgtggattctgagtgatctcaaggagttggggttgctcattttgtagagggaagattgagaggtagcatgataatgttgttgaagtattttgaaaggctgtcatttgaacaacttttgcttttctttagaggttcttattaggactaatggatgaaaggtacacaatagcaaaatgtatttctatagaaagtagaagtttctcacaataaaatccctctggctctagcttcattttgatgtcatattttccccaaaatatgatgacatattttgatgtcatatggagcaagcatatccttgctccatcattaaaaagatttggacaggtggtggtgaccatttgagtcaccaaatgaagcagtacctgtgaagtttggcagtagaagtcattcaataaacagtagccattagtgacattttgggggtcagttggaagagaacttgaattggatagtctaagatttctttggagagagtgagtgtcatacaaagtgatatattaggctgggcacggtggcttacgcctgt

SEQ ID NO: 118157 - DNA, 2041 bp, Homo sapiens
cggatggtcaaacaagataaagggaaggagtggaagaattaggtaaaatacaagagtagggggtggagtttggataaatgggtctaggattataggagttctacttctaaaactataaaatcttatctggaattttaagaaacttaactgtctgtgacattggaatcatccaaaatgctgagtggaattttcttatttcttagataataatttgaggacagagttgtaggaaaattgaacaaaagctccctctaaaaaaaaaggttaaaaatttagatttttattttgcgagtattcacaatctgcatgtaatcactttgagagaaacttcagtgtatctttttagcatgagaagaaacacaggacctttctatatggtctgtatgttgatagtcaaatagaagagttctgcgagcccaactgatttttaataatggtggttaagcctatgtatgaatagatttgattttcttctgcataagttgtatagttaaaattatttattggaagatggttttggagaacagtctttgagagtaaagttcgtatattcataagaattgaatttcctgtgctgagtttagtaggttcagtgctcctgcagatggcagtatttatactgattaaacttaatccatgctgtaacttccttaaccaaatgaatttttccattgctttctttcaacattagggaaaataaaattatacatataactttattcaacatgctttcatgatccaatgtttttattttagtttaaaagttaatagaaagtttactttattctttatataaaatagtaattaagaaataaaggtacttttcaataattgacactatttttgtttgcttgtgtgaacatagttaaattgtatacaaacccaggagtttaattttacttttagtctcagaggtaggagaaatttttttcctgtcctttagtggggaaaatagtttattgttactatttttaatttttatagagtaccaactaagcttagttttttcagctgaaaaaaataaaaaagtaaaaattattgcccctatacttttcttcagactttggccttttcctctaaaagtttttaattttctcagttaatcagtcttagttttgcagcttttcttttcattccctttttaaaaatcaccattgtaatgcatcatgatgagtcttcattcttctaagaactgtacataattttcattctttaatacaagtactacttctttagttagcttaaatgatagaagtttctgcagccatcagcccaagtagtcattagtggtattaaaggggctgtatgtttcttaatgttttagcctgcttccacagtgttctaaggccatggggttccatagagcaggcactaaacatggatattttggcattagtgaaatgctaccttcctcttcatctttgcctttcttttatttaaagtattatttgcagtggaatatttggatccatctcataccttactttcttcctctcctcaccacccctagcttattccttttttacttctgcatggttgtactccatgcctcagctcctgcatgtagtttcaacttagcggcagcatagagaaagtgtcttgtcagtgtcatgctgcatctgccttttactggtatctaagcaacagcagcatgggtttgatgtcctgtgggaaaatgtcccacatgagaatttgttatgtatgtgtaatgaaggggctttcttttgttgaatttaaactcttaagactccttcaatatgttcagagctggtttgataaaaaggtaattgatggtatcatttagaattagtgtcattggatttggcagcacttcccacaaaatgtcaaacagaaagaaattttactccattcttggtctttttcattggaaatagcattctaaattgtagtggtaaattatttccctgaatcccagtggtagccgacatacaatggcagctttccaacgtatgcttgcttatccattttacaggtgtagcaatgatgcaaatagtcagctgcccgtatgtaaagacagtcg

SEQ ID NO: 118158 - DNA, 3855 bp, Homo sapiens
tatttttgatgtgtgtttttaagttaaatataaaaaaacatttccatgtgtaaagtgatgtgattatgcttgcatgctagtgagtatatgtgtgtgaatacatgtgtatagtatacatttacattttaaagttattgaagtaagataactacctgaaacttaaaattcagtataggatttgaggactttttttttttccagttttgattcacatatccttattttaatagtattttatttatatattaccagcttatttagctgtcttgtaaaaaatataaatcttggtttgtcttctaaaaagtagacgagctttgctttctcttaggaaaagagtaaacaaagggtataaggatatttgagttaatcatttagagtcgataaactcagtcatttgctataaaactgagaatattcatacccttttagttaccttaaaattaaaaataattttgcctaaggaaatatgtgtagtaaatatgtttgttgtcttcattagaatttgataaattatcttcataaaaatagatttctattcataagtagagaatataccatgtttttaaatatttattatgttaagactttgtcataggtgagatccaaatttctgactgtttttaagggttgaatttctgtgtctaattgagtttaggcattagaactaaaaatccagggaaatagaattaagtggtatttttatgtcacctttttatatgatttttgttttgttccaactggtccattcatttattaatatttaatagaaagatttagctcatattttagagttttattttgtattgcggtttgatacttggatctaattttttattattctttttttaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaaggtatatagtggttttaatgacttggaaagtagtataaactgtaataagtagaatggtatttgaaattctgagttaatttctttttaacatatttgagggattttctaattacacagtcattggattgtttatttttactgaattgataaatatttattttaaaaactagttctacttacatgtttgtcatcatttttttccatctggagaaatggttatatgtacgtacatatgtatgtacatatttttactgttaggaattttctaattatattgcataattattgtaatcatcattgagattgataatacagatcaggaaggaatgtgttttttatatgtgttctgaagaaaaaaatttaggcccttagggtcttagatgtagaagattcataattttctatatcacaagctgctattattattgttgtttttaaaatttgagacagagcctcactgtgttgcccaggctggtcttgaactcctgggcttaagcaatccttctgcctcagcttcccaggtagctgaggattataggtatgtgtcattgtgcccagctcaccaaacccccttttctattcctaagtatcttagtatcttatcccttttagcaaaatgaatgattgctacaaatgatatatgaatgacctgaaagatttaatgtgccttcgaagtcagtaggtcatcttcaaatcagatagttacctgattggtatagcaaggtatttgaagttgtgcattacataagattcaaatcaaagatataaggaaagacattttatcttcatggttaatacttgggaatggaatatcttaatggcttattctctgaaagttcttagaaaattacgtcaaaacctttgagtgacattatcttaatttttttcatagaaaagttagaagagaagattaaagagccaattaaagaaccctctgaagagcctctgccaatggagacggaggaggaggatcctaaagaagagcctataaaggagataaaggaggtaaagggccatgacctgttaacctgggagccacattaattgtttcctacagcttacttgtatctgagtatctattggatagatttaaaaataattgttataaatttgatctctgaaattttaggattcttgcaagttcttaattcagttttttctttgaaagtgtcattaaattacttcttgtactaaactgagatccatagaaagacagggccttggaccagagcttggacctgatctctaaccttctgacttataaactgagtggtatttgttaaaattataagtgtaacttcttacttggggaatgttagatatattttatctgtcctttctgctgttgtgttcttgcatagcatgatccatgtatagcactaaaagagttttttattcagtgaaggatcagtggtagtcgtgtttcagtagcaggaaagctagcagaaataagaaacaaccttaaatgaagaggtatgtactgtagttctccatatctgctcctaagcacatggttagtgagtctataagataggacaagctgctgctgctgggttctgctattgtgaaattcagctctttctgggggatgaggatttagaactttcttcctactcagagtctcctcttattctagcagcagattttgtgttgattgcactttgagctgtttgccttcatgtttttgtggaacattcaggtattgttaatgtgatactaattagagtaatatcatttcttgtaggagcccaaagaagaggagatgactgaagaagaaaaggctgcccagaaggcaaagccagttgctactgctcctattcctggtactccatggtatgtatttggctcaagtagtaattttttttttttttttgagacggagtctcactctgtcaccagggctggagtgcagtggcacgatctgggctcactgcaacctccacctccctagttcaagcgattctcctgcctcagcttcccgaatagctgggactacaggcacacgccaccatgcccagctgatttttgtatttttagtagagacggggtttcaccatgttggccaggatggtcttgatctcttgacctcgtgatccgcccgcctcggcctcccaaagtgctgggattacaggtgtgagccaccgtgcccggcctcaagtagtaatttttaaaaatcatacttgattgttacatggtttattttgtagaaagaaaaagtactttaaaaagtgtatgtcaaatatgtttttatctactgaatattttggcctttgttgtatttgagttattcaaaactgaagttcaattactacaagtgtcttcctagtactactctccattaatgtgtattcttcataattatagacatgaccactgtgagatcctgaatctactttttgtttaaaatattttaaatttgtttttgcatgtttactcactatgcgattacatttatagaattgtgtaaaattatgtctttcaatctaagtatggcatacctcattttatagtgctccactatcttgtgcttcatagatactgtgtttttaaaaattgaaagttttgtggcaaccctgtatctaacatgcctcttggtttcattttttcaacagcatgtgctcattttgtgtttcggtgttacattttggtaattcttgggatatttcaaactttttcattatttttatatctgttacagtgatctgcgatcagtgatcttttatgttactgttgtaattgttttggggtgccacaaaccacacccatgtaagatggtgaacctaattgataaacgtgtgtgatctaa

SEQ ID NO: 118159 - DNA, 2336 bp, Homo sapiens
gcttccattttgattgatgccaaactttaaggaagctgtactgtaggtaaaatgctatcaaacagcattgcatgctacagagaaatcttttgcgaaagggggagtcaattgatatagaaaacttcatatttgtcttattttaagaaattgccacagctaccccagtcatcagcaaccaccagcctcatgagtgttcagccatcaagagattgaggcaagaccctccaccagcaaaaacattatgatgccctgaaagctcagatgatagcatttttttagcaataaagtatttttaaattatagtatgtacattggttcttttggacataatgttgcacactaaatagactacagcatgatgtaaatataacttttgtatatggtgggatacaaaaattttgagatttactttattgcaatatttgctgtattttgttggtctggagctgaacccacaatatccgaggtacgcctgtctacttctttttttctcttatcttgtttttcccttttcttccttttgccacatctgtgcttcatttcctgttcctgctccaacttatttaatctatatacaatccacacattgcaatgatttggcttgtttctgaagtcttgtaatctataggttcccttctgacttcttttccttgtttttgttattgaagaaataaatgtttttcctatagtgttcccaagtctggatttgtccccatggtactgtctaataggatcctccattcctgaatttcctacagacaggcaagcaggtctagaagtgtgatcagattcggatttaatctttttggcaagcctagttcataagtgatgattattattgtgtagatcagatgttttcaactaggagtaattttgcccctagtggacgtttggcaatgcctggagacaatttttggttgtcaaaacttggagggtgttagtggcatctagcagatagatgctagggatgctctaaacatcctattatgcactggactgctcccaacaagaattacttacctagcccaatatgtcagcagtgtaagattgaaaaactctggccaagattgattaaatcattaacccgattaaatcattaacccatttatgctgaaggttgcaaattttttttgtgaaaaatcagaccttggcaatgaccttgagcagtaggatataaatcccacaagcttagcgttccaataatggaacactaggcataactgtgttaagggttgaaagtagtggtaatgtatttcttttattcccttttcattaactgggatgcttatagagagatacttccccttatcaccattggtcacttagaggtacaaattgtataggaagggaagggcttagcagttttcagaatagtgagttggtttgagtattattcataggtttaaatatattttctatgtttttaatctattgcagtttttatccttattgatgtttaaaattgtctcatctttggtcaggagaagcctcttgcgctaactttttaggtttttttttgttaaaatcctctgtagcttccctgctttctgctgtgacaagatgttctaggcttatcttgtatatatttcctgtctcagacctagactgagccatttctgcagggggctcttggcacttttgtgggaagtggatagtttgcaactgaattagtcattatttttagacttctttggcagacccagctggaagatatacacattcaaagatacagcatgagttgataccattacttgccatttagatctacctgaagatttttattgaacctcatcatctatcttcagtatctcatttcttgctgaaaatactgtttctcaatgatagtgacctaattactcatttgcttttctcagacatgtcactgagtaacaataccaaaactatcactaacaatataattactgaagatagtttttgttgttgctctaggaatgtataatcaaattactgtgttttaaaggcacttggaatagttgttttctgtataatttctatataattattccactgactgttacacaggctcatttaaaaaaaataattatggaaaatatttacttggtttcaaagttataaaaacagtctgtattccaagaatatattcctgggttgtggtttctctgtttgagtattgtacatgaaaagctagtaaccaactccaaaccccctcaatttggagcttcgtggtcctcattaattttcggacttgggggtccgtccccacctcctctgttcttcagatgagatagttaattattgattttttattttatttttttgtgacagggtcttgctctgtcacccaggctggagta

SEQ ID NO: 118160 - DNA, 1004 bp, Homo sapiens
ctttttattttagatataattagatcttaaagtcttcatagaaggttgcatttcagtatgtagttttggtttgttaagaaatattaagaactatagtagctaggatgctatgtctgttctttagctttagaactgcttaatagcattattgttgccattaaactcattctttctgatagtttaaaatttagtactctcaaattgagtgtgccaaaccaaattcctaagcattttaatctctgatcacaaattgctttgcatttcttggttttctcagttaatatgttgatctgttatttttgcttgagtcattcagttatcttgtaaaaaccatgtttggttctctgtaaataactattggtaataagaacatgtcgttcttcagtaccctcatctccctacttgtaacaggctgaaagaagtcctagctgtaaaatatgttctgtaacataagagaatgatattttgcatcaattcttaggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaagtaagttttaaattaggaatttatccactgattttaacattcttttcatattttgatagaaaatgtggaaggcatttagaaaccctttatttttcaaagaatataagaagcattcgaaaaaaatagactgctatcctagtttgaatgaaataatagagattaaaaatatggagagaatttggataagattgtgctttgtaaaatatgtgtgtctttaatttattgtcctactcaagattttcagttagtccaagatatggttggtagtgttgctgcttgcttagtgcttatcaatactactaaaatgctcctcggtgggccttttagcaccttttgtgactagtaatatatttcttgaaata

SEQ ID NO: 118161 - DNA, 2815 bp, Homo sapiens
gatatttgtacgtaatttttgttgtgtatttcttattggtaatttgcccttgtgttgatatgattgtgtttttatagaactgtggcccgcaagtggtatagaagcaagataaatgaattatttaatgcttctaatgaaataaatcctagtgtgtatcatttatagtcattgagacattttcatgcattatatatatgctgaattataagtaatttctgagtcagtgccgctttgcctatctagtgctgaaggtactaggctcaccttcagcaatacttgttttataggtatgataataatactttataactatggtattgaatgatgttgaaacaatatgtgattttcttttgtttttcgtgaatttgtttttaaatatttgattcattcatttgataaatacattaacgtgcattgttaaaaggtactgtaaatcctgaatcaagaaagctttattttatatatttgtaaatttaaggtttgggcaagaaacatttcaaaatgaattaaatttaatgtaaagggaggataaatagaggaagtgtagaattatgctttgtttaatgttttataaagggatgaatattaagaggtgaatatattatgtaaacagtaatttttaaaaagaaaagtttgtgaaatatatgcaaatgactttgtaacaatatttgaaatgtttttgccagggcacccaactccgacaatgctgtcgatccaaaagtggcaattctctatgagtgcaagtgagtgaactaaccataaattgcagcttctttttaatactattaaagcaagtgttctggtagtgattagcagaaggattcattcctaaatattttaattaaattttgtcttatagttaaagaggaacaagaattaatggaagaaattaatgaagatgagcctgttaaagcaaaaaaacggaagtaagtaatacatacgatttgattgaggtagattatatcttttaaaagtcgatttggtaataatttgtgattggaagggacaggtaatgtgaatgttgttaggaggcatgattgctctcttaggcctgataataaatagctttgtttttcattgtagaaaatgtgtcccttcttttgctagatttgtagaagatttgggtattcatatatgtattatgactccaaatgatagttttggaattaattctttttggaaatttattaggtctcaattttatgaaaagttagtttcctccctcatttagaccccaatggataccattccagagatctcataaaaacagacacagacttctccctctttatatggttatcttacgacttacctagtccttgagtctggtcattaactccttggtgaggagagaacccataagcttaggaagtgctctgcgagaaagagactgctaagaagtagaggcattagcttggccagtgctctagagttgggtaaaatgtaaatgttatggcggggggaaggatggggtagagggtatgcatgtatggggaatgggaccattatttagcagcaaaaaggaaagtttgaagacattaacaggaactggttaattgtagtccttatctgaaaaggacagattgaatgcagccaaattatggcaaagaaatcagtaggacaacccctataaagggtagttcttttaaaaaaaatttctttattggcaacaacataaaagatatgaaagaatcactcataatttatcagcgtaacatagctattctcatttttgcaattgactttttagttcttgaccaaatgtaatttttattagttgtgattaactgattttgtgctttttttttaaaaaaaaaaaacctagaataagacatttgttttgttaattattataaatgactgtattcattctgtttatgtaccataattttggatgttcctacgatgttaaacttttaggttgtttttaattgtttgttcttatagacaactctgtaaggtttttaactgcttttatcaggagaatgtcaaagaagtcctttatgtggattgcccgagcttctctatttaggtacaaagctaaaagcctgtttttcctggcttagtttttcttttatttcctttattgagatagatagtgatagtttgtattgtgacattttcatttagtatagttctataaaggttatttgtttttattagttacttcttggatgtcttttaactctaactatttaaatagttttaaaattattattataagagggtatattgtttggcaaattgcttttacctgtttgttttgtgcatatcttaggtcacagactatctcgctaagttcctgcaggtcacggactatgtcttctatttcttttgattcattgcctaagttgctaagtacctctcacttgcatttgtgggttagccttagttccatttaaatctctggggctacctacagtttcctgtatagcatgcttttgaatttccacatgttctgttttcctaattcccttaagtttgtatagggaataagagccaatttttaaaatatacttagcagatcatatttaagaaggaagatctgctaaaatacacccagatattattgaattacatacttttttggattatttacgtgaatgggcctttttcatagtgcatatatttgagaggtgccgtgattccatgtttacaatttcacttgagtaccacacagaaacagggttgcccttacacctgaggtgcatttttggaggaacaagaagtagtttagtcattgatgaacagttctaattccacctaactactcctgggcccatgttgctctctgggacctgtccttcaacttaaa

SEQ ID NO: 118162 - DNA, 1015 bp, Homo sapiens
ttgagattactaaaacattataccacttaataccaatttttattagattttacaaaatattttatgtgtttataatgtaaaacattttggaaaatactgttttttctatatttcaagaactaaaaaaattatattttgtgctgtttgattctgacacatagaggtttactgcagtgttaaacttttttttttttaagtaaggttgctccctttttatgttattaaccagtgtcagggagagacagcccattaaaggtgtatttttttcctaataatgtagccattgtaaatcattagaagcccattttaattttgttattatgaaagttatttatcccttagagttcatttgaaaccctcaatataatttgtttttgccaaaaatatgctgctcagtagtgagtcttgaaaattcctttgattttaagatttctaataagatctgagaattaatattttgtcagttgatgtcttatattttattttttataggagagacgataataaagacattgactcagagaaagaagctgccatggaagctgaaattaaagctgcccgagaaagggccattgtccctctggaggctcgaatgaagcagttcaaggacatgctgctagagagaggggtcagaaaacaatctttgggggagatatttctgttttgtataagtaatataaatatgtcttgctaaaaggtcaaatctaaggttagtgctcatgttatggggggggataaggggatttttaaaattactgtacattttttgcaacagcctttttcttggctaatcttatcatatttaactaaatgccattttactgtccttttaagtacaaataacacttaacatttattgggtcattaaattgtggtgagtaatataagacgagtattaacattacagaatggcggactgcttgggataggtaaggtatatatgattattcttcctttaatatcttgagaatggcttttgttaaaggagaactgatactttgtgatattattattt

SEQ ID NO: 118163 - DNA, 1630 bp, Homo sapiens
acacttccaacttacttaatttctgaattacctgaactatcctgacactgatctccataaaatggtgagtatgtggaaccacttgctatagtgctgttaagctgtaagatttcatttggtaacagtagtgcccatctttgatatttttaatgtaacaattgaaataattcttcacatggtgtgtaccattatgcatgtaggtctaatcatggacttgaatgaagggagaaaatttacaatgtgccagatatgtattttagtacttggaatagaaagacataacttccttaatgtatttgcatcttcattttaagctttgtatcttttttaaaaaacaaactctgtgtgagttttttattctcatttcagtttatggctctatcaaaatttataaattagccttgattccttacttttcccacttcccctttacagtcttatcagcaaatctataatctaccttcaaaaaattttcaaaatctcaccttttattaatcatttcccccattaacaccctaatccaagccaccataaacaacccttatcatctgtgtagcctattgttgatctccttcattccatctgttcttgttcctctttagtcaagttctttttccacacagcagccaggctaattttaaagtttaagtgatactaaattaagtcactgttcccttgcttaaaactgtttagtgctttccatttcattgagaataaaattgaagctcttttcatggtctctaatattctacatagacttacccctgtatacctcttgatggtcttttttaatgtctgttgattacagccacactggccctgatattacttgaacaagccagtcattctggtgtttgctattccttctgcctggactgtttttcctccaggtgttagtacagccagcttcatttcattaaggtacttgtcccagtgccttctaatcaatctaagtattgtctctttgccttttctaatttctttatggtgctcatggctctaattgtataaaattatgtttttattatttgtctcctcctcctgcaaaatataaattgtatgaggctagaaactttgtcttcattgctttatttgtagtgcctggaacattgcctaatctaaatatctctgaaggctttaaaacttttatgacgtattcctcctggtactgagtgttatagtgaaattagaagtaacatattgagaactatagttctttcccaatttttgaagcattctataagctgatggtggtatctccttaatagaattacgtttgaaaagagaaaatattattctagtgttctgttttcaataaaatctctagttaaaagttctcatgccatttatttatttatttattttatgcatctatttatttagagatggagtcttgctctgttgcccagactggagtgcagtggcgccatctcatcttactgcagcctctgcctctcagggttcaagtgatcctcccaccttagcctcccaagtagctgggattacaagcgtgcaccaccatgcccggctaatttttctatctttagtagagacagagtttcaccatgctggccaggctggtcttgaacaccggacctcaagtaatccgcctgccttggcctcacaaagt

SEQ ID NO: 118164 - DNA, 1078 bp, Homo sapiens
ggcctttcatggcttttaaatagaattcttctctcaacaatcagaatgtaagaactgagaagaagtagtagttaacatttggcatttaaaaataaacacgttttttgaatacttggttttattatttgcataggagtataaaatgaacaaccagaaaggtgctaggttgcacattacacatttgcactttgtaatttcatatttgcagtttgtgctttgatttagaaaacactaataacttcattggaaatgccttgtaatacaaaattatatttcagttgtccttttctagttatttgtagattcgtgtacattctgtatcattataaaagatgtattttatataattgtaaccataaattttaacttagaattttcttttgataaagtttacttaaggggtctgaaatgtttttgttttatttgttatgacaaattttaattgaataacattttccataaaaactagaccatttgcataaaggatgctactaggttctgacatagatagtcgttatgctattaacactttaaaataagttctctcttatcttatttcaaaataaacattttaaaagcttttcctctaagaactggaagaagacaaggatacccactttcaccactcttagtcaacatagtgctggaagtcttagccagagcaattaggcaagagaaagaaatagagggtatccagattggaaaggaagaagtcaacttgtttctttttgcagatgacaggatcttacatatggaaaaacctaaagatgctactaaaaatctcttagaactgataaattcagggtgggcgtggtggctcatgcctgtaatcccagcactttatgaggccaaggcaggcggatcacatgaggtcaggagttcgagaccagcctggccaacatggcgaaacctcatctctactaaaaatatctctactaaaaatacaaaaattagccaggggtggtggtgcatgcctttcatcccagctagttaggtggctgaggcacaagaattgcttgaatccaggaagtggaggttgcagtgaaccgagattgtgccatcgcactccaccctgggt

SEQ ID NO: 118165 - DNA, 1052 bp, Homo sapiens
cactgttaggtagatgttgagtcccagtgtctctttgtcatatactcttgttggaaaaatggtatcttctgctatgcctttatacaagcagaagtaactgccaaagttagcacacttgtaattttgttacagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaaggtaagatggttttagttccagtggtgtgattgatgggagtgtgaatgggaaaggtctatgctggtgttatgtttctaaccttattcattggcataaataataggacgtacatggactgttcttttaagttaacttttataattatttatgtatgtatgtattctatcactttacttacataatgcttattttagtagcttcactaaactatatacttttgctttaaattgtgttaatattaagatgcctggtaaactcagaacaggttgttaggactgcctgctcagtggtgccttctaagatttcaagattctttataggttgtaatatttgaatttcaaaaagcttctttatcttttttgccctctaaaagatagcattttagtgactttctattctttcagtaaacatatcttacatataaattattgcttatcagaattaaaggtcagctattaaagattaatgaattccaaatgtcatttgatagcagtgtcaggagtggagaggagcttaccactggggaggaaaactagtagggagatgaccccagtggtgtgtgaaccatcaaaacatgcagccactctccttagtgtcctggtatgctttgtgaatgtagaaaaataacctctggagcctaatcattcttgacatttaaaattgcctcttattccagaaagttataatattacaagttctattaagaaatgttgtttgaaagtaatgctactcctgggaagaagtctctttcattcaaaatagtaacagt

SEQ ID NO: 118166 - DNA, 2958 bp, Homo sapiens
ttaaataaatcatttttaccttgttgatattaaagaattgtcagcttcataagcctgactcttagctaaaaagaaatgcagctcgatgtaaatttatattccctatgaatacatggcagttctgagatctaaagttatcaacaatctgaaaaagcctttttctatattttaataatttctttataaaatattatttatcttgaatttggcaaattttagatgaaagcctatatgcttgtcgatgtttacatttctagtaaaagaacacttctgatcttttactgtaattctactctaaatgcctatattttaaaagttattattctcatatttaaggtaggtgaactttttttctagttgtaaatatttaagatatgatgaatttctcatggtacattattttccctcccatcccactacctgttttaaaatacagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaaggtaactgttgtgtttacttgtattgctttcattgaataatacaattcttgtgtttaagggtatatgttgttgttggggatttttctattgggggtttggattttttcttgttagtattcttaacataagagtctagttgatttggagatgagaggtacacagtgtttaggtatattctgggcaaaaactagatttggaattttttatttggcaagctagttattctgtaaaaacatattttgatggagttggtaagaaggataatgtagtttttgcttttacagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtatacgttaatcttttactttttttctctaaagtactggatattggaaatttattatgttactgttatgaatattttaatgttctttaattctgagggagataatttgctaaattagaaagcatttaaaaattgaatacttggtattagtactgttagtataggaaaaaacccaagttattcaacaaattcagaagttaggcattttgcatatatggaaagtcataatcatttagtctcacaactttattatttattgttcttgatgaaagtcattgtaaactattacacacttacctgccatagtgataaacaaaacgtgctgaacacaatttaaccttttcgttgatgatttagggccatcattgtgatgatcagttatacttgcagatggtatgagattgtaggactggaggtgtaactgactgcaggagataccctgaaactttgttgaaaatctttctcccttacccctcagagttgttgaggtatgtagggttttttgtccctacagtgaatgaccctagactaccgtcctacttgctaatatattttggagttgggggtggcttctctttgtcatatctctcctatgctatttcttttctctttttcagtggagcttgctactcttgtcacttctgatttcttcccttgcatctgtttcttactctacccaggagtatccaatcttttggcttccctgggccacattggaaggagaattgtcttgggccacacataaagttcactaacatggctgggcacggtggctcatgcctgtaatcccagcactttgggaggccaaggcgggcagatcacttggggtcaggagttcaagactaggctggccaacatggcgaaaccccgtctctaataaaaatacaaaattagccgggtgtggtggtgcgtgcctgtagtcccagctacttgggaggctgaggcaggagcatcacttgtacctgggaggcggaggctgccgtgagccgagatcgcgccactgcactccagcctggcgacagagtgagactctgtctcaaaaagaaaaatgtacattaacactaatgatagccaatgagctaaaaaaaaaaaaaaaaaaggacaaaaacatctcataatgttttaagaaagtttatgaatttgtgttggggtacattcagagccatcctgagttgcatgtggcctgtgggccacgggttggaaaaccttgtcctacaccctggacaattacagtagtttcctaatttctctccctacctctaacattccctcaaatttatccgttctgttgcagtcacagaagtcttcataaaaagctaatcaaattttgtcactcccctggttacttgcaggggatgaaggttctctttactcccagcagtttcctacaggtcacatttagcctccttagcataatataaaagattgttcatttcttacctcccaccttcatatttccttaacacctttgctttcttcattgttccttgaactgtagccttgctgaacatgcttaatgaaccataccatccttccattgctcacggcagtccctctacctgatatgatttggaagtgttcctgttgcagtgacagactttctcgttcttcaggggtacgctcaagtatctcttctgtgaggctactcctgacctatctaggcagattcgatctcactgttccttagaccacccttgtgctcagcatatgactgcagcacttattacctgtatttgcagttatttgcttacatgtttatcctttttgtttttttattttttatttttttgagatggagtctcactctgtcacccagctggagtgcagtggcatgatcttggctcactgcaacctttgcctcctgggttcaagtgattctcctgcctcagt

SEQ ID NO: 118167 - DNA, 1245 bp, Homo sapiens
acaagtaactcctcattctctcccttgtcctgtctcctaccccctagactttggtgaccatctactctctatttctatgagttcaacttttttggattccacaaatgtgagactatgcagtatttgtgtttctgtgcttgacttatttcacttatgttgtcctctaggtttatccatgccataaatgaatagaattttcctctttttttaaggctgagtggtactccattgtgtatatttattacattttctttatccatgtatctgttgatagacacttaggttgattccatatcttggctattgtgaataatgctgcagtggacatggaagtgcaaatggacattcagataagtctctttggtgatatatatataattttttctcttcaggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcagtaagaatctcttatttttctcattttaatctggatgaatcttgttagtaatttcttaaagcaaagcattgatatgatttttagtgtcatggtctttagattcattactggaatgcatcttatgacaattctctgattttaaaaaattatggtattcttatttatttagaaatgcctattctttgcagttttcacattcataactgctcccatagtaattcaaaatgtccttagccatgtggtcagtgatccctcctaataatagatttagcaaatttcttcttttgatccattttcaatttggtactatggcctcttgttcggcagtttgtacgctttgttatccaggttttgttcctttttatttgctctctttttggtgatggtttcttcagaagttatgatgtttgcccatgtaaatacagggtttgcaggtgattgtcttaggccaccttgaaagtatggccatgaaaataactcttgtggcaagccaacaaaaagaaattgcattaacgctgcttccctgtccctaactagtccagttacgcttgggcattacaagagatcgcaggtcagtgtgtaatattatgtacctatgtgctgcagtttgactccctaagtaaaagtgagttgtatttatgttttttattcatgtcttttcaaagattacctt

SEQ ID NO: 118168 - DNA, 2832 bp, Homo sapiens
ggaaaccatttttgtttcatgctccagcttttcttctttaagagagaaatttgaaacatcttaataaagggtatgtgcacgggaggctagatagtgctgagggtgtggtttttagatattttgtcatttggattttttggtcaggatccttaatgttttgcatcagcttgggcttttaaattagatgtgaagtaagacttctttctacatttttatagttaatttagtgaaagatgtgaaagtgaaagcttgtgaaagatgctgggattggcagccccgcagactgaagtcctctgttcatccacagaacaggtacagcacgggcaagatttacccacccaccctcagccctgatctggagggaccaccactaggggtgggagggtaattcagcttctgaggccctttcactccttggagtctttgctgaggcgacttacaaaggtgaccactgccgtgaaatttttcttaaaaaaaaaaaaaaaaaaaaaaatggaaacacaattaggaactagatggacatttccagctcatttctgaaagacctgtgaacagcagtcagtaattcttggacttctttttcttatttcagatccaaaaaattaatccaagaatcagatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatatatctgtattgtatatgattattgttacttaatttttaagagcttattttaacctgtttttaaaagcagcaaatagaatttcccacaaagtaagttgactctaaatcttaagtattacctagtttttaaaggtttgaatataataatgcagtatttgcagtataaaaaggaaggaatttgtagagaatcattttggtgctcaagtctcttagcagtgccttattgcctcatagcaagaagatgctggggttttttttgtttttgtcctttgtattaatgtatgatggtttgcgcctttttggcattctttcaacatgtcgtgtacatcacaccatgaatcagttcctaattgatatatctagctttacctcccgagttaaaaaaaaatctttttattttatgccttcataggttgctcgtttcagagtgccacataaataaaatgtttaacaaaatatatatgttaatagaataatttattttccattatctcataccgactatgattgtaacaaatcctagaaagaaggaataccaacagatctgtatttgtatgttgtgtgcatacagtcacagacacacacattcacatccatgttatatagttcatagcttaaatctattaagtgccatggaaattttgtgaactctttatgtaggaacctggcattgatcagactaaggtcttcagctgtaaagttgataaacaggatatgttttttctttttatgcgtacaaaggatcttactctgtctcctaggctggggtgcagtggtgccatcatagctcactgtaactttgaactcctggtttcagtgatccttctgagtagctgagactgcaggcatgcattaccatgtctggcttttttttttttctttttaaaatttttttggaaatggtttcactctgttgcccaggctggcctcaaactcctagcctcaagccattctcccacctcggccacccaaagtgctaggattacaggcgtcaaccgccacacctggccgccttctgtttccttttttttctttctttgaagttcattttataagttcattgagtgatttttaagtactgtgaggaatgaaattgaagtgcttgccaaaaggagcacaactattatgtagtatgtagaaatacgactgtctcacaagggtaaagtttccagaat

SEQ ID NO: 118169 - DNA, 1030 bp, Homo sapiens
tgtgaaatatttttataattcctaatggtaataattatatcagtttgtaaagtcagcaatattgataagcagcagtacaagtaaatacaataatcacagtttgttttgctttgaaacttaaatctatttaacaccttcccctgtctcttgatcttcatgttcccaggggatagggtcattgtcctgtacagaagggactgtgtccctctcatgccaaaactgctctacgtcaggaaggatgggaatctctgccttctcagttttccctttgccagaggagggagagctgggtttctctttttctggtatggatgctggggattctggagatggaaccttgtcaggaagaccctctgagttgccagctggtgtttcctgagactctgagacagttggaggttttttggttatcatccatttccatacacctttcaagccttccctgaactcttccgacatcacaagaaaaatgagaggatttgctgaagagatggaaaacatcaagacttgagacagggctatgaaaccttgtggtggggccgggcctgcagccttcagatgccatacccacagccaagctacccattcggggagccacaagagagcagagatgatggcaatgctcagcagcatcactgtgacttgctttgagcgtatctggtttctaagattttgagtcttagttcctcgttttttacattggtcataagctctccagaaataaaagctggcaaaaaataatggaaggccaaatgccaggagtgggtagagcttaccaaacatcgacataaactcttcagccacagctggtacatccacgaggcacatttccacaccttcatgatgcctgatggtgctaaagaaccattccggcaggggtaacaggctagccacagtccagatggccaccagcactgaccagatggtgtagttgtggatactcacttgcttggctgggtcacttgcatacatgaagcatactttggccaccacaacgattgtcaggctcttggctgccatgcatgtgtgg

SEQ ID NO: 118170 - DNA, 1080 bp, Homo sapiens
ttgagacccagaactattctagtagagacttgatgaatttctaaattagcagagaaattaaagttgggcttcaataaatgataactattatttattaatacctgtcagagagacagttgtgaagtgtctgcttgtgagcatttgccaagaatttctgtctccattatttgccttaatttccaaagcagaaagcctgacggccacatagaaggctttaccctggcggagaaagggaaggtcattctgtctcagcaggtctactagagaaagctgcccccaaagcccctgacattggatccatacaatacataatttctaggcaagtccttggtatgtctttttgttgctgttggaaactccaggacccaaggacattcatcactggagaagtgggtgcgcgcgcacacacacacacacacacacacacacacacacacaccagtgttagcagctggcatttctgcctcgaggattttacatttacaaggtaataataaaaatggtattagaaacctgcagacggtctgtcctatagagataaatgttgattgcaaactccaacatgaaagtagaattgactagaagagttaccaggtaatttaaggcccaacagttgatgtccctgcagataccttggcaagtcaattctgttttatttcagagaggaaataaaacttgcctgattggactttctttcccctgatagaaatgaggagttgtcacagtgaaccatgagagccaaggctggcaaggctggcaacacacgccagagccccggcttctaggatgctgtctttgaacttgaagtcagggtcaagttttaggactcccagtttgttggctattcaggattggtcagttcttcctttccagacagcctcttacctcttagtgaatggggctctgaggtatcttttctaaatgtgtgcatttaacagtagagctttcaatactgagaagcagtgaaacacagaacaaggccagtgatagagtgatgattttcagcaattggattctctaaaacaacactatgcaatagaacttgctctgacgatggaaatattctatatctgtgctatt

SEQ ID NO: 118171 - DNA, 1046 bp, Homo sapiens
tgctcagtaaatatttgttaaatgttgaatgaaatccaaggccaatgatgagagcttgagcccaatagtagcatttgagatattgtgaaataaagaaaaattacttaataaacagatctctgagggacaggattaggagatgattggcaccattgtgaacctttactgcatgagattgtttcttcatgtcctcttatgtccacttctatgtaatattgaataatattcatttcgatatgataaaaaggacctcatgtttatttggaaactaccaaacctggcagtgatgtttatttactcatccttggggtgaccaatcaaatttattatgtgaagtgacatattcttctgaatccaaagaggactttaatattctagaaagtctttacagcagtatggatagattgcgtggtcatttttcagacatttacttgataggtgtttattgggcacttattgtataccagctatggggttagataccaggaatatggagtgacaagaccctctggggaaatatattaataaagaataataaagataaatgtacaattgcaaccgtgacaagcactctgaaggagttagtagtactctgagagtgtgtaataagaggattattggacctagacagggaaggcttccctggtgaaagaataattgctaaatccgaaagtcataataagagttagctctgttgaagaggagatgggaagatgacccaggcagggagaactgcatgtacaagggctttatggtagtagcagtagagagagtgtgtgttcaaaaagtgaaaggtggccagtgtggcttaagttcccacaggatggacattagacagaagccacatcttgcagagtcttgcaaaaatatatgagccatttttgctttttatcttatgagtaacaggaagccatttaaatgcttaaatgtagggaagattggggaaagtgaccaagtttgcttttcaaaaatactattctggctgcagtgcaaagaatagattggaaagggtctagaatagatctaaagagacacgtgatttactc

SEQ ID NO: 118172 - DNA, 1039 bp, Homo sapiens
gagaattgcttgaatgcaggaggcagaggttgcggtgagcccagattgcaccattgcactccagccggggcaacaagagcaaaactccgtctcaaaaaaaaaaaaaaaaaaaagtgtaaaaaccattcttagttcatgagctatacaaaaatagatagtgagttagatttggcccatggggcttattttgctgactcctgctctaagcatcttgcagacatttcttcatatgccctaggagatttctgatatcccctcataataccctggccttacaccaagactacaatctgttctttgcagatgcttaataaattcattcttccctgtcattcagttgatctgtgtgagccagtggaaatacttgggccaataaatctagtgtgtttgagggtaaaatatgctatttttgtaagatatattatttaatggccacacaacctaaattcaattaaatggttacaacctgtaacgcatttaaaatatgactaggcagaatttgcttcctactaaagacatttattcgattgaggagcatccaacagttgatgttgatccccccatcctgccccactgttctactttgcaatttgtttgaaagaaattgtcaatatatttctgacttctgagcaaatccatgaatcgggatccagcaacaggaaaagaagctgttgctgcccattgcttggttttggcaccaggaatggataaatcccagacttcctggggcacgtgttttataaaagggaagtgctgacagtgcaaacagctgccatcaattggccttggagactacttccctggagaagctccaattatattcttaaaggacccaccaagctcttcaagtgttagtggcaaccatttgctgccaaccatttgaaatgatgaagtaatttttttttattagtggatcctaagtgataggctctagaactgatcttcaaccttaactaatatcatggcatcagagggctacagattaaatcagtggttcccagtcactctctgtggacaagtagcaactacgacaaagctt

SEQ ID NO: 118173 - DNA, 1154 bp, Homo sapiens
tctgcttggggagggtaagtgtcctgggactgagtcccaagcttcttatgtttttccatcagtgcctaggaaagtcctgggtacacagatactcaatgaatgtttgttggtttgacttgccagcaaagccgtggctcctagggaagtgacttcagcttctttatcttcttggtgtgactatcttaaaagggagtaagtgagcctttctttgtaactgactgtatttgagaatgcagcatgacagacaaaacattcatctcattcatggagaattgtaaaatccagcagaagagctctctttttaaccagtgcttacaatttgtcctttttcacccttccttggcaaatcacgcaatattccttcttaaaaatgggtaaagtgccagccgaacttagaagagggactgattctatctctattctgaccaggtatacggtagactgtaatttaatgtcagcacctttctgttgccataatgaggtatatttatttctgttcaaagatcatgcagccctgacaaagcaaataccctctgactcccactgttaattatccttcagttgctacagggttttcatccatgtcctcacttaggagagttggcggttgtgaagcggatggagtccacaatctcagtggcagttcttaatgctttgagctcaaagagtgagtaagtcgatgagtgaggcttttaagatgtaaatccaatatctgcagagaaatctgaagctgtaatattagaacaacattcaaatgaggacttcattgactagctcattaagaagtcctttgataatagcatgttggtaagacttttcttagaaggtacatattataaatgatgatgtgctaagaaatcaacataaaggaaaatagaaaaattttccccaaatccatcctttttctgtagaactttaatgatgatacctcattcctttgtaacttaattttaaaaagttaattatgcacctactatgatacgtccaaaatgtttttaggtgatgtggatatagcgaagaacaagacacacccagtgtcttccttcatggagtctatattcttggcactgttggtcctgtgtgaagtcctaacattattttgcttaatgttttggcaagagaggcaacattggctgggcgtgatggctcatacc

SEQ ID NO: 118174 - DNA, 1048 bp, Homo sapiens
aacatatattttattttaatgttattatatatgtatcattacttttacaactcttaaaccaaacattttaaaattagctacaactgcaaaatcaacttaaaaatttcaaagagccatttaacatgataaattaaaatattttagtaaaacaaaatcaccactgatactttaatattcttaggtctgagaaaaaccattatgtcgtattattcctgcgttcctggtagcgtttctactgctggacatcagaaatagagaatagtagagcccctgagataagagcagagacaggggaaaagcaaaacatttctgaagaggcagttggtctagtttggctataatcactagacgggtaaaggaacattgggtgcattaaaagtagagagcctgggatgaaggcgtgaaggctgagtaagaatctcttcacttggtagtaattctagttcatccccctctgacctgcaattctgaacatggtgtagcttggtcaataaggaaataaattgcctttctggctggagaggcaaagggtagacaatacattgtgccagctgaacttcctgtctctccgctctggagaagagccagtcacaatgtatgactcagcacgccgggcacctctcccacgccagccaggcctgcccagccacttgctgaatcacaagtggccatttccaatcccatcagtgacccaagctctccaacttagactagtttctctgtgatcggtctatgattgtcatggagcacaaaaagtattaacttctaacatttatttttctttcctggatgcttgatgaactttataagcaagagactgatttaattgttcctcattatcatctgagcatgccgtcttggcttgcccttttatatggagagcaaaatgttgttattcccctttgcctgattactggctgtattattctctgaggtggccatctcaagagattctgtagaaaataataatagcaaaatttctcccttgagaagcttcataaattaaatctccagagccagtatatgtaagccgacagattatgaaata

SEQ ID NO: 118175 - DNA, 1049 bp, Homo sapiens
gatagactggaatggaagtttcttgggaggtgaggccagcaaggcacttcatatcttgcactcttaaaattaacccagtttctctcttgcccacatccccctacccgccactctgttttttttttccccctgggaatttatttccaactgtaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcc

SEQ ID NO: 118176 - DNA, 1011 bp, Homo sapiens
ctatcagggaaccccttcaaaagttaattccatgctcaggaaatagagattctgcagtcacagctaagcaagcaggagcaggcctgggcagaggggagcaaaggctgtgtctgagagtgactcatctggggtctctgtcattcagttgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggtgagcccggacatgccgtcctccctcctctcttagcttcttcttgccagtccttccaacaccatccactcatttcagtcactgtcttttacttggagcctggaaccttgagtgtgagcactggatgtagggataacacaatgttccaggcactttatttacttcttacaggatccccatgagatagtgattgttttccccactttgcagatggagaaactgaggctcagaataagcagcccaagatcatagcattagtaagcagtaggtgtatccaaattctatgctcttcacctccatgcaatattgcccattctgaagaggaagaaactgaggttaggagaggctaactaatcttacataaggttgtatggctagtatgacctatgagattagggatttttaacctgtatcatttttgctgtagagatcaaacccttactatcatataacaatggcatccttagacaaggctaaggcatttctaggagcaaggatgtattggtactcaggctgggagcttagggtgtgaaaacatgttcatgtatatgtatatatgtttctgtgtgtttgccagcgtgtgtcctctcagtgagtacatgatttaggttccactgtcttcttagattcctccattctctgcttctttttgatcaacagatattgcaaacccctcccccccacatacaggcacacatatg

SEQ ID NO: 118177 - DNA, 1066 bp, Homo sapiens
agaatcttttgttaggagcaaagatgaccccacttaaaagatagctgagttcccatacctgttctttaaatgatttactattatcttcttcagtctcttctaacagtgcactattttatactctttagattcttctccaaatgttatttctcaccttaacttaaagaacaaaatgaaaggaataataaaaatatttatatgaaaaaagtattacacacactatattctagacactatcagacccctggggttatagtactaaaccaggacacgtggtcccaccgaatggcatatcagatcattctgtgactataaacattgttttctgtgtatatctatctttgtttatagattgctaagcttgtgagtcacttgcaaagtttaatttgataaatacaagtaacactgtttaaaatccttataccactatatttgtcttggaaattgcacttttaaatgaccaagtgtttgatcatttttttgtttgtttgtttcaccagacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcagtaagtcttcatattttacacactcctgtttctcagaagtgtgtgtttaatgaatgtgttatctccagaactctcttactataacttgtatacttgtcccagttcagtttatagatgtgttgcctgatgggacctgagaaaagcagattgagctgaggaaatgggcagctccctgtaactaaagaggagattcatgaggctcttggtcatggcagcacctgccctcttgtctaccttagcagcaggcgctggctcctgcaatgagtggagaataggaaatagcatctctgggctagtaagaggtgaaagtagacttaaaaagttatggatagaagatgaaacattatttcaaaactgcccacttgggtctgagaaaggagg

SEQ ID NO: 118178 - DNA, 1022 bp, Homo sapiens
ttccttgtacgcctaaccataagttctatttttgagaatcaccattgagtgtcaacagagtactagagagtgcactagccactgaggcatatgttatcccactttaaatatttagtgcctactgaatcagaaaatataatataaaggatgtctcccttacttgagtagatatgtttccaggtggctataatattaatacattgcagaagcaagaggtgaaaccctagaataatttgaattaagggcaaacaagaaagaccggatccccaacaaatacacctactttaaatgttgagtgcattgagcacacatatgtctttggtaaatgtgtttctactagacatctagaacaatgaattgggaaaaccttggcagatcactcttctctgaaatcatacctgtgataacaactcatgttttccttcttttctagagtgaccgtctccttatcaagggaggcagaatcgtcaatgatgatcagtccttttatgctgatatttacatggaagatggcttaataaagtatgtatatggaattcttctctttattgttttgcacttcctccttcattaatggctcataaaggaggttggattacatgaatgtagtgaaaaaaatcttaatttaatcaacagaatgaagtgagatactgagggcaaatttgggcagaaagtattgatgagcattctacgggtcatggaaaagtggaagatgtggccatcatccttaaggatactggaaaatgtgcacaaattacagcaccctaaaaatataaggctttgtgcaataggtatcaaaggagttgaagtcgggataagtgatttagaagtacaaagaagaagaaatttatttagaagtaatgctttggggtagagagagtatttaatctgaaccttgacttaaggataggacttagatgggcagagcacagataggacatagatttcatgcaagatttgcaaataaattcattagggatgtataattacattctaaaatgtatactattggatgcctgtaa

SEQ ID NO: 118179 - DNA, 1026 bp, Homo sapiens
gcagctttatggctttgcaggtaagggatgaagtcttggaggttctaagcacagagaatgtattcccataatgttaacatggtctttgccgatagtaagcggtcttgaatacattccaggaggtgcctagtatgagtaaagccttagatctttattgaaggcgaagaaaccttttgttctaggattaactacccacttgtctctgatttttgagttctgataatttttaagtggtgtctcgtttgtatttagttcaagtgtttgtttcattcaaggtctgcctgacctcttgaagtccttgttctcagagcatctgcagttttatctatcaatacaacttgaagaagttcagggccaaagaatcaaaaatagcctctgctttgataaccacctctctatccaatgaaagcagagttgcgggtgtataggtttttagacagacagatggaagcctgtaaccaagaaaatcagtcatcaccattgtctgctttgtcaagaaggaaccagaaaaaaagagcgaactcttccctttctttccttacccatattcttttatagaaggtgtgtttgggttgttgtagaaaggtagttaagatatgtggtatgaatcaaaccaacctaaaaagaaatgaaaagtcaagttacttttcagggataaaggagagggaaggtaggcactaggtggaaggctttgacctgagaagatttagggagattctagcttctaaaggaactcacatttattgagaatctgggcttcatcctcacagcattcctttgaaaaagatattattttcctcgctttacagtcaggactccaaagcccttctctttcccaccattccatcaggctaactggcactgattcatcacttgaattcttggactgctttaacaatgaggaccctctttgcactcctgtatgatagacctaatctttgaggtctggactacaaggcagagcaaactggaagacatctgtggtctttgagacaattccttccttccacactctccatggggccc

SEQ ID NO: 118180 - DNA, 1027 bp, Homo sapiens
caatattacaagaagttctctgcaggtttttagtcaggggacataaagagaagtttaactttgtggtgacaaaataaagactaactatagatttaaattaaattctgtagtagatgtataaacatccactgagctttcctcttatctttctaaacaaaggcaaattgcaaatccagtgcattgtagttgtgaaatcatttgtaatagtggtttcttaaagctagctctacaagtgatttccaggactcctgcttggaaaaagaaagtagtgcctgcttttaactttaattttaattaaggctgagtgagtcaaagatatgtgggtgttaaaaatcattgttttccatagtggcattagcttaaaaccctcattacaatagagccattgttctattaactagcacctttttatgcattataaaggatcactgctatggtccaaatgttggtgttggaaatttatatgttggaacttaatttgtattttggagcctaaaattcaatgtgacagttttaagaagtaggccttttgggaagtgattaatcaataaggctctgccctcacgaatgcagttagtgcccttataaaagaagttcaagggagctgtcttgcccattcagccaggtgaggacctagaaggcaccatccaggaggaataggccactcaccagacacagaatctgctgatgccttaatctcagacttttcagcctccagaactgtgagaaataaatttctgttgtttgtacattacgcagtctaagatattttgttatagcagcaggaatggactaagacaatccccatgaaaggtataatctaatgaagtgtcaataacacaaaattattcatctcttttgccagcaataccttgatgtttttggaggtccgtgtaaattgtttgtagctgtgaggtactgaaaagaagacttggttacttgttaaaatatgcattaattgtgtatgcctttttggaaggcgttctgtatatgtactctattaataaattcagtccagaaggtcctt

SEQ ID NO: 118181 - DNA, 1041 bp, Homo sapiens
aatattcctttttgaaaagaatgtaaatattcctattggtcccttccctttgcactgatatgctcatttatttctcatgctttcacatggatatttgcaaataacctgtgtttctttttgttagagcaatacaggatatacatatatatgcagaataaattaaatgatttcaattttcattgtggctcttcaaagggtgtgtgtttaattgacttatatcctagtatcatggaatgctcagaaacccctagtcattcattatttgtgtatggactagttactttcaaaaaagagcttgggtcattggcatggaccaatagtcccaactatgccggtggctgaggtgggaggattgcttgaggtcaggagttcactatgaaatgcactatgattgctcctgtgagtagcaactgcactccagcctaggcaacataacgagatcctatctctaaaaaaaattaaaaataaaagttaatctgccttggttagttttcaccaattaacaaatacaaattacagaggtacttggaagaatggtgcctaacatcaaattaaacgttatttttaacatccgtgtatcactattgtgggtgttgctattatgtctgaacgcaaaagtatctgagacaggcatcaatcaatttagaaagtttattttgctgagattaaggatgagcccgtgacacagcctcaggaggtcctgatgaagtgcgcccaaagtagttggggtacggcttggttttattcattttagggagacaggagacatcattttatacattttagggagacatgagacatcaatcaatatgtataagatatacattggttcagtcccaaaaggggggacatcctaatcttctttgtcctcactgccagtatccttatttaagactgttgtcttttgtctggattgtttcaataacctcctagtagatttgccagcatttaatttctccaaagctttgttcaaaactcttggatttgtctaatgagttcattcttgatcttgttattctgattcttacaagcatcccaaaa

SEQ ID NO: 118182 - DNA, 1120 bp, Homo sapiens
aaaacttaagaacatcaatcaaggcacatgaatgaagaaaaacagtaaatgcatgaaaattgagtttacaaacctgaaagtgtgtgtgtgtgtaggggttttgtaacctgtcttgccttaaagttaaaaaagaatgttagttacatggaatcaagccatgaatggccatgattcagggagtaatgcaagaaaatggatttttaaaataaagcaaacaaaacaacacaaacagatcactttgcagactgaatggtttgctgtgctcaatttcagcatgcttgaaacttcatcacttagtaactattagaaaacagagtataagactgaagtaagaaatgactattaaatcctacgaggaaaattatgaatggctttttaaagatttttttccaatttgaaccgtttcttgcatgtgaatctaatgagggcatatgcatgagaaatattggaaaacacattagatacattgatttcagttacagtcaagggactctttcattattattttttctgtatttaatacataaaaatcaacccagaaagtgagaaaaatataaacctggagggaaaaaggtcactgagtacttaatgagagtattgattctgatttgcctgccttcactttggatttttcttctttgagctatgattatcagtactccaaccttggtattaagtaatctgtaaattctctcttggtgtgtagtcaaatgccactgagccagaaacctgtacaactattgcaaatcccttaaactgtttattttcctttaagtgaaaaggaagtgttgagatggattctctacaaggactcatccagctataagccaatgtgtttatgactttgtgactgtccatcacattttccgtcagttctttgtcatagtaaatgcttctcaaggtaataaggcaatatcagcttattgtcatttttctctttcactctgtgtatatgtgtgtgtgcgtgcacgcgtgtgcacacacaatgttgccattcagtttagccaacaggtcattaaattcaagctgtacatcaaacagtgcatataatgtggtatgctgccaggctaactattcaatccaatgcataaaggaattgactactgttttctctgctgca

SEQ ID NO: 118183 - DNA, 1089 bp, Homo sapiens
cggggctggagcctcaaacccgtgtccatattgtgtgtgtgaagaagcatcgaagcgcggcagccatgttcagcgtggcatttcggaaggcttgtcaggggtggagaagcggggcgggttgctgttctttcacctgacactaaagcgccatgccggaagcactgagtctgatacgtcggaaccagtctccaccgtgtggtttggtcttgatttccactggtactctggggtcttggataagtctctggacctcgcctttgtcatttgcgaagtcgataggttccaatagagattttcccagaatcattcaactaaaaatagagaactttttttttttgagaggaaggacgggggcgcagttaaagatgttaatgttaagtcatcccttctgtgatttcgggacattatctttgcacgtaagtaatagtattttacagtccaaaggaatttcacatgagtgtcattaaaaactctacacgactctgacatgtaggcaaggatcaacttaatcaccttttctgttgtttaatggataaggaattgtcttcagagagtgtaattgattttcacaatgtctcgcagatggactgaaattcagatttttaccttttacatcctgtgttcttgccctaatatacatgtaattaatatgggctaaaatccctagatttaaatagatacaaatacttcttaggaaagttagtgtgcattaaagccatgtgagacacaatttgacaagacgtagcattgactaggctattctgctggagaagaaaaagctgaagaaggcttgggaatcccatttcttcttattcttttcttgattgatagcagacctactggtttttcccctctttccccaatatggttcggcaccttaggtttcagcttgtcttaggcagtcacagttttagctatcccattccgtatgtcaaaccatatatctgtgtttttatttggagctctggtaggacaaacaaaacaaaacctcatcatattcatgtactattcattgtaatctcagctttcatgttacattcttcctgtaattgaagacaaaaatgaatttttatgctatttgcttctgtc

SEQ ID NO: 118184 - DNA, 1058 bp, Homo sapiens
cacagaagggatgacttaacattaacatctttaactgcgcccccgtccttcctctcaaaaaaaaaaagttctctatttttagttgaatgattctgggaaaatctctattggaacctatcgacttcgcaaatgacaaaggcgaggtccagagacttatccaagaccccagagtaccagtggaaatcaagaccaaaccacacggtggagactggttccgacgtatcagactcagtgcttccggcatggcgctttagtgtcaggtgaaagaacagcaacccgccccgcttctccacccctgacaagccttccgaaatgccacgctgaacatggctgccgcgcttcgatgcttcttcacacacacaatatggacacgggtttgaggctccagccccggatgacaacactccggaaatatgcgagcggcggcggaagcggaagtgcctcagcggtaggggccggggaagtgtctgtagcgtccctccctctcaaccacaataacaggcggagggtcggcgtaggtgaggcggcggctgagtgggcctggggaccgggagcggggtggcaaagcccggagtgcgtgcggcagggctgaggtagctgggtggggattctggaacttccgaccgcttaagctcggcctctggcccccttggggcctagagctccttgagagatcaggggttgaatttgtagttcctggccttctaggccgtgcttgcgggggttgcctgcttgtctgaacctggccccaaaatccagcataaagaactctctctgggccccagtttcctcaatgaaatgggtgagggtgttggactggacagcttctgtgactgtctcccaccccgggcgtcacgaatttcatgattttaatgttaagtcggtgtttcggccagtaaagtgaaggaggtctgtgttcagcgtagtgaggagatgtccctgagcaggaagcagtgaacacatctttggctgccacgcctgagtatcaggagccctgaattctagtttcaccccttccacctacacaccgtgtgaccttgtctaggtccattagcttt

SEQ ID NO: 118185 - DNA, 1311 bp, Homo sapiens
ctggtacatcctgcctctgtgactttggacaagccatctaacatctctaggcctcactttccttatctgtaaaacgaagggttgagctggatgattcctaggcctttttcagcaccatcatcctgttggggggtttttgttttgttttgtttgtgtgtggtttttatctgagcagtttggtttatgtggtgtggtatttctttagacaagagaggctgtcctggtcagtagatacacaagatagtctatgatgtcaattaaggtctgtgaggtcaaattaagtgatatgcaagattactttgatatgagcaagctgaaaccaatagaaactaaagaaaggcatgagaaacttgaagggcagggaagcccttgaccagataggatcattgagaatatagggaagtttcaagtgagagggggtatttttcacgagggtaaagaaaagtaatttgagtttgggatgggaaggagatttgaattgacgagataggagaacactttttggaaacaactctggtttaagaatgtgcttgcaacaccaagacaaaagtaatgcttcctgtggctaaggtcagctaagcaggcagccacagagtgactgtaatataccaaaggtggccatagaccactgcatgggagcctaaattaaatggaccataaatcctaattggtgaaggtagggtgtggtcagatgcagttctatcagagcatctagaagcctttctccaagcactagggcattgctctggaatgcaggaagacaaccacagtgacagaggactgacttgatgatagaatgtttactgtaacctgggaagtctgtatcccagcctgaaccttgacactatttaatcttgggcaagtgatttgtcaccttatcctctctggttctgtttgttcatcttaaaaatttgggatcactagatgagcttcgatgtctgtgaatatgaaccccctgaaatcgtgtatgtatttctgcttgcatgagtctggaaaacggatgtgccactttcatcgtattctcagatgggtttgtgacccacaaaaaattgagaactgtgtgattaggtagtgtctctggtcctcttcaacttttaacattctgggattctgtaattctgtcatttctgacatttccttaaggttcagagtcttagggtctagaagttgctaagcctataggtaacacctggtaccgcaaagtatagtctttatatataatactctcctccttatttattcaggcatagctcagagatactgcaggtttggttccagactactgcaataaagcaagtcacaaagtttttg

SEQ ID NO: 118186 - DNA, 1047 bp, Homo sapiens
ggctgctagatttctccaggctataagtcctgtcaatctcctatatataagatagagatgttttcttttaccctagtgtttatctccacaagttccttccccacgataggcttagggtaggggcctcactattcacctgcctggtaagaactaaaagacccaagtcttcaattctagccgtgatgtaagaaacaggaatagttttacctaaaattttgtcagtcctgctaatttaaaatttaggctttttgctagttagtgttaaaggatattgtaggttaagaaggtttttgtcagcttcctggagatctaacctcagtataatattgtataacatcatttctgtgagtaaatatttgttaactctcaataagtggagttttataaactcaatgatatttaaggtgcagggtatttagtctaaaaatttacgtatagtttgtgcactagggctactaaatctaattcacacaaaagcaccacattgcagaatcctaaggaacaatcaaaggtggaatcagtagaggaaggtgttattaggtggtgtgaatttgaggaagaaaaaggaggaagaagggattaaaaaaaagctttttattaaaggaataaagaatcgagcatcatctcgatgaaggattgtcaagattcttaaagctgaacatgtgctaaagtataacaactggtggattggtctgagcatctaggtaatttgtgggtggattagtctttgctggttaatcgtcctgttgaggcttttacatgctacagagtagctgttaggtgtgtcactgcagtaaaatctgattgcattattgtctaggttataagtttgttgctgagatcattgaatgctgtggtagcaaacgtctcataagagcatgaaatggtttttagcagcagcctcgaagctactggatgtatatagaataatggaaagactggtggatattcatacattagatatttgaggatatattgtgagcaaggacttgttgtcacctagaggcaagattttttagcagaaacatgactaataaatcactacac

SEQ ID NO: 118187 - DNA, 1077 bp, Homo sapiens
aattaagttatggctagcagtgatgatttattttgtataatatttgatttaaatcattttaaaggggtaagaagagggacgagaagtagaaaaaataaatggatctgctaaatattcaacaggtatatgtggacttttcttttagaattagcagtgttgttaagagttagtgtcagacaaaactgtgtttgccattcctgaccctttctccctcttacctagccatgtgacattttgcaggtttaattcttctgagctaatttcagcacttataaaatggagtaataatagtgtatactatgtcagtgaagtgccagcagataacagaaaatacacttacctggaatttgaagataatttaatgaagggactatttacagagatgtagatggagtttagggaacaagtaagggatgatgaagaatttgtctaggggattagcagcagtagaaaggcagcattgccacctggagccctccagctggtgcatctcattggctaaagttaacagccagagaggggtagggaacacagcaggtcagagagggggagataaaggactgggagagagttgtatgccaaacaggaaccagctagttacctcttaaggttgttgtgaaacaatgagtagaatgtgacgcaatacaggttcagtaggtaaaggtagctttaacttttcaaaacatttaattaatctaggcatgtgtggaggggtcttaagagaaaaatagacctttcagaatatataacagaacaaaagtcaggattaattgaaagtttcaggaaaagataataaagaagaatggaaaagaggaagttgtaattcacatgaggtgtcttaatactttacgcaatacttttatcagtgtatgtgaccttaaaggttaaaaaaaaaaaaaaaatgggaaaagaaattgtgtactatatgactagtatacatatttgttgatggagaagatagtagagtttgcaggagcaggatggtggagttgagagggagcagaatgtccctgcaggagtagattctgtaaaagatacgaaataatattgtgcatgttcaaattgagtaattctctc

SEQ ID NO: 118188 - DNA, 1063 bp, Homo sapiens
accaatttgaaattctaaaataaatgactggcaggtttctgcttttctcagagccatgctggctggcttctcccacacatttacaaattcttaagattcatatatttatagaaaacagcttttaaagttctgtgtttggctatcttccagatatctatttgcatatttaaacccatctagctgactttgctctgagaaatatagttctcctactagggggcagtggatgttggtagtcaaatagtaaatttgtgtgttccatctccatcgttatagttttgctttcagtaatccattttcactttacctcttctgggaaaacgtatcctagaagagttgtaagattatgagaaagacttacatgtctaagacatagaaatactttttaaactctatcttcccattggcctttcctaaaaaagttaagtcagtttatggtttacgtaaactgttctttgtaagcctgttttaaataaggcaaacttgatagattttgtataatttgttcggataaaaatccttgaaggttaagctgttaatatgaaaaatagactcttgaacttataagcaaaatatagtatatttttgtgatttttttcttgtttgttcttttttatatttgtgttttaggggtgaatgttcctgaaattccttgtatcccaatgctaaggcacctttatatgaagtgggtaagactcactaaaccacagccatttaaagacttcctttgtatcagcttaagaactttcgtcatgaggaactgtgcaggtaatggtacacaattatggtggaattaaacataagttattctaaaaatatcctgaagcaaactctagctacatttgtaaatacaattatattatgctattactatttatgtcttataacatattcatcttgtgaagataaatgtactttttgttttaaagacattagaaagatgatttgtgtttgacctcagcaaaaaaaaaaaaacaaaactcagaatatctctattttttacgggtactttttacttttcctaggattgttttattaaatttcagtcttcttactttgtttc

SEQ ID NO: 118189 - DNA, 1016 bp, Homo sapiens
aattatcatctcagataatactttataatgtatagtatataaatacttcactaaaaatgctatggtcaaacacttgtttttgttcctcgtctttaggtggttttagaaatttgcacactattgttctgggagcttgcaaaaatgctcttgaagtagatcttggttacctcatcattactgctgcccgtaggtatgtttcctctttgtattgtgtctctcactttagaagtaattatgtttttccctattttacaaaaaattgtggaatgtgtgtgtatatatgtgtgtacatttgatcaagccttgttcaaatttaaaatacgaagaagtccaaataacagataagtataacatcatggtagtcttaatgttataactggtaaccagttgagctgcatactagcaagctccagagtggcatggtctcatatcagagaaaagcagtggaatttctggaaatggctgagagtccaatagaagttagcattgaagctctggtgtctgtagccctctcaggaccattgtctccatctctggatgattttctgaattgttctagttacttggtgataatatttgctattcagaaatcagtgttttaaatcagcttttccaaagtctgaccttgtaacacctctatattttttaaccaagtggttatatcactttatgccacatttactatttcttacatatcaatggtctacctccacttttattttataatattttctttaagcatttttaaaatttattcagaaacaaagctttttccatcaagagacttgattaggattataaataaaagtgtttctaagtttaggtaggtattgttacctactacagaattatactctttgttaaaatgcaacattaatagctagcctaagcaaaatgtcaaataccagcaccagatgcagattctcacattgactcttcaggtttagtaaagcacttgaaaggatataagattcttacctgtaattaattgttatttaatgtatagcttcagtgta

SEQ ID NO: 118190 - DNA, 2082 bp, Homo sapiens
agcaagttaattctcattttttaaatgaagataaggtggtatcctgcttttctcttgggtagctctgaggaaccaagggaaaagtgatgtatacatttacagtaatctctgacacttaggaagtattcaataaatgataacttttacctttagctcacctgtgggctgaaaagaaaaacaaaaatgaatctcaagtaatatcatcaggattttgaaaggagtgtgtcaagcaggaagccccaagagtagaaacatggtgttcatctcaaaaaactaaatgcaagacatcgatttgtcatgttaggttacagcatttattcagatagtgcccaggaaacagggtcagttcaaggtttaccctatcttaaggaaaatggtaagtttcatctgaagtcctaagagcagggaaatgatccttaccaggagctaaagaaaatagttcagctaaattgtaaaggatggattaaggtgaaatttgtaagatgtgccaggagataccaaatataggaactataggagaaagactgtcaactatatggaaagtaaaattggaagtttggagaagatggattgtttttaacatgttgtagctaaagttgtaaatccctgtgatattcagggcagcttcaccagagtggcagtgttttttttttgtcctgcatattggttgattgcagactgtgagagacgtattcccatgagctcttgtatccccagcactatgctagacactaaagatgtaactatgaactaacagaatcttggagcgtgagggggcaggcagatgggagaaatgataagaggcaagggatgaggtgtgattcttagtgacatgatctagaataaaggatcctcctttacttattcccaaacccctagtttgtgaccagagagtaggcactaaagcccagtggcatgtgtttgagttagaagtgcacttttagggtatagatagatgttactaaccagtgccatgggttctaacaatgaatcttaaattctcagagtttacctttctctacacatgtccacactgggctccaagaacatcattttattgtaagggagttgagtttttaagattttgttttccttttaaatgataaagctaaaactttaccatggtatgaaccagtatgatagatccttcacttatgctttaagaatttttgccttttctcttctctaaacaattggaaataatttttcctactagctgtcccttgacttttaatataatttattattttgtacaagaagtgctaccatatgtacggaatacctaacctaaaattatacctgaacccaatgataagcagatgatacagaatgatggtagagactttttatactgactggtaagatacaaagttggtaacactccctaacacttaagaatttgactttttttttttttaattgattgctctttttaggcagaatggctaatgcggatctggtgaagtatggtttggctgatgtggtagaaaatcctggtatcatcactgatatagggatgaaagcagtcaatgaagttttttcctgtatcaaatatctggcaatttacaattgccctcatctacacaacccatacaattggatctcaggtattacagacttaaaaatacagctatgttttattgatactgaaataatacaactttccatgttttctatgtgtgatatgattgcattcctaatgtaaaatgtaggtatttcatttggattgttcatacaagttctggtaacctttgataaccaagttggaagtatattcaatgcctctttaaacttctgacgttctctgcctagaagtgtatactctccaggttgtggattcaagtgccctgatttttatatgtacttctttgggctaggaacataaaattaaggttagttcattgttacctaggacttaggatattgtagttattttctcagaattatcttcacaatagcacatcatctgaaaggacaaagtaggtatgtatgttgaactttaattaagtgacattaacctgagataaaaatttctattgactagaaatcccagtctatttcagatctccccctccaatctcc

SEQ ID NO: 118191 - DNA, 2054 bp, Homo sapiens
tttaaaaatgatttatattataccaaaggatcttactctgtatacactgtcctgtagcttgttttttgtactaagtataatttggagagttttccatgtcagcaagcatattaagctctccttaattcttttgaaatagctacataatgttctattaaataaatatgccataattttttaattcagtgtcctattgttgaaaagccatgtaggttgttgagtggatcacatttaaatcagggctgattggattcaaattaatgttccccaggccatttagttctcacaatggaattaggtatgtaaacatcataatttagaatcatcgggttttagaagtcatgaaaaaaaggaaaagttattttaaaaaaaaggatttgaaagtctttgtgacctgtatcaaaattcatcagtaatggggaaaatgttacttagattttctctggtcatgtcatttctttaacagaccactcaagatggactcgattggttgatatcaacctagtacggtgccatgctttgaagctggactcttttggccagtttattgaattattacccagcctagagtttatttcactggatcagatgtttcgtgaaccacccaaggtaagatacatttgagggagtttttgtttattttgataggaaagaaaataaaaacagcctgtgatttttttttttttttcttttcaatgatatgcctttacggtgttacagtcggactttttactgccagcctcagtgaaggcataaaggttgtaataatgcatagcctctcattcttctaaatgagaattaagggttctctggggaagggtaaggaaaaaataagtggaagctgtctgttagtatataaacaaaaggtaaggtaagggtgaggctggaaatttaagacagaaattattacgtgggataattcattggtggattaaatataattaggttggtagattaaatctaattaggaatccaaagtataaacaagaattaaggatttatttggggaatgttttactttgctgctatctttctgttaagttgtatagcctgggaaatctgaggtagcccagttgtacaaaatgttattttaaaactgcttaacatatagaactttgtactcttaaggcaattaaaaacttaatccttcaaccatttatgttctctcttgtcagttattaatggttacattcccactgttgaagcagtacaatataatggggaaagctcaggatttaaggtcagaatcctggtttcaaattgcggctctaccacttactggccatgtgctgttgggcagatctcttctccttgcatgactcctcatctgtaaatcaagccagtaaccctttatctatcttgaagtgttgcaggccttaaatgggattttctatgtgtatgtgaaagcatttcataaataagtactatataaatattagttataatgtaaaggtgaaatgaagggatattaaaaatgaagggatatatactaacccaaattaataaacgtatgtgttttggttttgccttagggttgtgctcgagttggtctgagtgcaggcacaggaattggtgtttcatcagctcttgttagcaaccagaactccaacaatgacgataataatgcccagaataacaatgccaacatccacgacaacaatcaccatcatccagatgactcagacgaggagaatgactttcggcaagatctgcagccaggagagcagcagtttgcagctgacggtaacccagatcttttatgagctccagatagaaatgattttcactttgtattgtatttctggctttatcctgttccctttttcccctgtttcaacttgtcactttccacattgaggaaagctagttgataaggaacatgagggagtaggtgaaatttttctcttttcttgcttgtttcaaaactgcttttatccacagaccctataagaatacctacagaatgggaaagattacagatgccaggggaattagggtagagtggtaactcttgaggtctgagacttaactttcaggatttagacaaaggagta

SEQ ID NO: 118192 - DNA, 2056 bp, Homo sapiens
tagggatattcctgaaaagaaaaaaaacaaggatgtttatcccagctgcagcagcaccaccgccagcacagtgggaaactccagctcacacaacactgcttctcaaagccccgactttgtaaggacggtgaacagcggcggctcttccgagcctagccctacagaagtggatgtgtccaggcagtgtgcctgctcccccggtgggtcagaggactctgaggccatggaggagggagatgcagagagttctgtctgccccagatgctgctgtcacaggccccaggaatcccaaaggagaactagcaggtgttctgatgaggaacgtccttcaaccagccgagcctgtgttgtgaatggcccggatggtacgagatccgccttttcctttaggactctgccacaaggggggtcttcaggcccagcacatgatgagaggactaatgggagtggctctggggctacaggtgaggacaggagggggagctcccagcctgagagttgtgacgtgcagtctaatgaagactaccctcggaggcccctaaccagggccaggagcagactgtcccatgtactgctggtatctgagtcaggtatgacaatgctcctaggattagcaactgcagggtagggctgcagaaaggcatgaacttgtttcatgagttttcttacaaaaagccagtttggcaaattaaattctattttggggttttgtgggtcatgtgaattttgaactaatttcagcaatggtttggagggtgggtgtgtaaaacagtttataaaatgtccaacctggaaagctcaaaatagttcagcttttaaggaaaatgtcattgtgtatatttaccctaaatataacactgactgacacctaagccccagtagatgaactctgctgccatcacacacttagagaagtcttaacttaggaaagttttaaactcagccaaaaggcaaggacttgacgttgctggggctgggggaacacatctcagtgcagcttcctgtgtatacccctctttctgtctctgcagtacttagtaattttttcagaaatctagttttgcttcaagtaagatttgccaggagataagcaggtaagtaaatggtttggctgagaattattttggtgaaaatactcaaaacatatatgtgtatttaatttcattaatgtttataatgtgtagccatggattgggtgtaagcatatttattaatcataagtctgttactgtttctgaccttatttttaagtactctttcctgcctttattatatcattactgcctgacagtgataataatgtattttaattttcttcaagtagccctcagttttaaaatcttaaaatcagtcccagaacataggcagtcagtgctttttgtatattcaaaatagaactaatggattcatacagagctaaacagaacaaaagtaagctttcatgagatacatttgagaccttagttatgtgctagttaccatagttgcataaactcattgaaatatatgagttttatttgaagacttttttatgctttgcaaacagtggttctgccatatggtgaaagtacttttcccagcttaaattgtaaatgtttgataatatcttttttttaattggtggtaaaatataactttaccattcagtgtacagtgtataattcagtggcactaaatacattcatcttgttaggcagctgtcaccaccaaccatctgaactttttcatcatcctgaactgaaactctgtgtccattaaacagtatctgcctcctatgacaccttttgttgtgtggtttttcgtatttgcaaagtcagatatgcatgttttcctttatgagtttatttttatgctgcgaaaggcctttcctacacttggttcagataaatgtgcgcatcttcttattcctttattcattgatttcagtttagttccttagttcagttggaattttatttcaatatgtgggagctaatttttttttttttattccaaactatcaccatcttgtttcaatattggttatggatgtccattctcgtgctatgattttgaa

SEQ ID NO: 118193 - DNA, 1026 bp, Homo sapiens
ccattttagaagctaatataattgttttgtgaatttatattttgggaataaataactaagttgcttttaatcctcactgtataacaatttataaatattagagaaatatataattggattgtcaaagaataacatttaagattagttgctataaatattaaacactttccctgacaccccaagactggattgatctgcctttctctgtttctgtagcatcttcaacattaatgtgaaccacactctgttgtaatttcttgttttactgtcttcctttccagtagactgtgagctccatgaggacaaggacagtctctgctttttcaccagtatatttctatcctttagcaccatgtcttacacatggaatggggcttagataataactatgaacataataagtatagaaaccatcatatgaggtattgttgatactagcggatgttttgagttactaaaaaatgttcctaaacaaaattaattgtctctaaacagggagggaggcataagagaataataacaaacacacaaactttcttcctcatgcatcagaaatgtttgtttttcaagctcatgtatgtatgaagtgtgacttcattttataactttgcctagaaaatgtaaactaccagtttgggtaccctggagagcaggaaactttacctaattttgaaccccatgctctgataaattaaaggggaagggagagagcaatccaggaaggtgagatacttgaaaatcagatcataaaagtattttactgagagatctttattagaacactgtcatgtagtggaaacaggcttgctttttgtttgttcattttcatttttgtggtactgggagagggaaccaggacttactaatgaggttttaaaaggattgtgaattttggctatcaggtgaaatgtgctgcctttagaaggtttcatgtcaatgaagattgtttgattttggatgaagttccttcaggatactgtgggagaaggcctacgttgtgttgtgtggtcaatagtcttcatgttt

SEQ ID NO: 118194 - DNA, 1022 bp, Homo sapiens
acctaggcatgagaagggttgttatgtttgatgtagatatgtttgaagtaatggagggtgatcctgttttgaaacaatccactggaaataccaatgtaactgtattccactgggaaccaaattgtagatttgggaattaccttgattatgttcatacgtatgtgattgaatgtgcttgagggaaagaaagcaaggctaaaatttggattttctttttttttgccttttttagaagtagccaaaacaaagccacgtcacgccatgaaacggaagcggacagcagataaatccactagtacaagtgatcctgtgatcgaggatgaccatgtgcaggtagagaaaaaaccctcacttacctttatcacagtctagcccagttcctaaataatgcacataaactaaagtttgtatctttatatagtttctaatttttctgcttgtaggttcttgtattaaaatccaagaatcttgttggagtcactatgaccaattgtggaatcacagatctagtgctaaaagactgtccaaagatgatgttcatccatggtatgtatttgggcccatattatacaagagtatcatgaatgagttaaaagaattaggaactcataaatactgtaatagcattactgtcttattttcttaaaggaaatattgtgttgggttatctttagttccgcctttgttctagttctcaaattattactccatagtatttctgagcatcatatatagaaacttcgttcatcttttaaaatagcctgtctccaaaagataattactgcctgatctggcagagtaaataacagcctgcacaggctttggagtcagatagacctcagcttgattgctggcttggtcatttactagctgtgtgacttgggcatggtttttgagggaagcagcggttgggcctcaagtgtataactgctctgtatttgattgagatgattaattgtatctttactttgtggcccattatcattaatccaagcccctttttctttttagtctcatgtccc

SEQ ID NO: 118195 - DNA, 1763 bp, Homo sapiens
gcttagtctgtaggtagtggctaagttaatgacagcggagatgattaaatgagattagaactgaccttagtcatgtcggattttatagctaagaaccactggatccttactgtcatctagcgctctcctttcctctgttgctgtcctcaacaacagttccccttctttccaccaagtcacaaaaggagaaaatgaacgtgagaggcgggagtctctctcagtgtttaaatgtcaagttagttacattagattgcacaagacgatgatgacatttgggtcaaggatgttacagatgtctgtgaaatgttaagatcagacaaatgagcctgtggttttataatcttttccatttgatctctctcaagttggacctggttgaaatctgcagtgaaaattggaccaggttgaaattggagattaaaaaaagagaaggaaatatttttctgaagttgatatactagttcagttaaatgtgtttattatatcaaaattacttttttctgacttcatgttttatatgtcaaacagaaaaactaatcatgttttagatgagcatttcaatagaactttaatgttctgtgtctacactgttcagtattatggtaaccactaaccacatggctactagattggactgaatagctttagaccaaagtatccaaatgtgtttctgggtcttttttttcaaggttctacttttacgtttgtgacaggaattaaaatccaactctgctcattcctgagagtgaatgtaaggtaacataggtgaattatttcaggtctgactattgactataaaaatgtataatagttactcattttttaaataaatatttcctaaacagtttctgtctgggcaagtcattttctgagacttggttttcttaacagtaaaatcttagaaaaaggcactttaatgccccttctaccttcttttgaattgaacagaaccacattttcaaatttttttgttaactgtgatttgtactctatgatattatttgacctctgttaaagatgtttgttactgcagtattttgtgccaacaaaaattaggccatctctccaaagatgatatgtacggagcttaccattgttttcattttgtagctaccaggtgcagggtactaaaacatttaaaggtagaaaatgcaccaattgtaaaccgatttgactatgcacagtgcaagaaactgaacatggatcaggtactagaccagatactaagaatgccacccgagagaaaccgcatcatatacctacgcccaatgcagcaggtaacgagctttgcttctttccgatgatacacatattgtggtgtttttctttttctttttcttgttagtctttagccttttggatttggcattcattcacttgcccaacctacagtaatgatattttagtttttacaggttatgtatgatatagggagttgttattcaacaggtttttatacttattaaaagttacctgtggtttaagagcacagtctctggttcagactgcctgattaaatttctggctgtctgacctgtagcagattatttgacttcgatgtcttagtttcttcatctgtaaaattagaataataatgatatacccaggattattgtgatatttaatatatgtgaaactctaaaacatgtgctagtatatagtaagccatcatataactactgttagtgtcattatcattattaagagtatattgtatataaggttctgtgcttaatgccaaaagagggtttaaaggaaatttt

SEQ ID NO: 118196 - DNA, 2282 bp, Homo sapiens
gaagttaacgtaagtaagaaactgagggaaatgaggacttaaaactaaaaagcatgtgtatatatttatgatctttaaaactcaggtaaaaattacaagaacagattgcacatgtacttgtaacattatttagccttggggcatgaaaaagagatcaacttgaagaagatcttaagactatgatattctatatcatcagaaaatttgacttttataaatttgttatataaatgttgcattaagcaccttttgtgtagaagacatatgcttagaaagtgactttctttccctgatatgattttgaagatagtgaagaaagtagttttgacctgactacacttggattctctagtttgagtgtatcctacttccgttaggtatttgatgttttgtttgagatgttcggtagaatctgtgtccgaaacagttttgatggttccttcctacccgacactaattatttccagttttgtaatttttacttaatttttcctgttgcttccagagagctcattaaatatgaattcttccctgaagccactcgaagtgaagaagacttaaagaaataccccaagtacccctgggggagagaaatctatactttagaaggtgagtatttacaaatgtttagaaagttaaatagcctgtgcagtacttacctctgtaatcccagcgactcaggaggctgaggtgggaggatcacttgagcccaagagttcaagaccggcctgggaaacaaaacctggccctttctcattcacggatgaatgaatgatccatcaatcaattagtcaaactggtttgggcttacagcaagcagtaacccaaatgtagagaattacactttttaaaaaaagaaagttgaatagctattaactagatgaccgaacatgccttagggaagatatgaatgggggtcctacagttcttcaaaatatggatgattttaatacctgcaagaagtgggagccagatgaagattgctttgcctgtatgagtctttactatttctaggacaatcagaaccagtgatgaaacataaaacgtaaacagaaattacaaattagtttgatagctggaaatgatttgaggacacctgactcactctctttattttatattttacattctgcttacaaaatactgcagaatttggctctgtcagcactcccacgccagttagcaatgttacatttgtcttttaggtgttgtggatggagctccatattccatgatttctgacttcccttggctgaggtcattacgagctgcagagcccaacagcttcgctcgatacgactttgaagacgatgaagaaagtaattatgacctgacttgacatctattctctagtttaagtatagcctactgtgttacatacttaatatctttttgtgagttaggagcagtgcagtgttaaatggtttcccatagaaataatttgtatttactcacttcaaaacagttctttatttgtgcagtagatgttcagtggacttactagggatatataaaggctggtagaaaggattcctttagacagattttcctacaagatttttatattacctaaatatttataatcttatttattaaataacttcaactatattgtttcaaaattgttccaattgtattattctcctgctagttatgagctgcttattgtgtggaaacttataatttaggtgtagaaattaggggagaaatttttgaatgtagtttctctaagtggtagcatacttgaatatttattgttaaccaaaggttttttaaaaatactttataaggaaatggattttatgaactacatgtgcatgtgtctgacttgcctttggtgcagtatttttaccttgagactttaagcatgtattctgtcttaggcatcaaacataagaacaaactggtggtgacccattccttgacctattcatgcatcagttacattatagtgcagtatatgggactgtcctatggaccagcttatcagtgattttccaaatgattctgattatcatatgtatctctccttttatttctaatttcaaaggcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatcca

SEQ ID NO: 118197 - DNA, 1038 bp, Homo sapiens
ggaaaattgctcactcataattaggacctgtttttaggctaggtaggacaataatcccaatttctgattcccactaggctgcctctgtttttcgtgacagaaatacaaggatgccagcaagtttttctaacacaaaatattccgcgttaatcagtgtctttccttaacgttctctttttttcccaggctctaaaaattctcattacattaggaagagtgattcaattgggtacttcattctattgtctccttattacattatttttaactcagctaacttataattagacaagtgtgtttcactatacagattacaagtgtggtaagaggcaggaaatacagaatatcctagatatttcaaagtaatctgggattcccaaccctgagcgaagacaatctaactctaggttttcactgtaacctgttaaccaaattatctaagtaatgcttacattagccacaagaggccgctgctttgtaatttttggcttagtcatgtctttgtctaacctaacctaaactgttagatcagtggaagtacagctggcagcgctaaaatcattcaaaagttgctaagactggaatagctgaaaaaaaatctggaagatgccaactacgatagtcactctgaatatatatataatacgaagggctggagagtgattgctctacagcaagggtcagcaaactatataggtccaaatggtaaatattttaggctcaatgggccacattctctgtggcaactgcacaactattgtgaaagtcatagacgatataaacgaatgggcatggctgtgttgcaataaaactttatggacacaaatttcaatttcatgtaattttcacgtcacaaaataaaactttttccacagccatttactaaagtaaaacaccatcctgaaggctcatagaccagatttggcctccaggccacggtttggccacacctgccatagagaactgagatatcctattcattcatttaattatatcaccagctgttggtgcagtgcagtgcctggcacattttttaaa

SEQ ID NO: 118198 - DNA, 1041 bp, Homo sapiens
catataaagcactgaccacaatgcctagcagaaaaaaaaaactcattaaatgtcagtttctcttattgctattttattattatttttattaacaaagatatagatctggggcaaactgaaagaaaaggtaaagaaggagaaacctaatctgaatccactgtaacagtagttaaaaatgtatgcagtttcttatcccttctctccatgtttccaaaagtgtagaatgcagcttgtagctaaatcacaataactcctaaagcttggaagcttctcttttgtaaattctcttttgaccctcccaattaactgaaagagccccaagcaagaggtagggcatttctaacaactctccaacattcacttgtctcccttttaaacacagaaacagaggttgcactttgatcactggcatctagttaaaactcattagcctttttttctattttgagtactgatataatgttcccttcaaaaataaatttaggtaagtgaaaacttgaatggacttaaataaggatattaaataggtaacagaacaggcagaacacatttgataaaaatcctaacagtggccctcagatgacccatgttggagcacttacaacaatcgtacaaactcagaaattatctctattttgtagatgagacaggtgaagttaagtgttgggtaaggcccaaagcaatgcgttgttcatacttaggacttcaaatccattcctgaattgtttgacttcaaaccaaatattcagcctcagttttctaaattagatggaaaagagattacaaattttggccagaagaggtaaatgcattagtctttttttccttcctagactagatgttacaagattttgaccacagcaaagtgaagagacaaaaagagaggagtgacaacgttttctcaccagagagatccaataccaaagagataagtgggtagacagcacagcaccaagaagacattatttttgttcttgcttgaagacaatattaaaggcagtgtagttatatccactccccagcccctccctaggtcccctc

SEQ ID NO: 118199 - DNA, 1076 bp, Homo sapiens
caaaaaataaaagattagtggggcatggtagcacattcctctggtaccagctacttgggaggctgaggagagagaatccacttgagcccaggaggttgatgctgcaatgagccatgatcatgccactgcattccaacctgggtgacagagcaagacattgtctcaaaaaaaaaaaaaatagcctatggtaaaactggttttcttataccatctcattttgcttatagttgcagtttccaagaatctattgaggatgttgagtgagaacttactgtataatgtttatacctgctcctaacacaggctttccttcccctaagctgatcagcaaaaagagacatgctaaacccatccttcatgtgacacttagcaccttgtattgtgtctgtttacttgtctttttcccccactaaaactaaggaacatgaggccaagactgtatgcctcttactttccttagcttagatagaatttggcatgtggtaggtgctcaataaatatttataagaacatttaatgccagtgactttatttctgacacatgagacgtaccttttcaaaaataactgggaaatttttttttgcacaaccaaatggtacacaaaggcatctatcaacaaatagataaaagagagataatagcgttaaaatagagcagatgcccatattaggaaggctgaattgaatgaggcaaagtgaccaccttgcttaggcaatgaagttcctagaaatcatagtgtacttcataaaacagaattgcatattactgttaaattttaaaaaagcaagctgtgctgaatcatgtatcaacttatacccaattctagtagagactagaattgtaggagctgacagtttaaattaattgattcttaatattcagtaagctctgttcactaaatgaatgctttccaaaatataataggcatattgtaggtagaatattgatagttttagaggtacatagatatatatcttaatggttatttgtgtattttaataaattttagagagaatataactaacatacaggctccgtgacatcacaaatcttactgctttgggtaaggctaaag

SEQ ID NO: 118200 - DNA, 1051 bp, Homo sapiens
aatcatcttacagaatccctagaatgtttggattctacctctactttatcagttccaaacaggacagcaaaagtgaccttctcatgtaattatctgttatgaattttatcaaactggtaagcttacattggcctcataataaccaaaaatgccccattcctgccttcacggtctattactcattatgtccctattttcatctctgaacagtcttagctggttttaggatgaaatccttacactgggatttcccgatgtgtgttttatgtgaaaagagtcttgtggtcaaataaggttggggaactctgccaacttcagtcttgtcttaaggagactagacgcaaataatcatcctgaagactctgagaagtcctccagtaaagaggtctggttacctttgttgaacagagcatttcccatgctgagtcaatgtttcattgtgtaacatttattcacaaaccttgaaataaatgttaatagaataaactttgggaaatactacctttcacaactttctgacttctccattcattatcacacatgtatttaccatcatcaagaatggcttcccccttcctgggagccaaactgtcttcttttccctcagaaccacatttgccccttaatgaaatcatcccagatgaaccatgtctagccacaaaacttcagttatttcagaaaccacttggtctctcataaacagctctgtgcaacaatcggttagacagcaatattttaaaagcacaaatcatatatatcattcctccgctcagaactcttcaggggctctcccaaaatatgcaaaaagaagacagactcttatggtccagtgatctgcccccttctacttcctcaacataattttctgccactccagctcttggtaacctttctgcctttctcacagatgccaagctaattcctgctgcagggtcttttcatgtgctctctctttcacaggggatgctcatagcccacatcctcccgtgctcacacttcttctcactcaggtatctcacttgtcacctgcccagtgaggtcttcctggacc

SEQ ID NO: 118201 - DNA, 1130 bp, Homo sapiens
agaaatctcactgggtcaaggagagaaggtcaaggtaccccggctaagtctaatcgctatgaggtggtggaacatgccctgggcctggagaaaggagagtcttgtcctggccttctcacctgctgtgtgactgcctctctctgggactcaatttcctcatctgtaaagtgataaagtcaaatcgagtgatctttaagatcagtgcctggcacatcatagttaattggtggtggttaagggttctgaaaaacaataagcctgttttttgtttatcatgcgttattatataccaggagctgggcttggccccttacgtacatattccctgcttttattcttatttctgtacagttttcaaaatagacagttattcctattttacagatgacaaaactgaagtttaaagaaattaagcagcctgcctcaggttacatagtagataataggaagagaaggaacccagctctgtctaaacaaaagtctcactctgcaccactaacacaagattcagatgcaatagtccaagctcaatcaagcctgcatgctcaggctgctgaaaaggaagttccctggttgtcagggtctcacagctgagttttaccagactgctggagcaaagaggcagcagtttcctatcacttatgggaaaaatgccaaatgatcaagatttagggccaactaccctggtcacaatttctaaaaagagagggaggatgttagggcttagatatcattggccgtgagtctctgggctttgcttgtgccccttcctccattcacagcactttccttctttcctcatttcctgcacaaatccccactcccaatacacacacactcacacacacacacactcacacacacacaataacctaaacttcctaaagtactgtgtaaagggctacaacatataaaaaaatgaacaaagaggcagggtccttgcctgtaagaaactcacaggctagtagtggagattagcacataaacttgacttccacgtaacatagtaaattctatgattgaggtaggaacttgagtttcttagttccttaaatgtcaggtgtgtatgtaaagatattgtttcaattttagttgcaataaagattaaggaaaattaattgttcagaaag

SEQ ID NO: 118202 - DNA, 2149 bp, Homo sapiens
gagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggcacccaatggaagccatgcgccggaccacgacgtcacgcaggaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccccccaacagaacactaaacagactatttaacttgagggtaataaacttagaataaaattgtaaaattgtatagagatatgcagaaggaagggcatccttctgccttttttatttttttaagctgtaaaaagagagaaaacttatttgagtgattatttgttatttgtacagttcagttcctctttgcatggaatttgtaagtttatgtctaaagagctttagtcctagaggacctgagtctgctatattttcatgacttttccatgtatctacctcactattcaagtattaggggtaatatattgctgctggtaatttgtatctgaaggagattttccttcctacacccttggacttgaggattttgagtatctcggacctttcagctgtgaacatggactcttcccccactcctcttatttgctcacacggggtattttaggcagggatttgaggagcagcttcagttgttttcccgagcaaagtctaaagtttacagtaaataaattgtttgaccatgccttcattgcacctgtttctccaaaaccccttgactggagtgctgttgcctcccccactggaaaccgcaggtaactacttgtaattactgcccatgacttaatgtagaatgatacaagaatgacatgcacagattgcttaaccctttcatttgccttt

SEQ ID NO: 118203 - DNA, 1049 bp, Homo sapiens
tctgtcatgtgagacaataagctttatgagtacaggcacctcttctgtcttatttcctatgccccagcacagtccctgacatctagtagaccttcaaaaagttttatggaatgaatgagtgaacaaatgatgcaaagtgttggttgcaggatatctctctcagtcttccaattcttaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggtaagagccagacttcccagatttcctgacagccaccacccaaccattctccttcctgactcaaagacaatgaggagcctttgtggtggagctgagaaaaccagagtgccaagatgagaagtcttgtctcatagggtgaggagtggctttacaggggacatggaagctctttccacttaaccctgctgaagatctcaaaggtgctcccatcttcgctgaggagtagaccatggttcctctttctccttgccttgccaccatgtctgtggcttctttatctgtcagatactacaggcacattgcctgtaagtctctcaagggcctatggaaatatacaagaccccaaaacaaaagaactataaggtctaaaatgaagatcaaaatgaatacttaagagtttgtccataaaatgttacagaccaactagtcaactgcaactcatttcttataaagtaatgtaaagctacattttatgagaaatgtgggtgcatattaacatgtttgagataacgaggtatggggcctttaaactaagtatacttagatcttaagaaggttttatccctgcttctcttgcttgctgaatctagaacttctttttttgcttgcttgctttttttttgggacagggtcttgctgtgtagcccaggctggagtagcatggctcaatcttg

SEQ ID NO: 118204 - DNA, 1072 bp, Homo sapiens
gcatcagtaataataataataattataagtgatctttaaacattcatcaggtgccaaggacgtaataggcactgttctaagcacttagttgtatctcaatttcatcctcacaacaatccgctcaggtgggcacaattataggtctgttttacagataaggaaaccaaggcacagaaggatcctgtacgttctcaaagtcacacagctgattggggtagagctggcattcaatcaggcccacctccctgtgtgatgtgggacatggctgttcctgctcagagcttctgtttcatcctgtgctgagtggaccctaaggcccctttgagccttcacacctcacaagttcatgtctgtccccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggtaggcctcctgcagagctctctgggagttgttgacttggatcatttggggaggcagctgtaccctccaaatcaaccagggggaaccagagagggatgatgttcaccctaagcctgtggagaaagggtcaacactgggctgctccctgaacacatggtggaaaccagggtggtctgacaagctgaatacagggagcaaagggccagtcgctgagacccatacacatgtgtgcaccctgggaggatgtgaggggagtctcacataccatctgtaacgtcacttgtcccgttaactatacctgtctttccaaagctcaacatacaccttgactttagggttttgctgcagtttgaggcaaggttggtgtgtatgtggggtattaacaatattattctcttatttttttgtttgtttgcatacttttaatatcagagatgtggtacagtgtagtggttaaaagcctgggctttgaagagagaaaagcctagagtcaaatcccagggccatcacatatggactgactgtgtgactttgggcttgccatatgacatctctgggatt

SEQ ID NO: 118205 - DNA, 1053 bp, Homo sapiens
gagtgagactgtctctcaaaaaaaaaaaaaaaaaaggattacactattattgaaggttataggtgaaaaataaaggtccccttccaacttccctttccttgatactttcctgaagtaactacttaaagatttttaaatacccatcaaggaatatttcatgcattttaaagtttatatatgatacatattttctatcttaaataaatattagatattaaatataatatgcacgttttagttacataaatggaatcatgataaaatgtctattacataatatactgttctgttctttgcttttctcgtttaaaaatatcactgtgaaatgtcaatccaacattttatcacactatgggagcccttccattgtgtcaggcactgtggtagttattggggaattcagtggttagaaaaaacaatccaaatacccacaaacagaacagtctgccctacataagagtgagcttgttgcctttacaagtattcaaacagagaccgactattcaaaaattttacaaaagagtttcctgaattgagctggatctggaactacttactaacagttttattgaggtttaattacacaccataaaattcagccttttgaagtatgaaatttagttttcagtatattcacacagttgtgtaaccatcactgctatttaatttcagaacattttcatggcccctgaaagaaagcctcctcattacccactcctcattacccaacctcactccaaccctggaaaccactaatctactttctgtcactatggatttgcctattctggacatttgatataaatggtatcatacagtatttgtccttttgtgtctggcttctttcacttagcatagtgttttcaaggttcatccatgttgtcacatgtatcaatactacattactttttatggccgaataatattttgttgtactgatatactacatttgtttattcattcatcagttgatggacatttgaattgtttccactttgtggctattatgaataatgctgctgtgaacattcatgaacaaatttttgtgtgaag

SEQ ID NO: 118206 - DNA, 1066 bp, Homo sapiens
ttaagctttgcacaatgtaaaatatttcaacagatgttgatgggaaaagaggtcataggtaggaaagtgagtcagtgcttgaagaacgactcatgtagtttggaggaagttaccagaaggtcactggtgcagcaaaggtgggtccatgctctggaaacctgggaatgcctgtgtgagggccctttccttaacctggcagagaatggggagctactgcatgtctctgagcaagggtgacatattatatgactggaccttttctctaggaaatgaaacctggctttgggggaggcatgcatcatcagggggaatctggaggcaggagaccagcgagaagcccacggtggcacttagaaaagggtgagaatggagaggaaggccactgctgaggaccaatggacaggaagtcaaagattccaggagctttacaaatatggacacctgtgttctgcctccagaggctgttgtgtaactggtctggatggaggctgggcaattatattgataaaagctccccaggtggggctggtgggcaaccaaggtgagaacattgctctgaaccaccccttcatgttaccacagggggaacagaggaccccagggatgaaggagctgaacccaaggccttccctctggaactttagaatcctgacattaaatccagtgagctctcattaaatgtcctggtgattttaaatcctgacatgaaatccaatacattctggtgagaagtcccagtgaaagggagaaagaaaaaagaggatggaaaataggaatgggggaagaaccctggaggatgcctccatttacagagcagaggaagagagaacgcagagaggaaacagaggagccacagagaggaagaaacaagctgcgggggaggcggggctgacacctgtgctgtcatcagagaggtacagcagggccaagtgaggaaagaaaggcctttgggactggccattggtaggtcttctggaagcacagtagctacatggcttacagagttgtggagtcagggtccccaaaaggcattcatgaccatgtgagtgcagcttgtgcctccact

SEQ ID NO: 118207 - DNA, 1050 bp, Homo sapiens
ccatgtatggactggggaccacttgtctgggcctccttagactttcttggggttgagtctaggaatcttcattttaaataaacttcctaggagatgcttttcacactaaagtttaagaaatcctgctggaagatatgattaaacttaaatatacagattgacagtaaacattaccccacaccatggacctgtgtggctctggcagagatctgacagttcaagtgtaaagggattgtttgttagttatttaactgacaaactactttcggagccacaaaatatcccaggtctactaacttctcaccttttcacaggtcctggtagaaagtaagttctcaataaacttttgccatcatttaaataagagaaaaaacaatactcatcatcatcatcattattctgatagactgttctgttcattgttgcaattttttgaaatctgtgtttgcaaaccccatgttttcattggcaggtggttcctaaagaattatccaggaagctgtggcctttccaggaagagggattggacaggctcctatcagattggtatggctgagtcaaaaacatagtattgttagggagataatgttgtcctgcctctcaattttatctgcaggtttggagtcagttgatgtgaatttttgtctcgtctctgctaggaactggatttagggaagccagtttctgtctgtgcacatggttttccctgcctgtgaaatgagaggtctcaatccagggggcagctacaaatgcctgcaggtgtgggcaggacacacagatgctagggggcctggatggaaggtattagggaatggcaggaataattagggattttaagatatatgagtgaaaaaacagggccaaattaaatgtttcgtgagccaaatgcggcctgtgggctgcctgtttcaatctctggtcaaaacattttctaatttcccttagagttttgtaaaattaactttgaatttaggaagagtagaaatgcctggcacataagggtactcagtaaaaatttgttgaataaatgaattatatacacacacacac

SEQ ID NO: 118208 - DNA, 1050 bp, Homo sapiens
catcctgtttaggaaatcactgtcaacatcaagtcatgcagatattcttctatattttctataagtttttttttgcatagatatctttttaaaaacaattatctaaaaaattctgatacagacagttcacatatcacattttgcaaaaccttgcaattttctgccctaagcctcacaaatccttaaaaagctgtgcaccctttccccaagccagggtccccatccttgacttcccttcttcaaggtgggctcacctcacaagccctcattgtcaggctattgtattttcttggagaattctacagcagggatacactcacaaacttgccagggtcaggtgtaaatgagtgatggaatagggtgggcaccatggtggctggagaacaaatgccctgcagagcgacagcaaccacttggccccagctgactgttgccatatgacaatgaggctcctgggctacagatcttccatgtttcaaaacaaactcaagcatctgggttatgtgaaacatttcaatttctaaatgatgtcaagcagttcaaactaaaaattcactgtgtgggccagaaaaaaataaagaagatgtttgtgggtttgctgtagtctacggtcaaactttgtcccagggaagcaggctgctactccaagtgtggtcctgggagcagcaggaggagcatcacctgtgaaaacatcagaaatgcagaacctcagctttcaaatactgaagcagaatcagcattttatcaatatccataggtgattcataggtaaaataaagtttcaaaagcaccaatctagacatatggttctcaacactggctcaaattagaatcatttgaagaacttattattaaaaaaaatctatggctgtactatggaccacaaaaatctgaatctctaaggatgaagcaatattttttctttttattcctttattatttttaatttttgtgggtacatattaggtgtatatatttatggaatacatgagatattttgatataggtgtatacaatgggtaataatcacatcagggtaaatcacatcgc

SEQ ID NO: 118209 - DNA, 1085 bp, Homo sapiens
agaaagatggctcatctatttttcaaggaactaagaaaagaaacaggcaactgactctgcccttttctctctctggaatgctaaggaactcttgtcctattagtaacactgagtattcctgaaagaaggaaacagactatccttcttttaagaaaaagaaagaaagaaaagaaaaaagaatcaatagagttggatactgcagaatatgaggactggcaaaaatgccactactttttataagcagggagagtgtgtgaattttgcagtaatggaaaatgaacagaggagaatggctcagcagccttggaagccctccgggttccccccaggaggaagtgcttctctaaacagacacctgggggacacagcaagcacagagctttgagggcttaactccatcatcatggaggtacctcccaaacccacgagtctgcaaatgcagagagtagacatcagacctcacaagaaaaggagtaacagagccatagggtgatatggatagggcattggcaggaggtccttgggtcacctgactaagcaaaaaagctcccctttgagatgtgaaattcttaacttgatcctcatgcctgatattgtccctaatagaaactcttgcttagtttttctttcacttctatttatttagtccttattctccaccagccaccatgctaagcactcccctgattgagctcaccagactgtcccacccaacctgtgagatgggtgtttttactcattttatgggtgaaaatttgaagctgtgttcagaaacgttgtagttaatgctcagtggcttcttcaagtcatgcagttaattgttgggttatgaaaggtacttggatgtgtaacacatttgacactgagtacaactcctaatcaatgattcaaatgtcaacactgaaatagaggcaaagcatgagattacaatcatccctttgtacacatggggattggtaaaactgtgcatactaagtcctgcagtcagccctgtggaacctgcttatacaaagagtcagccctcagtgtaggcaggtttcaaattctgcaaatactgtatttttttaaatttcaacttttatttt

SEQ ID NO: 118210 - DNA, 1035 bp, Homo sapiens
attacaccaaaccccaaacccttctcttgtgtaactgaatctatttcagattacttttttttttttttttttttttttagctcagaggatacaaggtcctggtttcaggagctgtgtatttctggcatggctgggttgtaactcagaaaaggtgcactaagctgagagatgttcaagtgagggcctcccattgttatgggttgtggaacgccagccctcagtcatcatctacgcatttcatgaaaccaccctctaaaaggcactactgtagtattggttgctataatttcgtagtttagcattattactttaaattggatctctctactgacagcttaggttgtaggagttatgcttaaaaactttaaatcttatgtttccccaatcctactacctaattttagatttttcagacatattctgttactgtactaaattgatacttcctgaagtctgactctactaagcatatttcattttaaatagagtatattttaatttttggcgagctgccatttttttttttatttagattttaagggttaccaagcatcttgaatcatatagaaagtattacagtgtagtagcttaaggtttgtatttctaaagtttgtttccagcttctcctctcaggtcaccacagactcatgccgatgtggccattttctcgcctgtcacatgtcacatcgacttcagcagtcaatttgtccatgttggtcagaattaggtctagagtagcaatttcccggcttacttcctctattttctgagaaacaaaattgcctgctgggcaagtcaagaacttgtcagatattcaggttttagctcgatgagacattttattagtctagacattttaggtgacagaaacctaactcaagctatgttaggcaaaagaagattgatcagctcacagaactaagaagcgtctaggagcagcacagctgggtcgaggggcccgtgagcaccatcaggtggttcttctccctgtttctttttgtgtttggccccatgctctcctgcccagactggctg

SEQ ID NO: 118211 - DNA, 1088 bp, Homo sapiens
ttctttataaatgatccaggttcaggtattctgttataagcagcaaaaaatggaccaggacaggtccacacttttatctgcaattctgaaatccagaaagctgtgaaaccaaaatatttctccattgttttggtatagactcatttggtggcaaaacttgacctgacctgatatgactgtttataatctttattcactccatgtgctatatatattcctatgtcttgccgtagaattattaacatgtttgcttacatggtaccacctgaggacatattgaggttttcatcatgtgttagtgtaggtaccatattacctttataaaatccaaaaagttctgaaacacagctgacccccaagagtcacacagaagggactgtggaccagcatcctggagggagccatggacttagaattggaagaggtgggtttgcttctttgcttttgcagtgataccttgcatagccctgggcaagtcccatcgtcctcgattttcagttacctcatcaatgaaatggaacctgtcctgtctgaaaacacattgtaggctcagaaaccagatgattaagcttgttagaaatatgtgttaacaaagagtgaataggttctgaataagatctgaggattaccccttctgaggaaggttcatgagtttcattgtataaatgcattggcaattctctacctttctcactagttgattttttggttttgggtgaagttccatagaaagggggctaccagatctctgatttttgaggagcagaactatggctctaccttggctttctgtagcacccttccttggttggaggctacgatggatgggctcctcttcctcagctcagaaacacagttgacagggagaggttgctctggaacgctgttctggggtttatttgcagtttcctgttgatggcaataaataattatataggtgagatctggtgatggctacctacacacccagcctgccctcaaaagcatgaggacactttattatttttatttttatttttgagacagagtctctgtcacccaggcgggagcgcagtggcacgagcttggctcactgcaacctctgcctc

SEQ ID NO: 118212 - DNA, 1033 bp, Homo sapiens
tgtgcttcaggaatgggaaatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctggtcaaggtaaataggttgaacaatcaataacattatccctgcctgcatacatgtgaacaaaagctatagaggacatgcaaattctacagtcattcctcatatgctttagacagagtgcagctactggaatcttccagatttcagtgttttaaaatcagagctctgaatacacaaaaggaaagagaaatggagcagctgacatattttaagctcacagtgatactcagtgacaggagcacagagctctaatgtccacaggatgttgtagggtagggtctctcagtaaatcaagtcccttacctatgttctgacactgaggctcttggagctatgggttagaaatccaggaggcaatatgtctttattctaatgaagtcctcatcttgcactcagaggcccactagtttgcccttctatatattaagtaaaaccaagagaaattaagaggatgatggcttctttctgtcacatgggtgctaaaccttttacaaacacttgatacttcta

SEQ ID NO: 118213 - DNA, 1598 bp, Homo sapiens
gagtgccgcgtgggagagcaagtaagcattgcaggcggggagtcgggagcgtgaggactctgaggggctagcgagccagccggggtggttgtgggctggaaggcgagagctatctgagcgtaggccaggggaccaagcttctcggcctctacgaccgtgcactcacggccccattttacagacggggaaactgaggccatcagccgtgcctctttcttaggccgaggaaggtaaggagatccgaggtcatgcatggcctggaaggtgagaagtctcttaagcccccaagggagggatgtaccactctcccggcctcttctcccagcctgtggtacctgtgggtaaatttgggttctctcccctcactccgtgtgacctaaggccagtcctttctccgttatccgggcactgttgtacctgtcagtaaaaggaggccgctgaacttgtttctccaaacggccattgcatcagccttcggaagacaagttccatcggcagcttttattggtcgcttacgaggccgactgcagaattatgggtggttctttttattattacccatttagtagttaaggaaagtgaggtttagaaaagttgagtaacttccaaacttaaatatttgggaagtggtggaacccgggctggaaaccagtcagggcgttggaatcggcgctcttatttaatgagcgatgttaattaattttctcagagactgttgcccctacactgtttcttcctgggatagagaataaaaatagttgagtacgaggtagggttggacctctgaatagtaaagtaagctacgggagaatctggtaaatgtgcttaactacatatgtcaccctttttaccttaacacacctgacccaacatcctaccctagcacctaagtgagaggttgcattcagggtttcgggacttggttttgcttaccgttctcaagtctttttggcagcttgttggtgatgtaaggaaatgaccagaagaaaaatggttccttctggtaagctgtctccctactccagttctgaagcagtaggaattgagattggccacaactccccaaccctatttcttggtctaagctttggccattttccctttgaactggccctgagaattttttttttttttttttttttttttttttttttttttttgagacggagtctcactctgtcgcccaggctggagtgcagtggcacaatctcggctcactgcaagctccgcctcccgggttcacgccattctcctgcctcagcctcccgagtagctgggactacaggcgcccgccactacgcccagctaattttttgtatttttagtagagacggggtttcaccgtggtctcgatctcctgacctcgtgatccgcacgcctcggcctcccaaagtgctgggattacaggcgtgagccaccgcgcccggcccctgagaatattttgacctgctttttcaagtggataaatgtggtttttttagggagaagatgtttcaccgtgtgtaattagccccagatctacggtgaccatattttctgaccccaaaatgtggaactgtctataaaatcacacaccggattataataattgaatttaa

SEQ ID NO: 118214 - DNA, 1820 bp, Homo sapiens
aagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttttgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaattttttttttttttcctgtgttgcccaggctgacctccaactcctgggcccaagcaatcctgcctcagcctgccaagtagctaggactacaggcgttcaccactgcgcccgcaaagtttttttgttgtttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtgttctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactgga

SEQ ID NO: 118215 - DNA, 1029 bp, Homo sapiens
ttgtctttttttgccttccattctgtgagatttgacagatggtgacaataagaaaatgagctgattgtaattactctctgtgtgtttttttattgctagctatcattaccagttagaattaacattaattacaattaacaataattttaggtatggaatgttatgattacctaaagagatgtctctacctaatgagctcaagtgatcctcccacctcagcctaccaagtagccaggaccacaggcaagtgcaccaccatgactggctagttttgttttttggtttttggtttttggtttttggttttttttttttggttggttggttgttttttacaggcggggtctcactatattgtccaggctagaagaattttctaatggtctattacacctcccgttttggcaagtaaattcagaataattttaggttcttttgttattcagtagttttgcagacttaaaagtgtaaatttagaattagaagatgaagctatagtagtaagaatctcaagctgaagggctttggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaag

SEQ ID NO: 118216 - DNA, 1112 bp, Homo sapiens
attttgatgcatctccaaataaattgcagacatcaggacacctcactaaatacgtcatcgtgcatatcattgactagagtgtcatatgtgtttacagttgcttttttttttcctccctcaacaactgtcattttaactacatgactcgtgaagattttcaagtccctcacacgtgatattcccacaggcagagatcctgggcttcggggtgggaggacaaagactctattccgctaggccactctccatgcaccccagttggcaggagtgcctggaacatctgatagaagcatcacaaacttacagggtccagtgcagtgctaaagcttcttgtgtagcagaaccacagcccaggccatacagggttaagaagactgaagcatgccagaaaccagtttgagactgagagtttagtgcttgccaagaaaagagaatcctgaggctagagtagccagagaagccctcatggagaaggtggagtttgagccaggcattgaaggatgtggaagagttaggcaggcagtatccatgagtgaccatgtgttctctctctgtccttagatcgtttgaatacagtgtggctaggagtaagcagagtgtgctgtgggaatatgcagggcactccccgttttcttaggaacaggcaacaggacaggacatttctcaccattggggaaggagcaggacctccacccagcagaattgctgcattgtggcaacatggagctctctgcctccttcctcccagctggcccttctggccccatccaagagtcatccagagcaggacacttggcaatgcctcactgcccttcagctttctagattttcctcagccctctgacgggagcctctgttcatccttggtggtttggactctacccacaacaagaatgcggattcctgttaggatggcttaatgcttgtgcttctgcaggaccaaatctgagaacccccaagtggcatcaggaccctctaaacccacccatatagttccatatgctgcccttctcatgctggtctctttgcagagtgtgcgtgtcctctcactgacaaagctgattgtcctccagcatcttgcatgaaatcttatttccccaagaaggctgtgt

SEQ ID NO: 118217 - DNA, 1020 bp, Homo sapiens
gctgggtgagtggtcagtcctggggctccagtgcccagcgccctggggctggtgacagcactgggcccttctcagacttcccagaccatcaaggccagaaggtcatgtggcccaatctcattttacagatggagcaacagaaacaagagaggggaaggaacttgcctgaggttacacagtgagttagttgcagagccgggattagaactcaggtttgactcctaggccagtttctttccctttcaatttgctgcctctaaataatcgtgattatatcaccttccacatgctagtgcttgccaggcaccttctgggtggtatgtaggcattacctcagctcccctctaccaacctgcaagatgagtgttatatctcctcttaaggcaactgaggctcagaaaatgtatagatttaagctaaagccattacagcgagaggtgggattcaaacccagcagcatctgtccaatacacgttctgtttgatgcagaaactctgcttctcagaagtgatgctacaggtggtcttacagatgtgcaaagtagcatagataccaagttattcactacagcattgtttgtaatagcaaaaggctgaaagtatcctagctgcctatccactaggacctggggttaaacaaattattgtataactacacaataggctgttcagcagtcagaatggggaagtctttatgcccagatacagggcaatctccaagatacagtgtattgttaaagtggagagcagtgtgtgtagtatgtgggggtggggaaggaacaagtcatagcagctctgtctgtgtttaggagtccactgctctgtcaagttgcagagtgcaggatggctgtaaggagctaggataacttccaagtgatctcagtgcccaaggccaccatctccaaacaagcccagtggctgtcaccccctggacattctgggataaaatctgaatttccctcacttgtggatcctcctggggaaaaaaaatgtaaaatgttacattattttcattttcatt

SEQ ID NO: 118218 - DNA, 2067 bp, Homo sapiens
aagctgagacttccatcgacccagcctttttctgttgaccgatgaggactttgaatgacatccttgcccacgctcccccaactggccagcggcggaagcagagcagaaactgagtctcctgactccatgccccttgcttcttctgcagccgcatcagcatggagaggccaggacccaccatttagacagccctgctgcaccctgagcaccagggtctcgttgtacctcaatgctggaccccagtagggagttcagtgggtagaagccaagggaaagttgacttttgtgctcttttctttccagaggggaaagccctgtaccaggtggcgtatgagaatgaggtaggcaacagctctgacttctatgacatcgtggtcatcgccacccccctgcacctggacaacagcagcagcaacttaacctttgcaggcttccacccgcccattgatgacgtgcagggctctttccagcccaccgtcgtctccttggtccacggctacctcaactcgtcctacttcggtttcccagaccctaagcttttcccctttgccaacatccttaccacagatttccccagcttcttctgcactctggacaacatctgccctgtcaacatctctgccagcttccggcgaaagcagccccaggaggcagctgtttggcgagtccagtcccccaagcccctctttcggacccagctaaagaccctgttccgttcctattactcagtgcagacagctgagtggcaggcccatcccctctatggctcccgccccacgctcccgaggtttgcactccatgaccagctcttctacctcaatgccctggagtgggcggccagctccgtggaggtgatggccgtggctgccaagaatgtggccttgctggcttacaaccgctggtaccaggacctagacaagattgatcaaaaagatttgatgcacaaggtcaagactgaactgtgagggctctagggagagcctgggaactttcatcccccactgaagatggatcatcccacagcagcccaggactgaataagccatgctcgcccaccaggcttctttctgacccctcatgtatcaagcatctccaggtgacctactgtctgcctatattaagggtccacacggcggctgctgcttttttttaagggggaaagtaagaaaagagaaggaaatccaagccagtatatttgttttatttattttttttaagaagaaaaaagttcatcttcacaaggtgcttcagacttggtttcttagctagaaaccagaagactacgggagggaatataaggcagagaactatgagtcttattttattactgtttttcactacctactcccacaatggacaatcaattgaggcaacctacaagaaaacatttacaaccagatggttacaaataaagtagaagggaagatcagaaaacctaagaaatgatcatagctcctggttactgtggacttgatggatttgaagtacctagttcagaactccctagtcaccatctccaagcctgtcaacatcactgcatattggaggagatgactgtggtaggacccaaggaagagatgtgtgcctgaatagtcgtcaccatatctccaagcttcctggcaaccagtgggaaaagaaacatgcgaggctgtaggaagagggaagctcttccttggcacctagaggaattagccattctcttccttatgcaaagattgaggaatgcaacaatataaagaagagaagtccccagatggtagagagcagtcatatcttacccctagatgttcatcccagcagaagaaagaagaaggtgttggggtaggattcttcagaggttagcctggtactttctcatcagacactagcttgaagtaagaggagaattatgcttttctttgctttttctacaaacccttaaaaatcacttgttttaaaaagaaagtaaaagcccttttcattccttttggacctgttcttttctgtaatggaagaactaagtcttaggttcccggggaccaaccactacattagtatcttctggggaaggggagggagccttgagaa

SEQ ID NO: 118219 - DNA, 1045 bp, Homo sapiens
acctcacagctaggaagtggccaaggcaggaagaagcccaccggcctttcaacaccaacagaattctttcctcagaaggaatgagggagggtggaggggtaaggacatggcatttttaatcctcctgttggactgggaggctctcaaggtcagggacagtgtctgattcagcaccccaccccctcgggccctcaactggccccactcaggatgtcacaaggccccgtgtgctgctggagggggtcccagggtcggtgacaggcagaccacagcctctggcctggaaggaggagagagggattggcaggcccatccaggctgggggtctgaggaactgtgaatgaggccgtgaacagagaccgctggggtccagcaggcctggctgcagaagggaagctctgcgcagtggaaggcaggacccggtggcagccctgggagcaggccccgctggcccctgggagaagacctccatgggcctcagcacgacactcctaggctggcagccgaggcctggttcacgtgatcccttgatttgtgttttctgacctttcttcacagacactctaggaagcctggggacacagagcctgccaggggaagtcacactctcatgaaagagctagccagcaagaaactagaaccgtggacatgtaagataggcacatgcgtggcgagtccgaagcgggaagcaagcagagggtgtgacagaatactgagggggccagggaatggctcttccagaggagacttctgagtgggagacaggagcaggggaaggagcagcatgagctctgggaagaaggcatttttggcagcgagcaatgcaagtgcaaaagccctgaggcatgaaaaacactaaagaatctgtaggaggccaaggtggccaagcaaaaggagaaagagggactccggcaagagatgggcatttctcaggactgcggtggcagggaaaagagagccccctgaaggacattccacattcaaacccctgccctgtggtgaccctgccaggtggctgggtcaggatcttccctgtcaggcccag

SEQ ID NO: 118220 - DNA, 1127 bp, Homo sapiens
actgcctgggtccaattctggcttgtttacttactggacaagtgaccctgggcaagttgcttgctgtttgagcctcagcttcctcctctgtaaaatgggtacaattctgagcttgcatggttgtcatgaggagtgagggatgtaggcacatagagcaggatgaatggggctgatgttacatcgcagtcagagcccacacctcctgcgggcaagataccctgagctatgttgagggagaagtgggaatgaaacccggccagggaatgcccagagttgctgaagagctctggaacaggctctggaaagaggcaggaggaatcaaaagtcagaggctgtgggacacaggaaagtgatcagcttgagatgcctgaaggactgggggggatctcctttcctgcctttctagggcattgtgtgggcaatgtatctgaaccactgtgcactcacccactgacgggggaccccaagtgaggcctaggaatctgcattacaagcaccccatgaattcccatgcatgtggaagtttgcgaaatgccaggctgtagggcggcctaggactctcacaaactgccgaggcaacggaatccacagagagaaagcactgctttaggttatttagcgagctgatggcagaggtggaacagaacctgcctctctgcccagccagggattccataaggtggtgcaaatcaggagaaatagatgacactatttgtggagttcttatgaggtccaggcactacctcagatcttcacatgaactaattcatttaatcctcacaagagccagtgaggaaggggcaattattatccccactccacagatgaggtacctgaggcaaagagagtttaggtggcttgcctgaggtcacacagctcatgagttgttaagttgtgtgtgccagctgcccctggggctgctaactcccccaggagtctcccacctcctgccctgcctcttagctacctcaaaacttcctggagaccctccaacagacctcatggaagggggcagaatatgtatgggagacttctgggagtcagacactgtgctgaacagcttgcattatcatttaatcctcccaggattcctgtgaggcaggaatcagcatcattccatcaccctc

SEQ ID NO: 118221 - DNA, 1067 bp, Homo sapiens
cacaaaaaattagccagatgtggcacacatctgtaatcccagctacttgggaggctgaggtggaaggatcacttgagcctgggaagcagaggttgcagtcaattgagaagagtcactgcactccagcctggttgacagagggagacctcatttcaaaaaaaaaaaaaaaaatggataggtgtcaggtgtcaggtgtcattttcccccagaactggccaggctgggaaggggctgattttgcccaaagggctgtggtgtggctgtgagggaccaatgacaaactttctgttgcggggcagcaacagggttgaagggagagcagtggcctcagagctagaaggcttgggctcaggctccggcagggcctcactcctggcctccgtctcctctgtgaggtgggattcttcatcactgccctcagaggtgtcggggtgggcagcccaagagtgtgcgttctgcagatgcatagactaggttcaaatccccttcaccactttttaattgcgtgacattgggtaatctgcagtggtttccttctctagaaagtgagggtgatggaatgatgctgattcctgcctcacaggaatcctgggaggattaaatgataatgcaagctgttcagcacagtgtctgactcccagaagtctcccatacatattctgcccccttccatgaggtctgttggagggtctccaggaagttttgaggtagctaagaggcagggcaggaggtgggagactcctgggggagttagcagccccaggggcagctggcacacacaacttaacaactcatgagctgtgtgacctcaggcaagccacctaaactctctttgcctcaggtacctcatctgtggagtggggataataattgccccttcctcactggctcttgtgaggattaaatgaattagttcatgtgaagatctgaggtagtgcctggacctcataagaactccacaaatagtgtcatctatttctcctgatttgcaccaccttatggaatccctggctgggcagagaggcaggttctgttccacctctgccatcagctcgctaaataaccta

SEQ ID NO: 118222 - DNA, 1039 bp, Homo sapiens
ggccaccgctaatcccagggcaataatatctccccctcacctttattagtggcttgtggtttatgggatgcctccagtgccagctcatgtttaatcctccccatgatgctgtgaggtagctattctcatgcccattctacagacatggaaactgaggctcagcaaagctaagctccctgccagaggtcacatagcatgtctgcgattgtgcctgggcccaaattcccaggccaggcttcttgaatgctgcatcagttcaagctcatttcaggaacctgaggtttgctacctaaaatcggcctgttggatcttgttcagccacatgaaacagcagatgtgcgcctgttctctgaagagcccatccctgcagcctcaggcactcagcccttccctgcactgccttggccctggggctgagcctgagagagaggaatggaagggcgctttgggtcctgacagagaagcgtgggtaaaagggagacaaaaagggggcagacccctagcatacacacagatgggcacaggcaggcaaaccctacagtctaggaaagtgggtaggggccaggcaaggtggcttacgcctgtaatcccagcactttaggccgaggtgggaggatcacctgaggtcaggagtttgagaccagcccagctaacacggtgaaaccctgtctctactaaaaatacaaaaattagccaggtgtagtggcgagcacctgtattcccagctgcttgggaggctgaggcaagagaattgcttgaacccggcaggcagaggttgcagtgagccgagaccatgccgctgcactccagcctgggcaacaagagtgaaactccatctcaaaaaaaaaaaaaaaaaaagtgggtatgggctggatcagaatcctggatatggctttgatcaaatcatttagtgtctgtgggcctcagttccctcatctggaaaacgtgcattacagtagcaccaccttatagagcagttccaaggactcagtggggaatccttagagtgcatttagcacaatacctggacataatgcct

SEQ ID NO: 118223 - DNA, 4274 bp, Homo sapiens
agcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttga

SEQ ID NO: 118224 - DNA, 1073 bp, Homo sapiens
ggatctcctgagcccaggagttttaagtccagcctgggcaacataacagcaagaccccatctcaaaaaaaaaaaagcatatcttttgtttatttttttaatagacaaagtctcactatgttgcccaggtttatttggaactcctggctttaagtgatcttcctgcctcagcctcccaaagtgttagcattatagatgtgagccacctcgtctgggccagagcatacattttagatttcagattgggtggcgggcagggatagaatatccttgttagttatataaaaataaacttttttttgctttttgcagatttgaaatttaattaagctattaacttcttaatcatcacatcctccaactctgttttaactcccccctccccctcccctttttttttaaggaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccattttagtttgttagtgatggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatggggg

SEQ ID NO: 118225 - DNA, 1550 bp, Homo sapiens
catttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagcttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggtattttaaaactccagaacgtcagaaatgtgtagcagaatgaattctgttataaggaagacaaaacaattcagtctgttttttaatgcagtttaggaatagtgtatacctcctatacttaaaattgtcatttatctttcccaactttaaatactcttttagtttctatagggaaggaagagttattacaggttttttttttttaattattctttaactttagatactgccaatctgatttaaaattctccaagcttaattctgtgcaacaaacagaaccacacaagcagccaggcactgtggctcactcctataatcccagcatttttgaggctagatgggaagatca

SEQ ID NO: 118226 - DNA, 2445 bp, Homo sapiens
aaaaattagctgggtatggtggcaggcgcctgtaatcccagctactcaggaggccgaggcaggagaattgcttgaacctgcgagacggaggttgcagtgagccgagattgcaccactgcactccagcctgggcaacaagagcaaaacatggtctcaaaaaaaaaaagagagaattcaggtaatcttttaaccccagaaaagtgtcttccccaggtaccagtcagacatcttattcccaaacttccagttgaatatttactcttacttgtttttaggaagtacctcctcttatgagtattcccctagataactgacagcttgatttcatgtttcagttttcatgctgcctttttcatctataataagaaatattttagaagctgccacacttgaggaaatattcgttgtgtaaagaaatgctgtcactgtcttaaaaagttagtaggttatataactggactctgttattaaaggattaacataaaatattttatgtgttccaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggttagtagccaagaaccaagtgacgttacagggaaaaaattgaatacaaaattgggtaattcatttctaacagtgttagatcaaggaggtggttttaaaatacataaaaatttggctctgcgttaaaaaaaaaaagacgtccttggaaaatttgactactaactttaaacccaaatgtccttgttcatatatatgtatatgtatttgtatatacatatatgtgtgtatatttatatcatttctcttgggattttgggtcatttttttaacaactgcatcttttttactcattcattaaccccctttccaaaaatttggtgttgggaatataatataatcaatcaatccaaaatcctagacctaacacttgttgatttctaataatgaatttggttagccatattttgactttatttcagactaacaatgttaagattttttattttgcatgttaatgctttagcatttaaaatggaaaattgtgaacatgttgtaatttcaagaggtgagtttggcattacccccaaagtgtctatcttctcagttgcagagcatctcattttctctcttaaatgctcaaataaatgcaaagctcagcacatcttttctagtcacaaaaataattcttttatttgcagtttacgtatgatcttaatttcaaaacgatttctttgtttttggcttgatttttcacaatgttgcaaatatcaggctcccagggtttaatgtggaattgaagtctgcagccaggccttgcaaattgaaggtaactggggcaaatgccattgaaaccgctagtcttatttcctttctacttttctttggcactcttactgcctgtaaggagtagaactgttagggcacactgttgctatacagtttaactcccattttcatgttttgtctttcttttcccatttctggggcttacctcctgatacctgcttactttctggaagtagtgggcaagtaagatttggctcttggtttctaatttttaaatttctgaatactgccctagtctgaacttggcctttatagattaatctttgcttcacatttttagtgttgtatttaaactattttataatttaaaaatagattctaatctgaagatacttttcaagaaatattattaactgatgtcatcctcatcccagcagctcatctgttaggaatgaagttgagatgcttctattccatgtttttgtatttgggaaggattcaaagttgaaggtttattgtcgttgggtttttcagatggtgacatgtaaactcaggatagcaaaccctaatgttcacacagtgctctgcctctgcatctcagttgggatagttgctccttttgagtgttttaatcatcgtataactaatcatagtgccaagaagttcataatgtgttatgtagctaatgtcactgaaaaacagtcctaccattttaggtaagaccaaacagagtctctaacccaaggacttgttacacctgacaacctatagtatatttgctttttctcacaaaatgaaaccaattttgccgaaagctagctgggataataggatcatcacaagttgcagtttctataactaaaattagattgaaatctcttctgacctagaacattttacttcaggcattcagcagatttcagaaagaattaccttattttaagttagtttctttgttagtttactgtgtgtctcttattcaataaacaagcagaatttgtgtcctgccctatccatgtcttaaagatgagaagttggatccactgagttagtttcattggggcggg

SEQ ID NO: 118227 - DNA, 1143 bp, Homo sapiens
caatctgacaaaaccctgtctctactaaaaaatacaaaaaattagctgggcgtggtagctcgtgtctgtagtcccagctactcaggaagctgaggttggaggatcgcttgaagcctgggaggtggaggttgcagtaagctgagattacactactgcactccagcctgggagacagattgagaccctgtctttaaaaaaaaaaaaagttcacgaagaggcgcgactttgataaaatgacaggttttaacaagtgggctatgtaagttatttaagaacatagtactgtataggaaaagcactatatgggaagaacatatgtatttcttctactaatattgtacataatagggtaggtagggtcatgaaattttatttaaatttatgaggagaccaagccatcattttagctctcatatcttcctatgaaatggtaaaatatcccgcccaaaaatatctttttgcttatacttaaatgcatttatttttctatcttgaaatgtttgtttttaactttgttttaacccttgaacctataggggtttcctgcagaatttgcgatgtacttaaactattgtcgtgggctacgctttgaggaagccccagattacatgtatctgaggcagctattccgcattcttttcaggtcagtttttaaggtattttaagattataaactctgtgagggaaattggttaaatttacctaacaaattcattctgataaatactaaagtaaagcagatctagctaacatgaataaaaggtttcagaaactgatttatttgggactaatttggcatttttctatttgtagtgtaaataggtgattttagtttggagtggatagagagttgaatcatactcaaagtagaatgtaacttttccagaatagttataattcatattagatataagtggctgtcagtgccttctggaactctccaactttgtacagtaccaaataaaaagcaattaaaatatcacatagtcatggagtctgatcaagtggtagcagtcctaaactagggtagggttccttaggcacaacccagaactggtcttgaaaaaggggggggaatagattacatgtggctcaaactcttagttggaagagagtaagaattgaggtaatccgcccaggtac

SEQ ID NO: 118228 - DNA, 1049 bp, Homo sapiens
gcttttcagctgggtatgatgatgcacacctgtagtcccagctacttgataggctgaatcaggaggattgcttgaggccaggagttggaggccacagggaattactgctgagcctgtgaatggctactgcactccagcctgggcaacatagtgagaccccatctccttaaaaaaatatatagaaagaaagaaaatgcttttcaattttggccccagccatttttacttaaatctaatatccatatattcctattagactcaccctttccctatagctaaaattaaattcttagagaagaaacttacatcagaagttaacagtttgggaaaaattttttttagatgtattatactttgattttttaaattctgggttaaaatttctcttgaatctcacaggtatatgtttatatgtctagtgcgttaaactaccatggttcttctcagtagcactgagtatatcttttttattttattcttttccacaggctgcaacaaagaaacaaaaatatgaaaagattagtgaaaagaagatgtccacgcctgttgaagttttatgtaaggtaagtatgcatgatgaatattaaaaaaatataaatgaagccaggcacaatggctcacacctgtaatcccagcactttgggaggccaaggcagtaggtcacatgagcccaggagttcaagaccagcctgggcaacatagggaaaccccatttctaccttaatagataaatgatccggctgggcacagtggctcaagcctgcaatcccagcactttagaaggccgaggtgggcggatcacttgagcccagaagttccacaagaccagcctgggcaacatggtgaaataccttatctaccaaaaatacaaaaattagctgggtgcagtgatacacgtctgtggtcccagctactcaggagcctgaggcaggaggatcacttgagcccgggaggctccaattgcagtggtgaatcttggctgtcttgcaaggatctgagattgtgccactgcactccagcctaggtaacagagtaagactctgtctcaa

SEQ ID NO: 118229 - DNA, 1050 bp, Homo sapiens
gaactcctgacctcaagttatccgcctgcctcagcctcccaaagtgctgggattataggcgtgagctaccgcgctcggccattatatctagattttgaaacctcatgtttgtttaccagtagtaacaggtgtacagactatcaggtgtcattatgacagatagcacacttgttgcttctgctgtcaagcatgtatacatttctttctttataaagacaggttcctgagtatgtaatgaaatgggcctgtgaaatctgcaaacgacaaggataaactactagactttttttttttaacttgatttattgatgaagactagtaaaagcttatgggggggtgttaagtctgttcattatctgttctattaatacttaggatactttattttgatatatttgaatgcatagaatagataccatttaatgaataagacgcagtttaattgaacaaggttggaaacctaatgtttctgtatttctcttttaaagttattccttattgattttggtttggccaaaaagtacagagacaacaggacaaggcaacacataccatacagagaagataaaaacctcactggcactgcccgatatgctagcatcaatgcacatcttggtattgagcagaggtaagttcgaaaatggaatgtgcttatcatagccatagcagaagccatcaatgggtttttgaaatattttagtttcttacaatgtctaaggatgtttcttggctgaggatttgaaggatgcttattaatcattttacctgctgctttaaccagtgtagagaagaccgttaaatgaggtcttctggattttttgttgttgttgaaggttgtctcttggggggaaaatactgcgtgatagaaagttagaagcataagtgcaatgttgacgtttctttttgcagctgaagatagtacatatatttttagagctatttggggctttttatactttagtaattcacgctgagtttgggaagaatgcattatttatttttaaaaggaaaatgttatcagtgtcctaataaaccaaaagtgggttgatg

SEQ ID NO: 118230 - DNA, 2256 bp, Homo sapiens
aagaataggctgcattgtttaaaatgggcgcagattttactcataacatgtagttagtaaaaatccacagaaaaggagcttgattcactgaaggaagtgcctgtgtctttgcacataaaagcctatagtaaaaatgcattatcttacgcttatttgatactgacttttcctcatttggttctgcctttacatatttacagctttttggttgtatctttggcatcatgtggtttcatgtaaacatttccattatatgtttatatttattagttttaaacagcaaagcatacagagagagctactaaagaagcttgataggtacccgaaggtaatgaaccaccaatagttttatttccttttttaatttcaagtagttttcctttcagttgtttactgagaataggctatctttgttcagtactaacatttttttcctgatgtattttcagtttttataagaggagaacatttcaaattatttgctctttagatttttgtttttagattgagatgtttaagaagatcgtgtttacatatttgtagtttacttgataaataaggtttcctcctttagcgttgtgggaggaaagaactctccagcgaacactgaatttttataaagcagtcttttggttgtgagaaagtgtctggttattgagtcacaaatgaagctattgaatgtagatttagacatgaatgaaactgttagacatactcatgtcagagctcttcccttttgtccttcattttaaagtaccaaaggaagcaatcctagaaaatgtgaactggaggaaattctatgtactaatcactcttcattcaatgtctacatatttcttagagatattttttaaataccatgaagctgaatgtccttttgtgtttattttccccatgttttcttttcactatgaatctgcagaacttaatcatcacttttgttttgcttaacaaatgtattttgctcattttaatatttgtgtactgatctggttttcatatcaagagaaacttaaagtataagctttatttcttagtgttttacaacacaaattttcctgtaatgacttgattgcttaggaagggagtttaatctttttactttgagagtcttcatcatccagttaacatttactaataatttaatcttcattcttttatagtagactaagtaaaaatcagtatctcgttgacatggtgactgaagctcaactgtcagtgtctttactgtccaaagtataattgagaataggttataatgcttggctgaaatagatgttactcatgctcctaggagaggtactggtcagatctttataacctaaatcagtaacttgctttatttattgacatgaaatctgcaggttaggtgatcaagtttcccagcacatcacaaattataaactggcaaaagggacccagtagtctaatggagagaagaactacaaaatttaggagtaactagagaacaacagactagggctatatagtgtaagggcacatagacctgcctagcttaatatttgtagattaacttttattaaaatatagcataataggtgattttatgacaaaagccaaaattttaagtaaagattatttcttttcatatggtaggtaaatatgaatatgttttggatttctttttcataaaaatagttatttacttataaaaggcttaagttctggagtgtaaacttgaattacatacaacaattagctacattataaatgaataccttattccctgagtaccatatagacatgataacactaaacgttattttgttctaaacactagtttttgtttttagttagctcacttaaactgctaattgtaagccaccttgatttaaatgctaagcgctttttggggggatttttatatcaacttgttaaattttccagaagtttaacctgacccatttgtataatgtcagtgctaagtagtattttttattaataaaaagtcttggtttcattggcaatgtcagacttttagggtagataacaagtattctgttggcacatttaagaatggcctttgtaggagggaagagttcagatagtttatatctggattttttttttttttttaagaaagagttttgctctgtcacccaggctggagtgcagtgacgcggtcttggctcactgcaacctctgcctcccgggttcaagcgattctcctgcctcagcctcttgtgtagctgggactacaggcatgtgccaccatgcccggctatttttgtattt

SEQ ID NO: 118231 - DNA, 3449 bp, Homo sapiens
tgtatttaaaagggtaacttttgggcctgcttcaaaagtagttgacagttttttacttgggtgccaaattgggtgagttctccacccctccctctccctttaaaggaaaatgtagacaagtgaaatgaacattcatacaacaaaactagtgttcatttggggtctctgagagtggttcaacttatggggtgattgggttttagctagtggcgcatgattgcagttagaaactaattgtgttgactttttttctgtaatgattagtcttactgagtgaattgctttctttatcgatactatgttgagctcgggcagacaggcagcattggcaatgcactaagcatgttgtgatctgatgatctatctgatagaaattctcaacttcaggacaacttgggggctttttttgtttttttgtggcttttttgttttgtttttggaaggaagatgcccatttgttttactaaactattaggaaatgtttggtgtttttaggtctagctataaatgtttacctttgtttgcctgtatgaatgccaactgggagacattaccattagaattggtgttatttgtcaatgtgagatactgatgttggtctgattaggttttaggaaattaaatttttttgttgagctttaaataatgaaaggtgtttaaatatacacataacttatcttgtcattcccaagttgcattaaaaaatattttatagcttttctctgaagtatccaggtttttattactgtaaagcctggtaattcaattgaaaaaaaaattactgttcttaagttttggggcagttttgtccatttgactccaatcttcttggccatttcccagccctctccttcctgttttcttaccccctaaaaacccattatcaccatgtgattcctattctgcatcgttgacattgcagtacgtggtttttgccttaaatttaaatgatgacctagatatcactttgccttccccccctcccccacaacccccttaagaatagcttgttaatcgcatagttgtcttaaggaagtgtaagttatctagtggtgaaaacctttttaggaggtttaggtctccttttctccttgagatattaaaaataattttgtggagctgcttgctgcttaacactgttttagagaggccatggggaagaagcaaagtgttttactcaactaagattcaaatgctaaatgttgctcttgaacattttagattagtgttttgtttatgtagttgatttttagtgttttctgtattgtagtttgaaaaatgccagttgtatgagactggattctttggtcagcttgttccagtagttttctattcatggggaaaaaaaggttttggggggcttttgaggacaatttttaaagttaaatttcttatttggaaaattgttctgaatttgatatttaggagtggccactccaatcttagtgaatttgctcatctcttccagtaatcagccctgcatgcttacgaaaataaattttaaggtgactaaatgccttctacctcttccttactgaagatttttttcccccgtacaatatttttttgggggggaagggcagattgtggtaccaaagattgcagatctaaattccccatttttgattaaaaatataaaagagccaaatgtcaccattgctatccctgtttcaggcagtgacacaaaatagtggcattaaaaacctgagtaatttccagaattcaaatgttcttgagcatgtgattcttatttggaaaactgagaagctacagtgcttggtggaagaaggatggcatttggctaccctgttctttctctaatgcctcggtgttgcctgtctgcgccggccattgttgcaatgtaagcaatactgtttgatgcactgccaccctctattgtctgtttagtgtttagaatctccagtggggaagaggaaaagaagcatgactgttagtacttctcaggacccatctttctcaggattaaaccaggtctgaaactgtctcctattccaacctcaatcccaaattcatgtgcttttcttttttattgttttattttgatgatttttgttttgttttaattctggagaatgtagatcttgctcaagcacctcttacgttggcattattcagacatacttggcaaacataacattactaagatatttctttgtggcttttgcttaaaacttataaagtttagaaaaaagctaaatgaaaataggatattatgtttagctctctaacatacatatgaggaaatgatgttggtctagtactgaaattgtttacctaatagtaaacttgagatagatcgttagtttttaaaaatttatttggagttacacaacttaatgcacgaaatatatttaaattcagttcattagtgctgtataatgaatatattctacctcacctctcttccccttccctaaggaacttcaggtaagtgtagatcagatttcagatctagtgtttctagaacttatttcctcagtctgtattctcaacttctagcaaatggatatttacagagcattataggctctggaactagaagatactgcattcttaacaatataacaataacatagcttaagcacttatcaagttatatggtagattaccattagtaatacattgaaatatattaaatttagtttttggcaggctggataaacaccctactaattttctaaatttgtaagtagaactcttcatattttgttacacttttgttgaagttaaatagcttttttatcacaaaatttaagttcataaatgttcatgctcctgagcaaatgaatcttaatcattcagtttagtatacagtgaagaggaagtattggcatgaataatcaaaaaacaaaaaacatgctttgtaataccttaaattatccacatgtatcatctggataatcatttaacccttttccatactgcccagctttattccaggaaccacctccagctattaaaaaaggtttcagaaattcagagttatttttattcaggcaaagaagtaccaagtattgtgactagttagataaggggtggggggaagacagtagatggtggatcattaggcatattataagaataaaactagttttatagtgcctcatttttacttacccattcacatattttgcttacatttcgtagcatcatttaataatttacaaagaaagttgtattacattgtttagattttgtacatacaggttagctaggtttttagtaaagtgaccttgtgaatgttttagaagggcaagggaaattatgacccctggttaggaaaaaaaaaaaaatgctgcaagtactaaacactaagattagccacagtgattttgaagaaaatgtgcctctattgaatggaattatggaattatccccctactttttttggtttttggttttattttttgttttttttggggggtttt

SEQ ID NO: 118232 - DNA, 1093 bp, Homo sapiens
ctacttatagcttaatctgccaatctgtcaacatcctccactcccaagtatatgtgtatctgtttgtgtgcatatgtatatcttataacatggaattaggtctgggtaatacaaggccattttaacaggttactttagaaggcctaggattgagtgtggaaagtttttattttatttcctttattgtagcaactgaaactattatacaggtattccttttattatttgaaaatcacaaacaccaagtcttcctatggggttagaccctgccatggttttaattattaatactagaaggtaaagccaaaggacacagcaggtatatgcttagatatccattaacctagaaataaatggagaacttagttgtcctttccatttcattttctttagcgctgtctttgtgaactctaaataattgagatactgaaatacttaagaaatgtgttgattttcatttactacttaactcaattatctctcccttcttttttttccagatgatcagtagaattgaatatgtgcatacaaagaattttatacacagagacattaaaccagataacttcctaatgggtattgggcgtcactgtaataaggttagtcaaatgctctttgcatgaaagaacaaagagtaaagtttcgacaagaattgctttggtaaacttttcaatcttttaaaaagccatagtaagttgaatttgctgttgacagttgctttaaaagattgtgctatgaggataatcagctaactccattaacttagtaacttgaaataaattatcttcaacttacccaaccgaggttagttacctatatggaaatataaaattctaagggctgtataatgaactgtagttgtctaagttatttaactgttgaacagttgtatctatttttcattcacaaaaatagcaaaaacccccatattcttttcttcctgaatgcttaaaaccagattttaacctttggctctgaagtgtgggtttttataatatatgtgcttgtgccagtgtgggaacactgacttatctgtcaccatggtgttaacatttgctgactgagcatggttgataatgagaattcttcagtc

SEQ ID NO: 118233 - DNA, 1004 bp, Homo sapiens
atagagtcatcttcatttcttcagttacaaagtaaattcaggtgagattaaggaatttggtaaaggccataggaatcagtggccagtgggtataaaattcagctgccctggtaacaggagtgttaaggctactatgcatgtcctatctatataggagaatggagttgcatgacagggaaaaaaaaaagtctcattacccttgttttgtctttgggccttgtagttaattagtgggtttgtcttctgagtaggggaacattcgccttatataatacctagtcagtgaaagaaaactatattattcttagggttgatgatattaagtaatagctttttgtaatatcctctcttctccttttgtttcgttaggtggtatggtcaggaaaaagactacaatgtactagtcatggatcttctgggacctagcctcgaagacctcttcaatttctgttcaagaaggttcacaatgaaaactgtacttatgttagctgaccaggtatgtgaaattttgattagaatataaactgagactagtactgttgactggaatttcattattcataaatcagagtattaaaatcctgtgcatcactatttaaccttagcataggcagaaaaaaaataataatgtgacttgtagatattttcctatgggaataagacaaaacctggaattatcttggtttcttactcatctgtagactagtagttttcaatctgctccttcagatgaagttttagtgtcatatgtagcaggttattgtaagattttgtttggagagtttagagtgtatgtatgcatataattgttgataaatgtttattgacattttggttaaattaagcaaaattgaatattatgtattatgtgtgggactcttagaaaagctatatttttgaggataaaaaggtcctgaagtaatataaggaagaattttttgaccaagtagatgctgcttggagtaatggattctcaaccatttgtgttacttaagacctaggaa

SEQ ID NO: 118234 - DNA, 1013 bp, Homo sapiens
tgtctggcacttttcacttaacataatgtttttgagattcatctatgttgggagattttataaatttcacaaatcaggttaaatttaatgtatttgaaatcagtttcaaaaagcattaagcattgtcatttttcagtgctaaacccaagtacagtacatgtccttttatctggtagcttttatttaagacctgatacagacccataagggcaatgagtaatgtactgaataagcacatgaataaattaacttctgagcagaattatagtaataggtgcctattataaggtggtgagtgcagagagagttatggtagttataagctgtctgtgggtgaggctaaacagattaacctgactttcaagttaaggcttcctgagagatgggatttcaggatctggctctaaggaagaaagcttggtgaactggtttggtaaggcatccaagaatagagtgtggcttctgggtgtagtctctaaaggagaacacagtaattggatgagagtgtggaaagggtaaatttgctttaggagtggtagggtcaggtacatggaaacaaaagtggttcattggttttaaagtgaaatgtaaaaaaaaaactgtttccactgaagcaaaaaggataaagatttatgtaaacattctttatttgggtagcagcatcttcccatccccctcagtttgttccccactatttctgtatcacctatacatggtacatacttaataaatatttactcggaaagtattgaattaagttgactatttagtgttagctagataaaagttatgtgttatctattgttttagaagtattgtcactaatttaaaaaatttagattttgctgcctttatccttcatatacaaatttgttcaatcccttccctatgttttctgttacaaaattccctataggatttgctttttttttttttgacatggagtctcactctgttaccaggctggagtgcagtggtacagtcttggctcactgcagcctccacctcctggg

SEQ ID NO: 118235 - DNA, 1543 bp, Homo sapiens
aggcgacagcctctttccaaacagaaactgggttggaataggccggtccgggggaacggccagaagaaagatcaaaggttaaaaaccgcctcaaagagcacaggtcaatacccaactcctaaggaggccttaagctttcatctgccacgaaacatgaaggtgactcctcccaatatcaaggccggggggccactcagccttccagagacccggcgggtccgaggcgagtaacaggtaacacctgctgagccgccgccgaccggaagtggaagagagcccgggacgggggtgaggacaggccgcggcacgcctgcgcagtcagcaggagttgcagcgctcatgcgcagctgggcggtgacagggtgacgctcggagcgtgggccgcgactctcacggatccggttccgccctctcgctgccgatccttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggtaatcatctggggtggggttcacgataacgctgcgcttttactcattccccccaccaccaccgtgcacccccaaagtgctcgggcctctcctcatcgcacgcactcgccagggagtccagggagctagttttcctggcttacgaacctcgtccgctgtctccctaaaagggtcaagaacccgatagaaaggttgggggaactagtttcccaccttgttaaacacgtcccataaatgtcccttagtcgagctttttttttttttaaccgtcttttaaggtggaaacggcaaaatcctctttcagtgattcccatgtttttttttttttaattcttaattctactgggcctcttgttccaattagaacagtttccgatcgcctagttccttaaaaacctctcactacgttcagaggttgcctcttttttctggatgaatcattttcctgcactttagaggacgtacggatttcgtcactaccccctgaagaggc

SEQ ID NO: 118236 - DNA, 1041 bp, Homo sapiens
tcgcgggggctggtttggtacctggagtgggagcgccggtgccggcccgttttgcataacagtggaagggagggggaaggcggagattgggggagggaggtgggaggagagagagggaaactttgcttcttgttataatctgcctgtctttgggcggcagcagctgtcatgggaccgggtgggcggggagaggcttgcaagctgactccttgcggtgaaacgcgacttggaagggacgccgcagccgagacgttcagctccgggcagcgacttcgggctggcggctgggacggcgtggcgtggcagggtgtcgccgagaggaagcccgccacgcgggaggcaggccgcccctggcccgctgcagacgccgctgcgtaggggagccgcggggccgcgtggtcggtggcgggcgcgctcgggtgggttcgcggcagaggccggaggggctagtggcgtgtgattgcgcttctcgagatcgaggggaatgtgtgatgagcgggttgcgcgcgcgggtgtgtgtgtgtgtgtgtgtgtgtgtgtgtgtgcacacgccgcgcgcgccgggcgcgtacctttacctctgacgaaactgcggtggagctcccgccgtcgtcgccgggctccgtcacacgccccgcgccggtgtctgcgccgaaggcaggtcccagcctcagtacccccagagccgacagcttggggctagcgggcactgagtgcgggaggaggggcagagtcactcctgggaagattctgtccccagatctcgaaattgccctggggcgtctccgaatctcttggctgaaaagcggatgagagaggcctgaaatagccggagactcgttcagggacccatgtcaagaactgtccgctttggactgtaccccggattttaactcgatcttcagtgtttggctcagcaataattaattattttgccctttagccgcccagcgagcctagctagcagaaatatttcaactaaggaaactagaaaattgaatactcaggtgtttgcaggagcagtgcagtgaaagttaatct

SEQ ID NO: 118237 - DNA, 1024 bp, Homo sapiens
tgcaaccccctctcctcccccaaactttccctgaccctcccctccttcatctccctttgggagctttggggaaagtggattaaatggtaattcattgtctttgtcccaaaagattgttgttgtctttggtggctaatccagggttagattagagggaggacttctgtttaggagacttaacttttacccattggggccaaagtacggaaatttagcagaacaaggattgcgaaagtttcttggaaagctttgaggcatggatcccaaaggactgtgggtggcttcacctttgttcaggctatgcccctggcccagagtaccctcactcacccgtcctgcatggccttctcctctactaggctctcccagcccagcttgccctgctttctctcctttggttttctgcatctgtgtgatacaaccaagcactttgtgtgagtctggtgtccagtaagattctagcactagggttgtaccttttatcattgtgcctgcaaggcacctgtcagtatgctgagctgtgttcctttgcttagctcttggctaggcacatggattacagacaggggtgcagctgggtcctgccaagcagaagctcccaggctagcaggggagacagctgggcagcgagtgtgggagagaggaatgcagagggctgcagctgtgggcaaaattttagaccccaaaggccacacagcaagtccacactaaatatgggctatttgaagttgcttagggcatcagtcatagatgcacaaaatgtcagagttggcagcgggaatgttagaaatcatcagttctaacaacttatttaaaaatatttaattatagaattgttagaaaatactgccaagcataaagaaaaaaatgagaaatatgtaacatgacccaaagataaccacttaattgtcatgtatattccagactgtttatttcctgttcatatagatcacatcttatttttaaaaaatggagtcgccgggcacggtggctcacccctgtaatcctagcactttgggaggcc

SEQ ID NO: 118238 - DNA, 1419 bp, Homo sapiens
ttcttccatttgcccttagcccagatggcagatcagtcctcttagagtgcatatctgacatcactctcttgctcacacatctcccatggctcctcagtacatttttttttcttttaagactttatttttttagaacaatttcaggttcacagcaaaattgaaaggaaggtacagagatttgccatatacccttgcccccaacatgcatagcctcccccattattaatattccccaccagagttgtagatttgttataattgatgaacctacattgacacatcattgccaccccagagtctgtagtttacattagggttcactccgtgggtttggacaaatctgtaatgacaggtatctaccatggtaacatcacacagaatagtctcactgccctggaaatctgctctaccttttcatttcttctgtcccccaactcctgacaaccactgatctttttaccgtttgtacagttttgccttttccagaatgtcatatagttggaatcacgcagtatgtagtgttttcagattggcttttttttcacttgctgataggaatttaaggttcctccatgactttcatggcttgatagcttagctctccggtattttaaaattaaagcctaaacttaaacctgatttccgaaggccttcgggtacttttaagttggagagttaggcccttgactttgtcttgagctgtctgcttttactttgggatcctgtacctccccaggaaaaccctgaattttcctcctggaggcttagactcaggctgcccttttctgtgtcttccttctccatttccatgattcatcctgcgagcccctgctcaccagccactgttttggcgatgccctctccctcacctccaagccagctgttccatcttctgtgtggcagtacgcagggccagcagagcactgaccttggaatccccttactgggtttgagtcttggttctgcgatttgccagcttcgaggcctttggcgggtcacataacctttctgagcttctgtttcctgaagtgagaagatatgatgattaagattgttgtgaagaggccgggcacagtggcttacgcctgtaatcccagcgctttgggaggctgaggtgggtggatcacctgaggtcaggagttcgagaccagcctggccaacatgatgaaaccgcgtctctactaaaaatacaaaaattagccgggcatggtggcgcatgcctgtattcccagctacttgggaggctgaggcaggagaatcacttgaactggggaggtgaaggttgcagtgagccaggatcacactactacactccagcttgggtgacagagtgagactctgtctcaaaaaaaagattgttgtgaagagtcagtgaaaatcgaatgacaacatggatttaaagcatgtaacacatgcctg

SEQ ID NO: 118239 - DNA, 1113 bp, Homo sapiens
ggaggcacacgagaacagtgaagaacagagctctgagtcagcctgagtccagggtctgtcagttagctgctgacttagggcatggtacttattctgcctgggccttagtttcctcacctgtgaaatggggtgaagagatatagatatagatatagatatagatatagatatatctatatatatatatctcagtgggtagttgagttgagaagatgagaaggtacaatgtctgaagagcttagtgcagtgtgtctgggtgttatgatcaataataatgacaattaccagtgaccagatggtttggtgacagtttagtggaggaagccgtgcagcagtcactccttgtgcacgggaaaccagttgcagatttgagcaagccttgctccctgccctggatgaacagatctgctgatggccatggaaggtgcccagggcagagtgtcaagacaacttttgcagcagaaagggtattgaaggatgagcaggagctggccaacatgatgggaggggcctcctagccagggaccaggctgtcgtgatggctagcatatcatgtggctgatgactgagcaatgagtggctaggtgagaggcttgaggggaggctctgagctgactggaggactccccatgggggtgaggaacagacagcatgaacgaaatgtctggaagaatccaaagatggaacaccaagattctcgtccgagaaactagctggaggctgctctgcagaaggggaaaggccttggggaggtttcagaaggagagtgactttgagggtgactagttcttccctgggcctcacaggcagcatgggatgaatggtatcaccctgtggactgcaccgctcctccccaggccctaggagtgagtgggggacatgcagggatttgtgttaaggattgacacaaaggctggggtacagcttctcatatgtagtcctgactcaagtccctggctcaatacagcaggaatcggtggggccaggcaccacagaaccactaggtacagccctcaataaatttaatgatgcagatgatacttagtgccatcataatgattattactcctatttaccgttatacctgttagtgtgtcactgcgaaattcacac

SEQ ID NO: 118240 - DNA, 1039 bp, Homo sapiens
gggaggccgaggtgggtggatcacctgaagtcaggagttcaagaccagcctggctaacatggtgaaaccctgtctccactaaaaatacaaaaattagccaggcgtggtggcaggtgcctgtaatcccagctacttgggtggctgaggcaggagaatcgcttgaacccgggagacggaggttgcagtgagccaagatcgtaccattgcactccagcctgggtgacagagtgagactccatcttgatcacttgaagtcaggagtcaagatgaaaacataaacaaacaaacaaaaacattatgcatgttacaaatggcagtcatcccttgcactcacattcttgtgtttccatccccagagcaaccctctactaatttctaatgtgttcttccagaggtaaaccatacaaacatcgcatatatgtggtctaacttgctgcctcctgggtttttattttttgttttttgcacaaatggtagcaaactaagggcattgttgtgcaactttttttctacttagtatttcttaaagatcatttcgtatcaatatgtagagatctgcttcactgtttggattgatcatagtttgtttaactagttgggcatttaagtgattgctatttattttattttatttcgttgagacagagtctcgctctgttgcccaggctggagtgcagtggcgtgatctcggctcacagcaacctctgcctcccgggttcaagcgattctcctgcctcagcctcctgagtagctgtgattacaggcatgtgccaccacacccagctaattttttatatttttggtagaggcagggtttcaccatgttggccatgctggtctcaaactcctgacctcaagtgatcctcccacctcggcctcccaaaatgctgggattactaaaggcatgagccactgtgcctggcctatttatttatttatttttagttaaaaaaattttttttaacctacctcttacacagaaataggttatttctaattgactactgctgctagtttgcagtaagttttgcacacatgt

SEQ ID NO: 118241 - DNA, 1034 bp, Homo sapiens
taattaaagacttggccattagtttcatacattcccaataacggtggttcatataatcatatcttttcctgctttgttttttaactataaaatgaaaggctagttttagaattttattacaaaagaattaaatctttgttgaagaaaattaaagaactgcagatataccctttcaaaggaaataaaaaccacccataattatttaaaagtgactattatttcttttttcacatatttatttttcctttaaaaaagtcagatcatattgtctttatgactttttcatttagcattatattgaagaatctatctttattaaggccttatagatcttcattaaggtttaaagaaggttttttccatggccttaaattggttcacctcctcatttgatgacagtaggattcctcatggatgtagcttgagattctgttttgtggtttgcacttctctcttcttgagagccagttatgttttactcatgacctcaggcaagtaattgacttgtttgcctctttatttatttgtacaggaggaaaataactgcacttctcttggagtggatgggaggggtgaacaagcagaggggcctagtactggtgaaagctgtagcaacagtggccaccgtggagcaggaggggcaggagaggtactaccatttcccatttggtacccagaagccagacactgagggttaagttacctgtcttcagcagctgttgacccaagttggacttgggcagcatacaaatgagagttagcctgagccctgggctggggtgggttggttcattgcaaagatggagctcctccggctccttccctcatcctcacaaaccagaggaagtgtatttggttgaaaatgacccacatccttcaccaggcatgctgccagcagcagcatggggcagctgcaaggctgctgcttgggagttggtgaatggcctggctgccaagagccccctgggccaggggccacccacacccaccctggatattgaggctcagagaggcagtgctatttgcctaagtca

SEQ ID NO: 118242 - DNA, 1147 bp, Homo sapiens
attgaggtaaacttgacaaataaaaactgtgttatttaacgtacataatgtgatgatttgatgtatgtatatactgtgaaaagatgaccacaatcaagctaattaacatatccaacacctcacacagttatctttgtgtgtgtgtgcttgtgtgtatgtgtctgtgtgtgtggtgagaacgtttaagatctactctcttagtcaatttcaagtatacaatatagtgtttagtcacatcgctgtagtgtagatctccaggatttattcatcctgcatgactgaaactttgtactatctgacaaacacctccccatttcctctgtccttcagcccctggtcaccagcattctaccttgtgcttttcccacttctgggtatgtatccaaaggaaatgaaatcaagatctcagagagatctgcactctcacgttcattgcagcattatttacaacagccaagatatggaaacaacctaagtgtttgttgacagatgaatggataaagaaaatgtggtatgtacatataacagaatattatgcaaccttaagaaaggaagggaattctgtcatttgtgtagcatggatgaacctggaggacattatgccaagtgaaatgagccagatgcagaaagacaaatgctgcgtgatgttactcttgtagaatgtagaaaagactgtgacttattaacttgacaggcaataggtcctgctcttgtcagcctcctcatccatagcaggggagcactgtgttatcccgtggacatgtggataacagtagtgccaacctgattgtggtactgtgagggtaaaataatatatgtttaaagagcctgacagagtgcctgtcaccatgagcgctcaagtttttgctcttgggatttggatatctgcctatcctttgctgttccctcctcagggaaactgtcatcctcttctctggccagaccctggttcttcttgggttctcctggggacctgtgtgagatgatgggataagtgcaagggcagtgacaagcagggaggcaggtgggtgacttgggtcaggaatcccatgggtttttttttttttttttgagatggagtctgtctcctgggcaggagtgcaggggtgcaatctcggctcactgcaacctctgcctcctaggctta

SEQ ID NO: 118243 - DNA, 1068 bp, Homo sapiens
agcaaagaaggtacttgtcctgggtccccctttcagctctgacctgaattccctttggggagaggccatggtgacatgggcatcagagccccagcggaaagtccaggggtggcaccttgcagcagccatgaggcagagagcctgtggagtcccctgttcccccctagtgaggggacaccgtcgtagagaagtttacagaatgggtgtcggggcctgagttaaagttagtgttgctgctactgactgtgtgcactgggctccggtttcctcacctgcacagcagggctaaaaatctggcatagccctgggtgctgtgaggttgccatgagatgctacaggtaaggcatatagcatttagcagtgagccgggcatatagcagcggatcagtagaggtctgcggcgctggtaatccttctggcttctggtcccacgatgaccggcctgaccacaataatcacatccgagcattagcggggattgggatgatctctaggactcccagctttgacattcattcatttgttcattcattcatctagcatgcaggccacacctcttaggagtttgtctctatttagggtgccagggctttagggacctgtaatgactaggtccctgccccatgtgtgacctggcagctgggcaggcctgaacctcaccccctctccctcctgcctctggccctatactgacttgcagaactccatttgtagctggatcctcaggccttctcagaagatgacagattctccaggatccactcatgggagtcatggagaccaggctgctgctttgggagttgagagcattttgtctagtggttgggttctatccctactcgcgcttcccaggatctagatgggctcatctgggactcagtggagcagcatgtccccacagccagagagccgggcgagctgcagccacagcaggcaggggaaactggttccacaattccacctagaattgcttcccccttctccctttggtgggctgtgttcattggcagctgagggttgtgtaggggtggagtagggcagctccctactgtggaggcctcctgccag

SEQ ID NO: 118244 - DNA, 1053 bp, Homo sapiens
gctcagtaacaaatacaatgggcactttgcgtctgggggaggggctgcctcttctgccctcaaggccaagttttgaaacccccatcttcacaaagtgttgctggaccacttcaggcaccactgcaacatccatgccttcaggaggtttttattgaacatctactgtatagcacacactaaggatacaacagtgaaaagaccagcaggccactgcatccctggagctctctagagagagagaaacaaggagacaaatcagataaaaagcaacatgctctgggaagtccagggagggaggaaataatgggagtcagctggagggggcaacagggaagcctgttccaggagtgacttttgagactacctggcaaaaaagagaatttgaaaaggtctggaggggttccaagaggaggccacaggtgtgctggggaggaagatgtgagaggcctccggaggtggcaaggttagggcatgcctgtgccttcccacgacactgtgtgctggggttgcccaggatgtatccgggatgcagggagaggcttagtgctccatgattgagaaaggagtagatggagccccttcccagccccttcccctggccttggtctgcacaagatctctcctgtttgctggtgtcattttcatttcctaataccctctggctggcagcaagtgattgactgtgtcctcagcccaagatgctgaaaggaggtctgagtgaaagggctttccacctaggggagtgtaaggagagaaagctgggatgaattcctaggcccacaggtacaaagcctgtttctgctgcagggtctgggagctgggagacagacgggagcagagccgtgtgtgattggagcatcgaaaacccacacacccagagcacaggctccagcgcaggatgagcagccagagccccgtgtgaccacctggccccaggcctggccggttcagattctcatccttactggtcaccagctctcagtgtgtgacccacgttggctctcctgaccttgaattgggtgcaggatttcaaatcaagccttaactaatgtt

SEQ ID NO: 118245 - DNA, 1513 bp, Homo sapiens
tatatgatctgcaagctcaaaaaaaagtttcctccaggaagtagagtgaaggatgaataggagataagtaggcaaagcctttatgtgtgggaagcgtgttccgggagagggaacagcatgcgcagaggctatgtcaggggacagatcctgtcaagtgccaggggtggaaagaagccagcaggactcagagtggcagtagggagtgggtgctggtgtgaaatgatgtgggacagggaggcaggagacacaccgtgcaggaccttacaggccacagaaagagtttcagtctttacctgggaggaatcagagggagccagtggggtcaggtctgtgtcttgagaagatagctgtggctgctctgtgtctagccgcctggtgggggctggagtagaggcaggaggctatggctgccattgacgtgtgagttggtggtgtgaactgggtctgtctcagagcatgaagggttaactcagtgactgggtgtgaggaagctacaggaaggcccagcaacccagagaggctgcagctgtagttgcttaaggactcttgtgtagtaatctcactgatggccattgtcttttgagtatctactttgcactagacactatgtgaagcccttctcgttaatcctcataagaaccctaagcaggtgggtgtaccctattttactgagacccggagaagttaaatcatttggccaagattacacagctcagcaccgccccgtccctgacccccgagctcctctggttgacggtcctctggataagtgttctccagttcactttgacccttctcaggacttggcccaaggccccagcttctgtctggttgctccagtgaccctcagtgtagtgtctgccctgacctcaggaaccagttcagagctggtctggaagagcattgtcctacacggtctgaaaggacacagccatgtggccctcgctcctccgtccctcctggcttgctggcttctggcagcactcaatttgcgacgtgagctgaaccggttgtgtctctgggctttgcatgttgcctgcctcccgggattcagatggtctctgctgcttgtttttatttttcttcttgacttcctctcctctcctcctttccctctgctcccaccctgtccccatctgttgtggccccatgggggtcttttcctcccctcccagatgtgcaggcaggatttgggatggaggcagaagcctccttccttctggcttctcgagaaggaaggaagctaacagtttggacagctgttacctgccgggctctgggctaggcttttggcatacgtgatcacacagagccctcatgacacttctgtgaggcatacacagctttatctctacagatggggcagctggggctgggaggactcaggtgttgcatccatggtcacatgataaggatctgactcgatttaaaatttttggcttcccaaacttaaatgtgcctatgaatcacctgagtattttgttaaaatgcagattctgattcaggaggtctg

SEQ ID NO: 118246 - DNA, 1378 bp, Homo sapiens
cagggccaacagaacatcaccaagccattctgtttctgtgtcagccccccaactcaggctatttctgaatctgtagggcagttcttctattggtaaccattaaactggggagaccagggtgagaaattgattggcttctgattcagtagctctgggtttaggcctgagaatttatattatttccaacataccaggtttccaggtgattctggtgctgcccgtctgggactacactttgagaaccactgattcaggcaatgctgttatcagagtcacctgtggctcccttctcccctactcactgctgttaggtgggtttatgaccgtctagatcttttcctgtgtgtttgcatacatgctatcctacatagagaaatatatggcttgatttttactttctttacacatgtggggttatattttacatgctggtattctacaacttttttatttaatgtgtcttggagaacacacagatcttcctcattcttttcaacagcactgtagtatttcatgatatgggtgtttgtttgtttgtttgtttttgtttttttttgtttgtttttcgtttttttgagacagtttccatctgtcacccaggctggagtgcagtggctcgatctcagctcactgcaacgtccgcctcccgggctcaagtgattctcatgcctcagtctcccaagttactgagattacaggcatgcgccaccacccctggctaatttgtgtatttttagtaaagacgggctttcgccatgttggccaggctggtcttgaacccctgacctcgaatgatccgcccaccttggcctctcaaattgttgggattacaggcatgagccaccatgcccggcccgtgatacgggtgttttatggctttatttacatattgtctattgattggtgttccatcatatatcatatatgtaattttatgttcatcatatatgttccatcgtatattacatcatatatgtaattttagacattacatatattcctataaaattcctgggaacatgaatgggtgtttctccagaacctagcagtcacacaatactgtcagtcattattattgctgttttttgtttcattattaatatagaggcattgttagctttaagaagtccacttataagtggggacatatgtgtaaaggattagctcctctatttacagtctttaataaagttttcaacaaaacagttctggtaacaggaggacagagatgtatgtgggcagggccttgagggatatgtaggagtgcagaggggagagcagcagggggttttgtactgctggggcctagcttagctaccagaagattcaaccaaggggtgaagctgatctttccatttcttggtcatttggcaaaatc

SEQ ID NO: 118247 - DNA, 1116 bp, Homo sapiens
ggggaatcttatttttctgtgtcttcttttcagactctcccaggtgcctcatgctggccttgtcacaaaggtagatttttagaaattattggtgtattgttccatgagattttgtcttgttggatgtgtgtgttggtggtgatgggggattcatcagcgcccacccctggccccggccccacaccctgtgccctgattgtcatctgggaccctcaggagctgggctcctttagaagggagttggtgtttagaaactgacttttgcaggccagaggaaaggcctcaggccatttcataacctgtcctcttgggggccctgaaaagagttcttttctgacagtgccctgtggctttcagcaagtccgttcctccttctgggcctcggttgctccctctataaaataaggaggctgacaacacttgtcctctatttaccctccagtgaaccttgcctgtgtctcctaaaagagctgtgcagcttgaattcctctaacagccgggatggggtttcccccagagcgaatgcatctcaggctccatttccatgggcagtggaaccagggcctgtcacagcactccctgcgaccctttcatgggcggggaggtggatgcctgctgctgacttgcttctttcctttctgtcctccctgcctccaccagcgacccaacttttggcaagaagagctttgagcagaccttgacagtggagctctgtggcacagcaggtgagccagggggcttccactggcaggtgccttcaggaaaacacccgtgcatctctgagtttttcatcatgcatgggcaaggtgccacgcaatgaacgatgcgcaagatgcctgccttcacggggcttatgttataggcagtcaaaaagcaaacagaaaaggaagatcattacaaattgcaataggtaccataaagaagactcactgggaatgaaccagcattacaggcgtgagccaccgcacccagcccaggtgggcagttttatctgcggtgcctgccccctctccgtcatgggaaacaccagaggcatatgagaggtatagttgggagggtttgttgaacgattggacgtagatcaggaagaggtatttggatgactgggaggttcca

SEQ ID NO: 118248 - DNA, 1052 bp, Homo sapiens
aaaaaacacacaggatctttaaaaaagagtcttggacgtactaccaatattagacattaaagaggaagaagggtccgggcatggtggctcacgcctgtaatcccaacactttgggacagattacttgaggctaggagtttgagaccaacccggccaacatggtgaaaccccgtctctactaaaaatacaaaaaattacccgggcgtggtggcacatgcctgtaatctcagctactcaggaggctgaggcataagaatcgcttgaacccggaaggcagaggctacagtgagctgggattgcgaccactgcattccagcctgggtgacagagcgagactctgtctcaaaaaacaaataaatagataaagaggcagaagggttcaaacttggccctggttcagagaggtgtcaggaaacatgattcacgtaaatgtttattaggcacccactatttgtaatcctgtcctaatagttggtgaatgccactttgtctctgccttgaggagtttacatagcagatgatatgtcagtcgggactctttctgttgttcatggaagtgaaaagttggaatagaattgacttttggtccttctcgggcagacttttctcctggttgcagagtggctgcctgtagctttaagctaccccccagcagcttagagacccctgagaaggtaggagtcactacatgactccagcaaagacctgagatggattctttggggttcagccttaagtaaacaggcttatccttgaacaaaccatggtgtccaggaagggccattgtcacgtggcttgccctggcaccctgagcctggttgaccacacatgctgttgtcagaggaaggggagtggaagctgaacaggcaggcatcatagatgtctaccatgaagggcaagatgcgtgcagaagaccagccctactaggggaggtgaaggccaagatggcagccaaggaattggtgactgaggctggctttgaaggaggcagaaagtggtacagtagtataggcaggggaatggcatggcaatggcaaatccagggaaatggg

SEQ ID NO: 118249 - DNA, 2068 bp, Homo sapiens
ggtggccgctaggctggtctgcaggaaagcgcggcctgccgtttccgggccgtatctgccaagccctgccttgtctcttactgagcaagtttggctcaaattataggagcccccatcttgtgcccagctcatgctccaagtgtgtgtctatccatttgtactcagactcttgagtaccttgtaaggaaggcggggcaagctgcatcattcctgttttccaggggaggctggcagctcctcaagaggcgaaatgactgtgggaggtccggttaccagtgaggaggcagagcggtgacccagaccaggccttctggttcttggtcccgtgcttccgtagtagctggggtaaagacaccgtttcagggactggtagaggtgagttcggctaaattgggcaccgggctagaagcctaagggctcattttaggggttacattaggtgttgattcaccagcatcaggtgaattcaagccctggcatgtgtcttggatgcaccatcagctttgatcctgagtggtcctgcggtttgtctgtgcctgtggacacactgtcagaacttcagtgacacccctggcagcggtacagacaggtggtctgggagcagtcatcttttttgggccagccaccagcccatcctactccctcaggtagtccttcgtctttaccttgtccttgtctgtaaagttgttttggtggctggggcaggggagccaggaggagggagtgaaggttgggaatagataggacaatctcctagctctcctccaattgagaaaacactccaattgggctttgctttaaactttgtgttcttaagtgatgtcaaagccatttccagcttaatgttctgtgggtaccttgggggccattcatgcagggagcatggccaggcagggtatgagtacattgtttctgatttctttcatacatcagggttcctcgggaaatttttgtattttttttttaagtcctgctgctttaaaaatttgaaagtggctcattaaactaaacaggctaatgtaatttgttgcttatgccaagcctagactgttgagaattgacgtttttaaagattatcaaatacctcagtaggtaaaatgagcccatgatcttccactgagtggtgagcatactcccagcccatggacaaggccggaagagacaggctttagtaggggtagggaatttgaactgttgtgtgtcacagcagttgacctctctggactccaatttcctttcctgtgaaatgaactgattagacatgtttcaacattgttagcttctgctgaggcagtgtctagcccaagatggcaaatacatagctcatgtgccactactcccacctccttgaccaatacagacataactaatcaatcacaccactcaggttccctgagcctggatgtgctataagaatcctgaaatcagtgctctggtaagtcattactaattgattagagttcaatctatttgacatcttgggctaatctttggaaggtttccaacaatcacacaaaaccatatgctggctgggtttcatgctggcctatccctgtctgtgatgttccgttccatgagagaaaactcccctaatgctattccatggcgtaacactcccaatactattttgacgcccacgtccccttgcagagggtgcagggggcggtagacgaatgacagacaggaacatatttggggaaggcagggcttaggaagatggaccaaaaagggacttcccacagcacagacctgatcattcggatttcctctttagctattcactgcctagcacatagtaggcacacaataaatgattatggaatgggataaaatttagatctttctgctgcctccactaagttaagtcctgatttacatcaaggagagaactgagataggaaagaacactagattccaagtctggagagttgggggagtccagattctaccaagaatttcctttgtaactttggtaagtcccttttactccctggcaccccggtgtgctgaaaggagttggtccatatatgatctcttagcccctcctatttgcttcttccttgattgc

SEQ ID NO: 118250 - DNA, 1112 bp, Homo sapiens
gtgtgtggaattacattgatgcatttattgagaaaggtgcaagaatttcacctacacagagggacacatctgctttgttatttataatagaaagctaaattttaattttttaaaggacactgctaatgattgagaatcaagtttttagttttgctattttttttaattggtagaggatttttatatattttttccattttgttgggttgtgtccttatttatataaatactttatccgtaagaggcaaggaggaaaccttctttgcttttacatattgtggttgtcatcgtccctattttatttctggtgtgatttctctgtcttaccttctaaatgagaaaatgttttcttgtatttgtacattgtcagattctatagtttcctagataatttaaccaaattgctctatgtattattattctgtgagtataaagttctattttaatgtctgtaaatacttcagaactggcttcttttctcaaactcccactgtggggttattgtttacatcacagaaactgtagaatctctatgctcatgtactgtaaatagtgaagtgatctgcttataaataaacttaacaaatacactatggagattaaaaacaaaataccacccacagctttgcccatgtgtgtttttccttgttggtcctgggagctcattgagggacactctgaccactaaatggggaagagatttcagttttcagcgtcaccttctcagataagaccccggatgatgtctgctcctcacctcaccacacttctccctccttcagagcacttttcacagttcataatatccattcgtgccaggcacaggggctgaggtgggggatcacttgagcccaggagttcaaggccagcctgggcaacatagtgagacccccatctctgaaaaagtaaagtaaataaaatataataaataaataaaataaccattcagactcatctcacataacagctgttccatgaacgactttttgccctgacttttataaagctataccactttctgaacaaagacttccttgttttggtatatcaactttcacataagcacattgaataaatgcactgtaggaggtattttggcattgtggttccag

SEQ ID NO: 118251 - DNA, 1085 bp, Homo sapiens
tcgaacctagatatctggaatagggatcgaggagataggagccaccaccacctcggacagatggggaaactgaggccggcacaggcgagacggcttggttatcttggttattaaaaatcacacacccgattaagtacaaaatcaggacctgttctttcggactcacacactaagttggtattatttcactggatggatggaaacactgagaagacagagagggcccagagccttgcctaaaaatacacagcaagtcttttgcagagctaggacttgtacccagctctccaaactcatagactatcagcctgggctccttccttgcacagattggggatcacagtgagttagaaacattcagaacttaaattgccttccggcgcccattctagttaacctgtcttttctccttgtccccaacagttctttatgtgaaatctacaactaatgtgatatgcaatactagattaagcagaactttttgtttttgaaaattgaatcaataagaaatggagggccaaagctgtgggaaaggaatggaccctttaaaatcaggaatctcaaggcaggatatagcaagggacagagactaatagctgtcgtttattgagtaaatgctatgtgccaggcactgtggtaggtagttgtgttagccttacaaaccagcaagttaggtaatgttaccccattttacaggtcagaaattgatgctgagtacagtgaagttttacaaaaccattgccatatgactgctgagcagtatagctgggatctgaacagagatctgtttgacttccagaacacatccagtgattctccaagtgtggtcctaagctcactcgttcagcatcatctagcgtgtggagtcctggatctcatccttggatttgcagggatggtcctaagaagctaacggctctctgtatttgacaattattgtactgtaatgtgctgcctcctaggggaagatctagaggtgaacatactctgggctaggggtaatttttgagggaaaaaaatcacttttttttaatttctgatttgactttttttttttttgagaccaggtcttactctgtcatccg

SEQ ID NO: 118252 - DNA, 1704 bp, Homo sapiens
aagttatatttctggggtcagatgtggtggctcacacctgtaatcctagcactttgggaggccagggtgggaggatcacttgaggccaagagtttgggaaccagcctggggagcttagtagcaagaccttgtctctacaaaaaaaattaaaaaatgagccaggcttggtcgtgcacacctgtaatcctcactactcaggaggctgaggtgggagaatcacttgagcccaggagttcgaggccatggtgagccataattgcatgtcactgcacttcagcctgggcaacagggcaagaccctatttctataaaagatatatatttctttgatacaaagataccactccatcatgttctggcctccatgatttccaataagaagtctgctataattcttatttttgtttctgtataagtaatatatgttttttctttgtcttcaggattttctctttatcttttgttttcagcagcttgaatatcatatgtgtaggtgagggtttttgttttctttttgtttttatatttactcttcttggaattctctaagattcttggagatagattatatattatatatatatgtattttttttttgagacagagttttgctttgtcaccatgctggagtgcagtggcgcgatcttggctcactgcagcctccgcctcccaggttcaagcaattctcctgcctcagcctcctgagtagctgggactacaggagcgcaccaccatgcccagctaatttttgtatttttttagaagagacggggtttcaccatgttggccaggatggtcttgatctcttgaccttgtgatctgcctgccttggcctccggaagtgttggaattacaggtgtgagccactgcacccggccttttttttttttttttttttgagaaggagttttcctcttgctgtccagacaggagtgcaatggcgtgatctcggctcactgcaacctccagttcctgggttccagcgattctcctgcctcggcctcgcgagtagctgggattacaggcgtgtgccaccatgcctgactaattttatatttttagtagagaccctgtttcaccatgttggtcatgctggtcttgaactcctggcctcaggttacttggatctatattttgatgtctcttattaattttggaaatttcttggccattatatcttgaaatatttcttctgcccattctctctcttcttttggtattctaattatgcatatgtttgatactttgatgtgtcccgcagctcttggatgttatgttacattgttgatattgggggttttttgttttgtttcgttatttaaacttttctgcgttttagtttagctaatttctgtttatctgtctttttgagttcatcgattctttctttggctttcaggtctagtaatgatcctatcgaaggcattcatcatctctgttactgtgtttttcacttttagcattccttatttgattttttcttacagtttccatttctttgttttactttctatgtgaatttttatctatattcttcccagatagcagccatactgggcaagatttggattcccttagttttttcttatgtctcttttgcatatcttaggtttggaaaaaccttttcacccagaaatcaccaagagctctccaaaataggacgttggtgcactcaagctagctctagaaagcaggaaatgacagg

SEQ ID NO: 118253 - DNA, 1594 bp, Homo sapiens
ccgctggtagcatatgtatggaaaggagacaggctgcccttacatcttttcaggaggaaaaactgccagggggagccaggcatatatggagaagaatccttaatggtttatactcttgggaagtcctgtacccagccagttatttgctttgacttggctgtttaaggtctggttctggtctttttttttccccctaaccaagacaaatgaggctcaattaaggaaaagggacataagatacctattccaaaactgaattccttttaactctcatgaaatgacaaatagaattgttagtatatgtgagcactgagaattactttattgatgaacactggtattttctctggtgtaggaagctgaaccatctatctccagaaatgtcttcagaaagtaaagagcaacataacgtttcacccagagactcagctgaaggaaatgacagttatccatctgggatccatctggaacttcaaagggaatcaagtactgacttcaagcaatttgagaccaatgatcaatgcagaccttatcataggatccttattgagcgtcaagagaaatcagatacaaacttcaaggagtttgttattaaaaagctgcagaagaattgccagtgcagtccagccaaagccaaaaatatgattttaggtttccttcctgttttgcagtggctcccaaaatacgacctaaagaaaaacattttaggggatgtgatgtcaggcttgattgtgggcatattattggtgccccagtccattgcttattccctgctggctggccaagaacctgtctatggtctgtacacatctttttttgccagcatcatttattttctcttgggtacctcccgtcacatctctgtgggcatttttggagtactgtgccttatgattggtgagacagttgaccgagaactacagaaagctggctatgacaatgcccatagtgctccttccttaggaatggtttcaaatgggagcacattattaaatcatacatcagacaggatatgtgacaaaagttgctatgcaattatggttggcagcactgtaacctttatagctggagtttatcaggtaagcagcaatgaaacaattggttatttctagaaaagtaatctagtacatgaaatctcatatctctaagggatctgaggaatcacaataattaaaggtatcatttattgagagttcaggatatatgaagggtagaggcaaaattcaaaccctaacctgactccacaggtaatataaggctggttcactggacctccaccacccagtacaactccttaattttacatgtcagaaaatcttggctttgcttgagattatttgtggctggttattggcagagtcagcattagcagttaggcaagtgggtaacagaatggagttgagagtgcaggagtttctcactttttttttttttctggagacagggtctcactctgtcacgctggagtgcagtggcactatcttagttcactgcaacgtccgcctccctggctcaagcagtcctcctacctcaacctcctgagtagctaggactacaggcacatgctaccacacctggctaattttattttatt

SEQ ID NO: 118254 - DNA, 3312 bp, Homo sapiens
cacttgctcttagccaagaggctgagaagccgtaagacttcacttttacagtagtgatttgtaatttaaggaaaatacttggtttcttaactagaataattttttccaatttgaagttttcttgtggatccttgagaatgtttttcttttaaaagaggtctgttctttgtgatgggaagaatgaaaaaaaaaagaggtatgaaccttattcaagtttaagaaacgtatgaaaagaaagaaatccaaagttcctgtctcacctgggttaataagtaacagtgtgaccttgggcaagttgcttagccctttaaacataattttcatctttgtaaaatgagaagattgatatatgattgtgtttattctagctctgacattctgtgatgctctgatgatatgtctccatgcaagaaatgtcaggataatataaaatttagaagttcttttccatttatatttaacacttctatatccttccttccaggtagcgatgggcttctttcaagtgggttttgtttctgtctacctctcagatgccttgctgagtggatttgtcactggtgcctccttcactattcttacatctcaggccaagtatcttcttgggctcaaccttcctcggactaatggtgtgggctcactcatcactacctggatacatgtcttcagaaacatccataagaccaatctctgtgatcttatcaccagccttttgtgccttttggttcttttgccaaccaaagaactcaatgaacacttcaaatccaagcttaaggcaccgattcctattgaacttgttgttgttgtagcagccacattagcctctcattttggaaaactacatgaaaattataattctagtattgctggacatattcccactgggtttatgccacccaaagtaccagaatggaacctaattcctagtgtggctgtagatgcaatagctatttccatcattggttttgctatcactgtatcactttctgagatgtttgccaagaaacatggttacacagtcaaagcaaaccaggaaatgtatgccattggcttttgtaatatcatcccttccttcttccactgttttactactagtgcagctcttgcaaagacattggttaaagaatcaacaggctgccatactcagctttctggtgtggtaacagccctggttcttttgttggtcctcctagtaatagctcctttgttctattcccttcaaaaaagtgtccttggtgtgatcacaattgtaaatctacggggagcccttcgtaaatttagggatcttcccaaaatgtggagtattagtagaatggatacagttatctggtttgttactatgctgtcctctgcactgctaagtactgaaataggcctacttgttggggtttgtttttctatattttgtgtcatcctccgcactcagaagccaaagagttcactgcttggcttggtggaagagtctgaggtctttgaatctgtgtctgcttacaagaaccttcagattaagccaggcatcaagattttccgctttgtagcccctctctactacataaacaaagaatgctttaaatctgctttatacaaacaaactgtcaacccaatcttaataaaggtggcttggaagaaggcagcaaagagaaagatcaaagaaaaagtagtgactcttggtggaatccaggatgaaatgtcagtgcaactttcccatgatcccttggagctgcatactatagtgattgactgcagtgcaattcaatttttagatacagcagggatccacacactgaaagaagttcgcagagattatgaagccattggaatccaggttctgctggctcagtgcaatcccactgtgagggattccctaaccaacggagaatattgcaaaaaggaagaagaaaaccttctcttctatagtgtgtatgaagcgatggcttttgcagaagtatctaaaaatcagaaaggagtatgtgttcccaatggtctgagtcttagtagtgattaattgagaaggtagatagaagaatgtctagccaataggttaaaatttcaagtgtccaacatttcccagttccacagtgggaaattttgcacacttgaaattttaaccaagtggctagatattattcctcctttgaagctaatggcatttgtatatacacactgcagcagagcttgtagctggacagagtcaaaaagaagaaaatacggtttcaggctttcttgcagatatgaagtattcttggaatgcaataagtatgtattgaactgtactgtaaagtagctccaaaacttaattactctcctgttttaggggttatacatttggactgtgcattctccaagagatgaagcggtgaagttgggatttacattggaagtgctgtagacttctttatgtggctcagtggagagagggaaagaatgttgcacctgctctagtaccataggtcaagaggcttctggatcacaaagtcataactagacaggtttgttcttgtagttttctatccccagtctttgctccccagatggcagtagtttttagtaggaaagtgccattcctgtccttaaggcacagtctcatcagaagtctaatacctgggcaggtttataacatcctgagagccagcctgacattagacagaataccctttgtaatacattggaaatttttactcatgcctttttgtttaggataaataggtaagcacaaagagctcttcaaaatcagaaaaaacaataggagtccttccttgtcttttctgtgatctctgtccttgtttctgagactttctctaccattaagctctattttagctttcagttattctagtttgtttcccatggaatctgtcctaaactggtgtttttgtcagtgacagtcttgccagtcagcaatttctaacagcattttaaatgagtttgatgtacagtaaatattgatgacaatgacagcttttaactcttcaagtcacctaaagctattatgcaggaggatttagaagtcacattcataaaacccaagtgctatgggtgtattattcatgatagctggcccacaggtcatgaattgaggaggaatttgctttcaaaaagcaagaatgtccaacactgaaagtttatagttttatatttggaccttgaaaggtaagaaaaaaccaggttctccaaagttaggaatagggaactaatttatgaaacagccatcttaaaaaaaaaaaaagtaaactgcaaaagtacaaaatcatttttcaatctgttcccagtttctaaacaattttaaatatttatgagaagcaaaccctatgt

SEQ ID NO: 118255 - DNA, 1003 bp, Homo sapiens
ccacttaaatgaccataagtggtcatttaagaacatgttagggttagccctgatctgaatataaaagtgagaaaagggctacagtgcatttcttggtaacttaaactgagtcttgaagttataatgatccattcgagttctgtgatccttattgttcttaattgtgtttctctacgtattgttacagatgagccatacgtttctttgtatcaatgtagacatgacttcagatacctctgaggacctacccagcagtctaggaccctgggccaagtgctgggactatggtactaaatccagtagatgggctgtgtagcaactctcccagggaacacactagggtacttagggaggtgctttgtggagcatgttgaagctttgagatctgagcaggaggcagtgatgtccctggtctattcagggaaagatttcagtgtgaaatggtaaacatccaattgacaggatttagattttgcttagtttttctgctttttaatgtttctatcccccatctcagtgttttctttatccatcccagtgatgccttatttgaaactgggcttaaactgcaaaaagaatgaagttggatttaggaagctgttagatcattgagtggtgttgagagtgaagtttcactagcagggaagtttccttgagcctaaaataaaaagaaaaaattaaaaagaatcagtttttttaattaaaaaaatagaaagctgttaggctcctaattcgtggggtttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgata

SEQ ID NO: 118256 - DNA, 1092 bp, Homo sapiens
ctgatgggacagagaaagtgtctcgcatatttcaggtattgaccttaactctgttttacagatgaaataacggagacttagggtaagtagattgcttaaggtcagaggtccccgtgctggtgcgactggtgtagtctgtactagaacccggattttctgtcctctagagcccttcgtttttaaccttaaattgtcctgcctttttttgcattgctatactgctgcctcgagtctgataacaaacttgtactcaggcttagaacagggtaataaaacaaacaaaaccgtagggtgttgtcttcctgccctcagcccaaggtggctgtaatgagtgtttcctaacccgttttgcgcagggtgcttagtaccctatatgccattcattacagatgctctcctgcagttactgcccttctccacaaggctttcagccgcccagaagtcaattcagggcaaaaaagcgcagtccccacgtagccttgatttgaactactgcttcccttatcctttactggcctattgcttacccagccaagttgtagactgtgttctcttcctgggttgcactatggcagttagaatgtaggtttttgttttgtttttctttgttagtttagtttttgtttttaataggaagaggaatcatttagagatgacagagaactaggaagaacctaaggaataatgtgtgctttacctggggtatatcctgaaaattataggtgaaatacagtgtgtctgcaatttctaggagaggttttttgttgttgtagttgtttgtttttttaagctttcgcaacattgtcaaaagaattcttgcctccaaaagactaggagccactgggttcatccttttctcacagtagaaacagttgaaatttaggatgtggaatagacttctctgagatcataaggttagagtttaggtctcttgactccacatgcagtgctcattataccttatttgtggagtgaggtctaaatgagaggtgtgtgggctttgtactgcacgtatcagtcccatatttaccaccacaactgcctcttcccagaattctaaatttcctcctgacagattttcaggggcaacta

SEQ ID NO: 118257 - DNA, 1044 bp, Homo sapiens
tcacacacacacacacacacacacacacacacacacacacacacaaatcagcaatctttttgtgcatgataaaatcctacgtaatcctggagtgatttgatttttaaaactacacactaatgtagatcattatcaagactttaaaaaaatttaaatcatctgcaatgattcttccttatttacatgcttatttctatctaccactatctctaccactgccaccaagaacatgagtaggttagttctgataatagctgagtgaccattttaacttttgagtcttggtttcctcatctgtaaaatggcagtagtctcttctcataatgtttaaaataggtaatgtaaatcacctagctgaattcttgataatactgacataataaatattaccctttagtagattaaacattcattgactatataataaggaaaagtggcatttattgagtacctggaatgtagtaagactgagtgaagctttatgtgctgtgtttgacctctcccagactgcctggtgtgatgggaagaccctcaatgcccacataccttgggagcctgtcagagccctgtggcaggctgtcctccttagcagcccttcaggtctcttgccaagtgcaggctccagtgatatgccttctagtctataaaatgagtatcattcaggccttccaggtttctttgtgcttggatttgttaagtccaggccatgctgtgtgtatttgccaccatttagtcttgttctcctaacatggctgcttcaaagggtggcttgagaatgccatttccccattacctctccaataaaggctccataaaagattcagtccatctgcttttatgtttcatctgagtgctgcttttaacttttcatttctgagtgcttcctttatgccttaagtagtctcatcgacttcttgcttttgatttattgaagaatccttttgtagttgactttagtgttcattttaaaagatacttctgaaatttttttttgttctgtttaattttaggtctcatttaactgttcactttgaacttttctgt

SEQ ID NO: 118258 - DNA, 1461 bp, Homo sapiens
tcccttgttttacagatggggcagctgaggcctcaggaggggaaaggatttgctcaaggctatgccagacctcaggttctagctcacagtttcatatggcaagaccagtgctctttccagagttcagtccatgctgtttcctgtgtgactgagtgaataagctacattggctaaagtgtgattcaaatgaagatgacactgctgttgacaggggctgaccttatctgaattaggtcaagagagtagagtttttccagtcccttttgcaggaaaaaaaaagaacttacacatatatatatatctttctctctccatgtggtcttagtccatttatctctgcttgtctcccccttcctggcttcctcatcctcagaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtccccgaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtgtatcagtggtaacagtcatgagggtaagtggctttggtactgaagtctttggctttgtctggagttacttaaagggcagctagcaccatacagtgtgattccagagcagtggtaatcaagagtactggtgtggcacttactgatactgcagttctcttgaatgtgtcttgcccctgggctcactccagagttccttgaaatttctcaggcactcttaccaactctttgcccagcttagccagaattttcttcacatgagatggttcataagctacattagcaagaaagctgcaaattgtatttgaattatccacgagtcaaagctaggatctgtcaggcaatttagtatcagtcaggattttatgttttctgaagactgcttccttttcttgaaatgggatttcactctgttgcccaagctggtcttgcattcctgggcttaagcagtcctcctgcctcagcctcccaagtagccaggattataggcttgtccatcacactggctccctgaagactatttcagcaaacaatggcaccttgagctgtgtacaagaattttcacacaagacctgtacccaggtcttcctggattcagatggggtaggaagaaaaa

SEQ ID NO: 118259 - DNA, 1050 bp, Homo sapiens
tcttgtcacccaggctggagtgcagtggcacaatctcggctcactgcaacctccacctcccgggttcaagagattctcctgcctcagcctccaagtagctgggattacaagcatgcgccaccacgcctggctaatttttgtatttttttttttttagtagacatagggtttcaccacgttggccaggctggtcttgaactcctgacctcaggtgatccgcccgcctcggcctcccaaagtgctgggattacaggcgtgagccgccgtgcccggccgccactagcctgtttaaagcaggtaaatagggtgctgagaacacttgaaagggttagaattggattctctcactaactgcttatgtgatcttagaagtcctaaatgtcttagaacctcagttttctcatctataaaataaacatagcacacttcctgtggaaatagttttctctttgttcttaaactttttgagataatcataaattcattccttttgataagcacattgggatgagtacactgtctgttattaaacttaatccaggcttccagtgttgagtggcctgggtgttctttattactctgtttcagtgaaactgtccttctcttcattgcccataggattccagtgagagtagctcctctgcaccagccacacagttcatcatgttgcctctgcctgcctactcggttgtggagaaccccacctccatcaaactggtcagtactgtatgtgggggattgatggcaattagggtgtcataagcattttttttctaagtagatttgtctttttttctttctgagctaccagttgtaggaccaagaagatttctaaaagtcttagaacctcaggatgcgaggactggcaaagatttcagggattatgtggtccatatgttcttaatgggggtgagggggttgtagatagatctccatgggatccatgaactcacctcaagttttatacaaacttttttcctggaatggattccatgacttttataaaattttcgtaagcatacatgatttaggaaaatgagcagccactga

SEQ ID NO: 118260 - DNA, 2470 bp, Homo sapiens
gtgtttttccggtgtctttaaaagccttggctgcagcgggcttcctgaccgacttgttccttggcgagagagaacagcggtgagtcaggagcaggagcgggcaggagcgggcggaccgcagctccgcaccacctatgactgtgtcttcctcaaagagcaaaacattatatttttttgtgtgtgattattttatttttatttttttaggctcatcagctattgttagtgttagtgtattttatgtgtgactcaagacagttcttccaatgtggcccagggaagccaaaattggacaccccgatctattaataagatttcttgaattctgatttttgaggcagcaagtataatttgtctctaaaagctccaagtgtgtttgtgccagccaggaaatgactcaccttttgttgtattgttctagagttcatactggctaaaattagcccaagaaatatgtggcatagttcccaatgagttggataaaacaaaagatagtatataaggctgtttagctcaaggcttcattcttaaggctctctgatggcagcagttgaggtctctctgagcctgcagcctcagagaattttgaaagtaacatctaaaatgagtaggctgagttaatgaaatgtgagatcaccaggtagagttgttttgctcagattgcttaaattacccaatctttctgtggtgatttttgtctaaaatagcctacttagtaggcagtgtttgctcaaaaatcttatctcaaaaaatgagtttagtctcctgtttttctgctaaattttccctctcctgcagtaaataagctctgtgcacttgacttggaatttttctccatgttaactcactcttaggggctattatgtgttagaatctgagaatgctttaccaaagagctcttaagaggtcacctgttactggctctttttttttttttttttttccagacagggacagggtctcgctctgtcacccaggcatgaatacagctcatgcagcctcagcctcctggggtcaagtgatcctgccacctcagcctctcgagtagctgggaacacaggcacacaggctgcataccaccatgcctggctaatttttttttttttttttttttttgtagagatgtggtcttgccatgtttcccaaactggtcttgaactcctgggcttaggtgagcctcttgcctcagtttcccaaagacttaggatcacgggcatgagccatgacgcctggctgttaccagttctgaactagaagtgcagtatgcagatggctttggaaatgttgaggggtttttgggtagtaagcgactgggagataaatcattgaaatttagtgacattggcacagacactaaactttctgtaatgtgcagggaggtcctacacactatagaattaggtcacccaaaatgctgtctggctcctgttgacaaatactgagagcccaaccctttgctatttcataaggggaaatgaggattcaattgaagcttgccttataccacataactaattaggagtggagctaagcttgatagaacccagcctttatgtttcctagtttacagtgccctttatgatatacatggtgggtagaaaacctttctgaagacaaccactatttaaaaacatttttaaaagcgtatgtgtgtatatataatactattatttccactgcagtgctaattggataaaagctaagacaccaaggactttttaaagccaggtctagctgaaatagcagctgccatttttagtgagtttgaatatttgtagcacataataatgcatgagttaatttgatccagtgcaaagtatgtgacatatgtgcaagtcattcttaagactctccttaaagaatctgggacaaaaaacagaatttttcccaaaggagatgggaaaatttgaatctgtccacatgaggttgcggccacattgggattaactgaatctcataaaaggaccaccaaggtgaacaacttagggcttttaggccctgtatggcagtatgtcaccctctttctagacacacagaagtagcctttgaataatgtaaaactaaatgtaaacctaaaaaatgccaacatttggttgatgaaacctggagaagcttttcaataagaattcattagaagatgaacagttttattcaaacgaaggcatttaatgctatagtgaaaggaacctgtagccagaaaacttagattcaggctagttttacacttgagatcttaagttaacttcttcctttcatggaccttagtttccttatttattgcccatatgttattaaaaatgagagaatgtttgtgaatgtcatcaactgtaaaatcccttatgtatacaaggtattcttatttttctaggaaaagccagccaaagtaaaagtggaattggcttctggcgtctcttccaaaggctctgtggtgaaaagaaatcagcaacctgtcaccactgagcaaaattcc

SEQ ID NO: 118261 - DNA, 1053 bp, Homo sapiens
ttttctgtgtgtccaaattccatggattagtggggttggttggttggttttttggctatatgtagctagaatagttatcaagttttttttttttttttcatgtcaaatgggtaatgtgctgacgttataatgaggtttgagggaggcacatctcacccatgtgcatgaataccagattgtcatacttgtgagctataaaaggatctctcaaaatttcctaagttagcatttttcaagcttttgatcatgaccttcagtaacaggcatattttttattactgcccagtaaacatatatactaaaggtttaatgaagctgtgcccttactatatgcagtcactttttttttctcattcctatttgcaaaatcctggtttcaacccattaaattaatgttatgacccctcattggattgtgacctgtagtttgaaaactgtgtcatggaccaggttggaataggaaaacgggtctgccatctcccctgtcatgtgttctttgtcagttaacttcctttctttaacagttttacatttgccctgacaggaatatcaactggcttttactttgagaactgttttgttttccacacagatgtggcagctctgggtgtatgtgtgatcttgcggtgtagaaggaaggtatctggttagcgtcggtagttttgtatatttccagcccctagattcccttcatgtacactctgttacttgggtaaaccccagtcttctctgtaaatagtttccttttgattggtgacattgggtatttgttaaaagccacaagctcttttactagtcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgaggtgggagcattgcttgagtccagcagttcaagaccagcctgggcaacatagtgagaccc

SEQ ID NO: 118262 - DNA, 1111 bp, Homo sapiens
gatagtaacttgtcataggagcttagatgctagagctttgagctttaatagtctgtaagtcacagtttgtcttcaggcagggcttgaactctttagttcaccagtctcaagcactctttgtttaaacagacctgctttactccaccaactgcctggaccctgaaggcatttgagtttctgaccattgagagtcaactctcctgtttcacagatagggaaggactggactggatttgccaaaaatttacagcctgtattaaaagtaaaagagttaactgcagaaaaggttaaggctcttgaagttaggctgaatctggtttgcagttgccactctcttctctgatttactggcagctgctcattctggttctgggttctgcccaggtttaacttaatttttgtagaattgaacactggtcttacttttttaggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgtgagttccttcccccaaacacatcccctggcctgttctgggctctgttagtgaacctgtcttagtagaaataagaagatttttaaagtacatggtggtagttagagcatccaaactgaaccagttggtgggttctgaacctgagcaagtgccgccttttctctgagcctccttgtccccattgccagggtgaaggggttgactaggtatcttgatctctgagaaccaagagttcactcactgcagagaatgatgtagcacaggccttaagtaggagtgaaaggagagggacgaaagggttgcatcctcttaccgctgaggcctgatacaagacctgtaagttgatttactgtttcggtaaatagagaatgccaacctgagactttgcagattagaccaccgctgctttctcaggctccttggaaagcttttagttaatcaaagctttatttctagcagtctaggcagccctcctctctgaagttgggccaaactacttgggtagtaaaatacattccacttggctcctt

SEQ ID NO: 118263 - DNA, 1041 bp, Homo sapiens
ttgctgcacatttaccctttcctcccctattattcatcaacatcaggcatttgtggaacactcaccgtgtaccagccattttaagactttggttgaatcctaagttttgtttgtagaattgagtgctgaagatgaaagtgtatttttgatgtattctctttgtcttagaacttaatggtgctttattttgaattcatgtttttaatgtcttatattattagattgagtttgtactattttatgctcttgccaacagttaacaaaagtgcctattaccctgttgtctatccaggctagtactcaggattatatatttatttagtcaacatgtattttaaaatttacatgtagttaagtgtgttgctccaagttccataagttctgacagatgcactaagtggtgtaactaccttcacaatcaatatatagaacaggtctatcacccaaaacattctcttttactgttcctttgtatttaaacccatccctctcccccaacctctggtaactgtttgatctcatctttatccatatagtgttctctttcccagaatgtcatgtgaaagcaattatggcacgtagccttttgagtctggcttctttcagtaagttaatcctttgagagtcatccatattgtgtttatcagtgatttattcctttttattgtggagtagttttctgtggtgtggatgtaccacaggttgtttagctgttccccatgggaggatatttggtttgctaccggtgtttggcagttacaaatagagctgctacaaatatttgtgtaccagcttttgtgtgaacctaagttttcatttctcttgggtaaatacctaggagtcagattgctgggtcatgtggtaagtgtgtgtttaattttataagaaaactgcattaccaaagtggctgtaccattttgcattccttcccacaatgggtaaaagttacagtttgctctacatgccagtacttagcattatctgtttttgtttttcagccattctaataggtgtgtctccgtataaactgtagagtcagct

SEQ ID NO: 118264 - DNA, 2117 bp, Homo sapiens
ggcatttagttgtggggtttttgttttgcctttttcaagatatataacttgaataaaatagagatggggctttgctatgttgtccaggctggtcttgaactcctgggctcaagcgatcctcccaccttgggagactacaggtctcccaaagtgctgagactacaggcatgagattacaggccatacctggcctgttttgtttttttgagatggagtctctcactgtgttacccaagctagtcgacaactcctgggctcaagcgatcctcctgcctcatcctcccaagtgcctgcaactacaggcacgtgccaccgcacccagctggtgtgtattctattttttgccattgtgtatgatacattaatttccttgttgcctcttcttaacctgcaggtctctttaatgtggggaacaagctgctggtaagcctggacttgctttttgcaatcagaaatcagatcaagctcggagaggaccccagagtgtccatcaatgttgttctgaagtcggtgcaggagcagacaggtaaaagttgttttcttccctttcccaaggttagtcctaagctccctcggaattttcagtgatggcatttggttaaaagactcattttgaagaagagtctgattattttgaaaaggagacattcttgacttcctaatacactcttccttttgaattttacaaatgccaaactaattttggaaagcatgaatctttttgtgcatccagggacccttagcaagagattacgagtgacttgtagaagtaccttctttggtcatagggagacttggccccattgcatgttagactcattctgaccacacagctcctggatatctgcttccagtcccaaggctcatgccaagacctaagagtgaggaccatcctttctgtctagaatatttttcctccatgccctctttactcctatttgtgcttttcccatcccattcctataggctccaatccccctctaccttacctgctgtgagaacagatggagtagagcctactagagttacatgggcctgtgtttcagtcttggctctgccactgttgcagtgtgattttgagcaagttattcttgtgcctctgtttctccagttataaaatgaggataatagctcctcgttcataaagaattaaattgaggtgagattaatgacataacatatccaaagctttcagcacagcatctagtacttagtacaaggcagctatcactccagtgggaattgctctttgggttgccacctgagcacttgcaggccagatccctgaccctcagggtaggtagtacactggagtgttctttaaggtgaatcagtctggcagaattgctctacttactacccactggctcatccctagtggcttcagtgtctttttctgtgcccttctcagtgttcttgctcttctttcagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggaggtaagtgcctcttagccaccgtgagggacctgcggaattttctcattttggcacctcccttcctatatgatatccccagggggtggatagctccagtcctgtctaggtgaggcaagtgagtttttcctcccacagcccaagatttcatttagggaatgccagatggaaatggaggcatttgtttattcagttactcacttgaaaaatgtatttatccagtgaataagtatcaaaaaatatatatagtaaatatattgaacataaactaaatgcatgttttagacacctgggagatagtagttaaacaaagtttctgtcctcatggagctcactttctggtttggaggacacaggaaacaaatatctgtccaggagtagtgagtgctgtgaagcacagtaaagctgggtaagagagagagaacagtgtcatgggaaagggcatttgtattttatagagggcagtgaggggggaaggcccctctgatacagtagcatttgagt

SEQ ID NO: 118265 - DNA, 1064 bp, Homo sapiens
tcaggagtggtaccaggaaacctcttctggccccgagagagcacttgggggacacggtatgtttaatggaggggaggctgagggaaaggctcgtagctggtgggttccgtggggcctgcggtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggttttggtgtagcaggagtcaattccgtgcacatcgtatggggcacagtgtggtcaagctccacagctgtgagctcgtcacttcatgtgaaggagggaaggaaagaaagacgttccagggaatttgcaggtactcatgtggcacaaagaaccagaggctgactgcattaatgctgttagtttaatgtggacagagacatcccacggcgtgactgttagttaggatgagtcagcttgggggagtttgtgcttcctgcttggtgtggccagccacatgccaaggtcccctgccttctagcccagaatgacgggactgg

SEQ ID NO: 118266 - DNA, 1430 bp, Homo sapiens
agctgggtgtggtggcaggtgcctgtaatcccagctacttgggaggctgaggcaggagaagtgcttaaacctgggaggcagaggttgcagtgacccaagatcaagccattgcactttagcctgggcaacaagagtgaaattccatctcaaaaaaaaaaaaaaaagtacaattattatgtgtcaatcaaaaataaaataaaacttgaagaaacctggagtagctgtattaatatcagacaaaatagacttcagaacaagaaatatttccaggcataatgagggacattacatagtgaagacagaatcaattttacaagaagacataacaatcctgggtgtatatgcactttagaacagagcttcagtttttttttccggctggaaccatggagggtgtagaagagaagaagaaggaggttcctgctgtgccagaaacccttaagaaaaagcgaaggaatttcgcagagctgaagatgaagcgcctgagaaagaagtttgcccaaaagatgcttcgaaaggcaaggaggaagcttatctatgaaaaagcaaagcactatcacaaggaatataggcagatgtacaggactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcgtggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattggaaaaaaaaaaaaaaaaaaaaagaacagagcttcaaactacatgaaacaaaactgatagacccgaaaggagagatataaaaatctcttgtaacacccttctcccagttgtaggtggtacaagtagagagcaaatcagcaaggttatagaaaacctgaataaaatcgtaaatgattgacctaattgatttttatccacctaacaattgcagaatacacattcatctcaagggcat

SEQ ID NO: 118267 - DNA, 1081 bp, Homo sapiens
gtgaccagccctctgcctccagggaggccaactgactctgagccagggttcccccagggaactcagttttcccatatgtaaaatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacga

SEQ ID NO: 118268 - DNA, 1082 bp, Homo sapiens
gaagcccagatagctgccagctccccagaagccactccacccggctggcagagagcttggcctgggcagcccagcagcctctccccacaccaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagcgaggagtactggaggtcaggcagctgctggccccgcggcatctgaggggaccctgcactgctgagggtggccagagggcatcccccacagtctcagcatgtaccgccaagatgagctcaggtggtgatggcaggtggactctggcttctaatcccagctcttcacctgaccagctgtgtggcctcaaacaatttatttggcttctgttgctttatctgtagcatgagggcaataatactaggtatctcagaaaggttgttgtgaagattaaaggagagaaagcatatattaataaattgtgcagtccagtctggtggatagtaagtgctcaataaatactagctgagaatgatgatgatgatgataacagtaatagtaacattatggagtctcagtttcctcctctgtaacaggggttggtaacagtacctgcttcataaggtgttatccagttagtcatttacccactcattcattcttttaataaatatttattgagcaactgctatatcataggtaaagcacttagcataaggccaggacgtacatagtaaggaccatctcagactcctctaatagagataggactataatagagtaagggactgtcatcagaattaaacaacataatgcaggtgaaaccattatcacggtgctgggcacacagtgggtcctgggaatggtgggtgtcggaaggacgttgcactcatcagcctatcccaatgccccattttatggtcaataaaacaaagccttgtcactgcattc

SEQ ID NO: 118269 - DNA, 1032 bp, Homo sapiens
ggaccaagcttagagaccatcttctagatcctgggtgggaaactgaagcccgcagaggggaagggacttgcccatgtcccaccgtgtaaatgttgggggaggctttgctcctggtccacgtcacttgtgagccaggctcatgaccacgccatccctcgtgaccacgccatccctggagctgtcacaccatcttcattcactgccttccttctctgtccttgaccatccgcacaccctccctttccatccttcccggcacaggtgtggattgaagctgctcttcagatcttctattccctgggtgtgggcttcggggggctcctcacctttgcctcctacaacacgtttcaccagaacatctataggtcagtgtcccacagcctcccagaccctggggtccaaagcagggaggagagtggctggccagggagggcctcagaggctgaaaggaaggcccactcaccctggcccgcacctggacttcttctggtagagacactttcatcgtcactctgggcaacgccatcaccagcatcctggctggctttgccatcttctccgtgctgggctacatgtctcaggagctgggcgtgcctgtggaccaagtagccaaagcaggtgggcaggctgccaggcctcagtggggtgagcatgtgtgttgggtagagatggggctgggccagtggaccagcaagattatggatgggggccaggcgcggtggctcatgcctgtgatcccagcactttgggaggccaaggtgggcggatcgcttgaggtcaggagttcgagaccagcctggtcaacctggtgagtcccagtgtctactaaaaatacaaaaagtagccgggcgtggtggcacatgcctgtaatcccagtactcaggaggctgaggcaggagaatcgcttgaacccgggaggtggaggttgcaatgagccaagattgggtcactgccctctagcatgggcaacagagcaagactctgcctcaaaaaaaaaaaaaaaagattgtggatgggtatgtcatgtgtgtg

SEQ ID NO: 118270 - DNA, 1031 bp, Homo sapiens
ccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgtggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagac

SEQ ID NO: 118271 - DNA, 1054 bp, Homo sapiens
tggactttccagatgtaagaagcaccaggcccccagatcttctgtcccacagaacaaagctagggagattcctgcccactaggctttattgttggtaacttggtgtcccaagtagctggagacacagccaagtcaggcactgtctcaggctacattaatagaggtataatatccagaattggggaggggatagagagtgctaccccagacatgatattctgcattattcaggccacacctgatattgtgtgcacgtactcagagaggtatctagacagctccaggactctcaaggattaaatggccagcttgagtcagtaccacaacctggaggccttcagctctgagaagagaagactaggcatagaggctggggaagcaggtgttcacttcggggccccagaaggcagaaagaagacaagaactgtatctagcgggttttggaaggacagatttcaacttgaaaggagaaggaagtgaaaatagccagggcagtccaacattgcagccagcttccgggcaggccacaagccctgggttccaaccagagctacaccccctcatatcaggctgctgggaaatatccctgccctgactagagactccaggatgtcctcaggaggaagttccaattcagagattcccagatgataataaccacactctcatttcccaagagccaggcactgtgctaacttctttacataatgcagcatcctttacataagtgctttgatctaaaggactcggaacagcaactggctctctgtgaggaccatgtacatgttagctatttctattgacatattcttaactcaatccttagaacaactctacaaggtaagtactattagtatcttcattatacatatagggaaactgaggcactggaagttcccttgtccaagggaacagctattaagtaagtggcatagccagaatccaaagccagggactttggctccagaatccatgacctcagccactgtgctagactctctgagatggcagggagaagcagacctcaggaaacaggcattgagcacaggctcct

SEQ ID NO: 118272 - DNA, 1603 bp, Homo sapiens
gagaggaaggagaggagggaggagaggggaagggaatcggggagatgaggggctgactgcaggctgatgactgtggaagccacaccatccagcccagctggggaaaatgcagggtctgtgagcatttatgcccctgtgagcacacgggcattggaagtgtccagtgagccaccccatcccttctgtggaggccccggatggaaggcacagggccttgagttcaaaggccactcctggcccaaccatcactttgtagctcagcctccttcactcccttggatggaggagggaagaagtcctattggaagatgagaataacctgggggcctggcccaggattttggggagctcactggatcttggagtcagaaacccagaattagacctgagaccctcaaggcatatccagtgcctcccatggcaaaggcctgccctgtgggctcctcgagtcccttctttccagcagggagaggggcctcctggcctctctggtataagggcatctagaataggatgagcctttggagagggtctgactgtgggtgcctggagacctggacagaggaaagagcctgaacgcagggcctgggttctagcctcagctctgctagtggcttgccgcgaggccttgtgcaggccactgcacctctctgggcctcagtttctcatctgtgcaatgcaagggtctgtcttcacctaccatcttctgtgaatgggagtctttaagactcctggcttggagagctgagggaaggagaaggtaatttacatttgtccccctctccttctcttggtaccgtagccaatacaggggatgctacaaatccccaaaatgctagtgtaagctgaatggcagggccaaaagactcaagttctagactcagctccacttctggctgagcctcagtttctccatcagcataaaggggtggaataggccagccaccaggaggttgtgaatgcaagctggattgcaaaggctacttagaggactggctcccatgcttggccctgctttggcatcacctgcagatattgtttaaaatggagatgctcaggccgcaccccagacctagttatcaaactcctcagaggggacctgattctgtttattgtaacgagtttcccaagtgactgtgacagtcaattgggaatgaggtcctcctagccgagatgcacggggagcctaggagaagacattgggcctcacttccaggcctgagcaccctttgtccttcaagagcattggattctggaggcctccagtgactggcttccagagccaggattggcttttgccatcagagttaggcagggtgggtagccctggtcccagggaggcttggccatgagcttggctgttagatcgctagacccaggcagtgtgcatgaggactcagagcttcaggacgaggactggccccgccaggtcaactgttgctggtggccttgactccttgactccttgtcccgatgccaagccgacaaaggactacagaggatgaccccgaggcccatcctcctcccaaacctcccctgtcgttcctctgctccctgccgttttcacgctgtgtcttttcctgtcccatctcttctccttgtt

SEQ ID NO: 118273 - DNA, 1010 bp, Homo sapiens
aggcttcttatttactctgggactttcaagacttgagtaaaggcaagacaccataagcagatcacatgggagccttgaccacagaagggggaagatgggatatgaatggataaatgaggaattcaggatttgcctaaccatttactcctgcctcagggtgatagcctggatcaaggggtcatatgagctcacaggcaggcacttgggagctggtcttaaaaaactgggaaactagacgagtcttagagatttcccatttcaaccaactcctatacgggagcaaactgaggcccccatgtgggaagagatacggcagcccagtttgctgaaaaagagtccctgcttagactctgcttggatttatgttcaagtcctggctctgttcctgaccaccgagcgacctcagttaaggcccttccccttcccttaaaaagaccttaggtcctttttaagatgaggtgagtaaactagagaatgaattgggtcccttctggctctaaaaccctcttaagtgtcattcattcattcatttcataaataattgagtgctctttgaacatcacttgggtgctaggaatagaaggttgaataaaggacagtctcatcacatgtcactgggcgcaagagcatgtgcagacgagtataatcccacggccaagtaagaaaacgatggtgtgtactaaatgctaggggaacccagaagcaaaagtgactaattctttgggagagttatgaaagactttatagcatggataacatttggactgagctttgaagagtgagtaagagtttgcctgggaaagcagggcttgctctaggccccagtgcaagttaatagcttagagcttagggattccgaagtctggagccagactgcttgggttataaatcccactccaactactagccgtgtgagtcaccgggcaactaatttaatttaccaagcctcagttcccttatttggaaaatgggaacaataatatgtacctctgaatttgtggtgaggatta

SEQ ID NO: 118274 - DNA, 1078 bp, Homo sapiens
aggtgcttattacagatttgttcagttagcgaatgaatcaatgaataaactggcaattcgtgtctggttcatgggcaccaaaaaccgtgcgaaatggataaatgagcaggtaatggcagtacaaagttcggatctagagaaagatccagattagggagttcagagatgagtaaaacgcagacccagccatcagagaattaacaaggaagataaatctcttcaagaagccagccggaaggattaaaagagagtcgtccaagtcccggccggccccgggggcgggtccctgtctagccccgcatgctccgcgccaatgggcggtattgttgatcacgagtctccgcccccttcgccttgaggggcggggccggccactcccggagaggggactacgtttcccggcgcgccgcgcggccggagcgaaagaggagccggaagtgtggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccaggtaagcgttcgtgggccgtgtgcgagggccgcgtgcaagatgtggagatcagcggcccgcggcccgcgccccgtccccaggcgacccggcaggcgcccggagccgggtcccgcagtgctcgacggcgcggccaggggtaccggaggagccgcaatctctgccttcccactgcgacttcagttcccctgggcctcactttcctcatccgggcagtgggttgggccagaaagtgtgctcgcaggggccgaactttgtaattcccgcttcccttacctccacgcccttcctggtagcgggtattttaagtttcctaagtctcccgccacgtggctaggctctgcgcggccccccctggggcaaggaggttgctgcgagtctcgggggtggattgcgaccagcccctcgggggagcgcctggaaaagggaccctacagcctctta

SEQ ID NO: 118275 - DNA, 1720 bp, Homo sapiens
agcaactagctgtatgtatgaccttgagtggatttcttggcctccctgagtctgtcttcacctataaaatgaaaataatgatggcaattatctcattgcattgtgagggttagacacagtgctccatataaagtgctaaaactaccggttggaggctccccgacttcctgcacccgcctcagtatttattaagcatctactacaacccagcaatattcttgatatagctgggaacaaaccagagaaaaatccctgctcaacatttttgttgggggaaaagaggcagaataaattgatacatgtaaaaatgaaacctgtttttaacaggagaatcctgacaagtggctttcctgggaacaagggaccctactatcacatcccaaaccatgacagagcagagtccatcgcagctgggaaacctggggcctagacagtgactccctgggatgggggtcaatgggcgtgagacttcaaagtccagggcctcagccatctgggtgcttatcctacccatgccctagactcactttgccatgagcaagtcacttagttgttcagtttttgagacatgtgtgaggcactgaggatactgtagtgagctgccagctgccttcctccctgggcctttctgtgtaggggaggagtctaggaagtaagtaaaataacaggagatagagaaaagctatgaagaaaatgaaacaggatcacagggcagagcatgccttggaagaggggcaatcttcgagggcctctcttggggggctacattaaagttgagacgggaaggacgaggacctgggcagagtcttccaagaaggcacagtacacacagcatgttctgcagggggaagagcctgggcggttctgtgaggtgcctgcatgggtcagctcctatcacttaaagactggtagctgctgcagctgttatataacattatccagcattcctgattattttaaagactaatcaagaattgtaaaagcactttatgaagtgagtgaaaatgcagaatacaaaattgtgcctatactgtgttttcaccactgtttagattctatgcacattgcctttaagagctggaaggatgcgggaaggtctgtctagtcaattcttgtggagttgttctgtcacccagttggtatagacagtcacccttgtcctgcagaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccagtaagagccttgcagctttgggaacaggctatggaatattgattgttctagggtagagtctacctccagcttcttctcttatcactagaagacctaaaagaccctggggaggagattgggagggcaccacatatctttggcagtatttgagcccttcctccgtgccaggcattatatctccatgctctgggggtgcaaggccgaaccaaaacaaccagatgggcccttccagtctcatttggtgtatggggcccaggagctgccctattacaggctcccaggtgattcttattagctggaaagaagacacacgttcagaagtactgctggagggatttcagaaagcagctagcggacacattttctgtgtgacctgtgggatgctttaggaattgctgatcttcatgttcattt

SEQ ID NO: 118276 - DNA, 1024 bp, Homo sapiens
cgcctctactctttcccaagctgcaggcacattccagacccaatgccttacagagtttcattatgcagctcacttaaatatttgtcttcccttctgagcctcccacctgtaccatgaggtgggtgttttatttttattttttgaaccatgggctattttgaagtaagccgtttaatttccaaatatctgggattacccaggtttctttttgttgatttctaatttagtcacattgtggttggagaacatattttgtatgatttaaatccttttttgtgtattgagacttgttaggtcaagtcagtcttgtgtcttgtttcttgtggaaaacatggctcccctctggaggatttacgtgctctactgatgagcacctcggcctgagtcatacttggtccacactgtagggaatcttcttgaagtcctgattcttcacctcatttgacctcatgtgtttgaggaatgctgggggatggggttgttttctgacactgaccagatgccatccctgagtgaggcaggggccttgagatgctgccagagtcctcattctgtttcacattaggcttgctgtcactcctgttaaggatctcactctgggaatttccctttttttttgttctccttctatttgttggaatccctgacaggccttttgggggttctctggatatcggttaaggctagattaagctgaagaaaaccttaaacaacaagtatcttgttctgccgtggctgcttgagctccagctctgacctcagcattccatctagcctggaggaggaagagacatgtttctgaccttttatggcactcaacttacatcctatgagccagaatttaatgacattgccacctagctgaaagggagcctggaaaacatctgttttaggtagtcttgtgcttagctaatgctaaggaaggcacgcacaatgagtttgagtgtttattatgttccagacatcatgttaaactctgaatctcctatttagtcttcatcataacccgtaggtgggccttatt

SEQ ID NO: 118277 - DNA, 1160 bp, Homo sapiens
atcggagtcataaatccctttcatgttcggagtcagctctggaaggagctagcagggtggaagcatgtttccagtggctgtggggcaggtcaggccagcaggtatccctgtgcatgtgcaggaaggggccacgctgcctcccctggaaaccagagtgcctgagggtcattgcctactggctgtttccccctcagcaaatgccccactccccgaccacgtgcttatccaggtcttgtcccctcagaaggacagtaactccaaacctgccagaagcaagaccctggccccagcacccccagagaggaacacggaggggtcctcggagagcagtgaggaagagctgccactgacccaggtgcgccatgccttctctctgcagatgctgcaggatcagagctgggctggcaggccttgcaggagagggcagatcttgcccatagggaaaatctcgccatatttaaacagcacctcacagcttccagagctctttcctctattgtgacattcatctgagccctgtgaggcaggcagcagtacacagttaaacatacaggcttcagagccaggtggtgttggggcgaagcccagctcttccacccaacagccccatggtcctgggcagatgccttttcccctgtgtgaggctcaatgtttcagccataaaatggggacagtactggcacctctctcctgcctctgtgcactggtgccagcacacaaggtacttgccacagtcccctgcctaagaaagggtgcctgttaactgtgagaagggcagggagtgttgccccatttgacagattgggaatcaagccttagagttgaagcagtttccccaaattctcatgattcataagaggctgaggaaaggtccaaacgctggtcccctggctccctgtatctctctgttttctgtttaggaccaggagtcttcttgaatcccatgagctctgcccaggaccctctctcaagcacctgtggcataccttcatgtgctccactgcacccagagcttaagccacagtcctgctcaggctacacctccaagggtgggaccaggcccaccttatcttcctgtactccagaggcccaagtcagccatgctggtgtggtccaagcttctgtgtgaaccctggcccttccatcagacagcattaccc

SEQ ID NO: 118278 - DNA, 1509 bp, Homo sapiens
ctcgtttcacgcaaaccctccactcagttccccaacgcccctggattactttgcagccagtctcagacatgtcagctcatccaccaggatttcagtatgcagctctcagttataaggacctttttaagcacaactacgatacagtgtcacacctaataagttgatctacccagtcagtgtccctatttccctgattgtctcatggagttcagttaaaggccacgtacggcattgagttattaatcctctaagtcttaatctgttggttctcacccactcacccaacccttgtttctcttgtgcatttttttgttgaagaaactgaattggtatagctggggagtttcatcctgggccatgtatcaggagggctgcatcagaacctctggggttggggcaactagactgtaaatacctccccaggtgaattgcatattccaaccaggcagccttggaaaactgcttagaccactccctgcattcagcaagtaactgtttctgaagccagccggggaaagaaggcagaattggacattctggccgtggctttgcttccagtagggacagcagccttgggtcgctccctttccctctgggcttgtggttttcccactttgtataagggagctgatcctgctgaatgtagggcttcactgtgagggtcaggtgggctctgggagttgtgaagtgctgtgctgggtcttagcagatgtgtggggtgggagggggcaccctgggcagctggaatggcttctgtgcccagctgcccctgagctcagtggaccctttgccttgtaaaacactccctaaccccatcacctcctttccctggccaagcctttaatcactgggggggtgttttgtttttgtttttcaaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggtgagcgcagcccttatgcagtggtgggaggggctgccagcactgccccacattgaggcccagaagggacaggacactggctgagtcacatagcaaggtgttggtcgggaggggcttggggtcaggtctctgggccctgcattagccattctgattagggcctggctcagacctgcagttctgggggaatagttgccagagcttttttgtggcagccccagtcatggagcccagaccagtggctagaagctgcagggaccaggttcctacatagtctaagaaagaattctgtatcagttgactgcctgtggaacaagtggtcagggtggtagtgagcttcccgtccttggtggcatgtaaagtaggttaggcaatccctaagccagagacatcacagggatagatttcatctatcagagagacaggaccaatctgaggtttctt

SEQ ID NO: 118279 - DNA, 1001 bp, Homo sapiens
ccaagacagggacaaggaattcccaggccagtcagggagtggtgaggggcagcgattaaacaaggaaacccacatataaataaaaagtattcaccagctggtaggagaggaaacaataaaaactagagaatagtggggtgacctgctatatgaaggcctcctgagacagcgatgcttaagcagaaaaagcagccagtcacaggatgagctgggccaccctccaggcagggaaactgcaggtaccaggtcttcgggggaagcgcttgggaatgagggaaactgagaggtggggacagctggatgaggagctgggggagaggagatgagccaggccgtggcaagagccacgccacatttgaaggctctcagcaaggggtcatgcccaatttccatgcccaccactctccctgactgctagtggttataagaagtagagatgggggtccaccaggttggagattatccccagtgaaggtgcagattgagtagtggggcctaagctgcttccctgccctgggctgggaactgtcccttgctccttgagaacaatgtgattcgctcataacctgaagcctgccaccagttttgcccctttgactgcccctcagtccctgctccagccctcaccccagccagacagcatctgaccagggtgtggcacagctggcatcccaaggacttgtgagtctgagggctacctcttgccacccacaggtgtcaaagaagaacccagcttccctcccactgacccaggctgccctgaaggtcctcgcccagaaagccagtgaggctcagcctcctgttgccaggacccagccttcaagtggggtgagcttggggagccaggggaagcaagcccacggagcgtagaaggtgcaggcgtggccctgcatcgcggcaccagcactcatctgccccatgacctctgcacttggtttgcctccctcggcctcagtggcctaatctgtaagaaggaattacagtacctttcgtagttggaa

SEQ ID NO: 118280 - DNA, 1036 bp, Homo sapiens
ctaaactaaacactaaaggactcagcccagttctcagaacattccaagtgctaaaaaatgtccactgtggttaatgcctcccccctgcattggagatgccagatttcattttccttgcaggggaaaagggtcaggaaatttgacatctgcatgtgtttccttcccctagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcatctggggcacatgtttcttggaagggactgtctcgccgacactcgggattccctcttgcctgcatgttgaggctatgggtgaccgtggttagtgggacaggcagtgagcagtgaagtgcctgagtgccgaattggtggggaaggcttcctggatgaggtggcatctaaactaaaggatggaactaaaggatggtcatggttgatttcctgttgccagagtaagtcatgtaaatacccaaagacaagaaatggaaggggctgagaatcctcgagttaggcctcgagctaggggcaggctccctggaggtgcctggtgaacagctgtggcaggcacagcaggtctaggaaaatcggaagtgagttgcccc

SEQ ID NO: 118281 - DNA, 1090 bp, Homo sapiens
ctatgagagaggtcacctgtaccctgtggtgacaggcctctgtgggcccttaggaacccttagacaagatgggggtgggtcaggggagggggacagccaaaccaagaaggaacagacaggagagagagagaagtgagaaagaagtgagagctgagaggatgggagattccgcggtgctgggaccagggagtgctggaggccccggcctcagcagcttcaggagagccccgagggtccagaagccctggcacgctaaagctcccactccctgtacctttcggtggagcgtcagtgggcttttgctccaaggagtgcctgctcatttcaaacaggagccaatggtgcatccagctctcaaagacctaatacggatagaggtggaggtcaggttcgatggccaccaccaagcccctacactgcctggctttgcccctggggacagaaacatgcagggccaaatagggccccaacacccgggtccagctgcagcctggttccctcttaaagacccctggggctgaaccccacatactctgcagcatccaggttttggaagtgctggtaaaccccttcagcttcctgagaatggcttccccagcccaccctcaccccacctctcctagccctgccctagacaccagaggaaagagagagttcccatgcagggaaacctgctgaccttccagtctatggtctccatggtgttcttaaggtgtctcaggttctccgggaagctccccttcagtggcgggtacaccttcagggggtcagcattctacagggtagcagggcaggaaggatggttcaagaagagctccctggcaggcagtgtgaaatgtgtagcccacgttcccttggtcttccattctgaggaatggaccagagctacaccaagcctaaaccctggacttcagccatgatgggaggggaggggagggtacgggtaagggtagtccagctgttcagctacgagactgcagcgttgcgagtcgagttccagattccaggccagctctaccaacaagccccagtgtcctccctgtggatggctgctcagctttcaggtcttacctgctccagcaggtgagga

SEQ ID NO: 118282 - DNA, 1068 bp, Homo sapiens
tgcaccctgcctactccagcaaccagcaaggatggtttaggacgctccaggagtcccttgtgcctggtaactcatgacatcacagactggctcattctcattggcttgctgcgtgccagtctgtgctttctgggataaggcccagcccaagggagagttattcgggaaggaaacagcaaaaacccgacggtgggcggggggcgggggggaagtggggagaccagacaggaagggaaaacaaattctacttcttggccttctcaaggaacacgggtggcctagcctgtgttcaggctctccagcctcatcctccacctgttcagtgcttctgcaaccccacacccaattctagccccagctctacctcccacacacgacatgggacagtaccttcccctctctgcaccacagttcctcaggaggcctaagaacctagagattcaccctgaagacgagaccacataacctggattggaatcctggctctggagtcggttagttctgggaccatctaagttgattaaccctctgtgtgagtaaaatcgggtaaaacatctgctccaagggctgttacattaaataagatgatgagggtaaagctcttggctccacacctagcacattgttagcactctataaataaattacactcagtgcaattctcaggggagttcgtagttaagtttagcatctgcttttcttcctctttatgcatcttgaacgcctgtcccctggttctggtagagtgccaactcttgtcacccccctctttatttcctcatttacactaccttcttctgcaattaaaaaaaaaaaaaaaaaagccaaagtcaggagccaaccagagctagcaggaatcgtgacacagatgttgccaggcagaagcattcacaaaagcctccaaaacaggctccagtctggaatggcctaagcacacatagccagctttagaagcagtaactgaataaagggaaaactagacaaggattagacaaggggacatgcactctgaacactgagcccacctgggtctgtaaatcactgagtggtctgagctcagaggggtct

SEQ ID NO: 118283 - DNA, 1027 bp, Homo sapiens
tcccaaactcctggcctcaggcgttccaccagcctcagtctcccaaagcccaaagtgctaggattacaggcatgagccaccgcgcccagccttaaaagattttttcagactttttttcagtgtctttttacttaatgaaaacgagacagttgcagttaccctgtctaaaagggttttttcctctagagaagacggtgggctagatgtcagaacctggatttgtcctgtgcctctgacatcttgcgcacagctcagcctgtttccctttctggaaagtgagttaagaccacgtcaggaaattcgaggaactggcagatggggccacttcatgttcacatccatctgttaggtactggggagtcatttggggagcagcaggatctgttgctgattggttaggccattggtctagggagtcctgggggcccttcccatccagctccaggcaatgacgctttctcttcctccccacagaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaag

SEQ ID NO: 118284 - DNA, 3569 bp, Homo sapiens
agtgcgggtccagccttttaaggcctcggccccgcaatacggccacggccacggccgcgtttgagctgcacagcgtagttgagggaacccgggacagacgtgggctcccgcctctacctcgccaaacttttttcttggtgatcgcaggcccacgcctaatctcgtttgtttcctcgtttgcaaaataggaataacaatagcaccgatcccatgggtttgtagtgatcattcaaagaaggaaagcagggaaaactctcgcactatgttggatgcttctaaatctgggcgattctttccgttgctgagtcgggcacgttgcaagttctgggcgctcagggcccagcaccaatgtttgctgtgcgcttgccctgcgtttatatactcctgatgaccactctgctcgttactttaggggatgttaggaacggagaaactgcaaattggcatttactgaatggccatcatgccgaaacatactcatgcttacgtatttgagatatgctggagcctttctatgcttctcgaggcagaactttgggcttctctcctgtggcgcgttccttacaatagttaacgcactgggtcgtgctcattggtctgatttgaagataggaacatttaacttcgtacacccaagacttacacttgaagtacttactgtggtcacacacttaactaaagtttatatagggaaggcagaggagagatctaggaacacctgagacagactagggtagttatttgtggtgtagaggcatcttggcaggaggcagagagtgctgggctgggagtcaggacacgttgtttctatgtttggttttgccactgtctttactgtgaccataggctgagacactctctatcttcaccatctgcaggatatcgattagtgttagtgtcttctgaaaatgttaaattgttctgaacaccaggaggttcagaaggcctggggctttaggccggaagcagtcttatcctagccttccactttctcattcattctcacccgccttcctcctgtcagtttctctctcccttagatcttgtgacagtatgattgcaattattatgaaggtcataataggttagagttatttagtctcaggacccatcagatttctgagatgggtcttttccattagcctgccttttggatatattttagtgcctttgatatttgatgttggtgacaaagatttagttctaaatagttgtgggagtcaaatcagttgcatttttgaacattttgaagggatcaggtggagcacaggaaaacaggagatgagaggcttgagggctgtgttggtaagggtcccttgaattctaagctgaggagttcatgcaggaatcaagcagctccctcgccccatgaagggtgttaggaatggtaccagtacatgggtagctgttggtcttgggtttcttcttgccttttggggtgcagccttcaggcatctgctgctagatccctaggcttctatcttgtaggtgctgtgagctgagctgttggtagtttctggggaaaggatacttctcatggtactttgccatgtggccacagttgatacccccccaagtgcaaggagaaagaagttttagtgaggcagaaatgagagaatacagtagagtattggatggaagaagacagggacatgaagcaggactagggtttcatttaatagccaggggaaagggattctggaaatgttttgtctgttaaccttgagtttcttttccttccactcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggcaatggctgggacgggctagcagttcaggggattctctctaaagaaatgctgttttgtccaggtaagaaaatgtgcttgtccatttagcccacaaatattgtgatttcccaggggttacaagagaggagacacattcttcgtccttacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaaggattaaatgcaaaagtagatatataaaatgttaatactgagtatagctatattgggccattcaaccccactggactgaactccatgagggcagagcccatgaccatcatcctccaccatgactgagctgtgttgctcttcactcattaggatatcgtaagcactccttgttggacgaggaagaaatgaccctgtgcttttgtccccagggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggtacgagtcgcagaggggatggctgggtggtagaaaacctgctgggcttgggtgctggagcacctggatttgaggtttgggttttttgttgtgaccttgaacaagatattttaggcatatacatacttaataattggctcctgtgtacaccccccagcagctcagtgttgagcacccactgtatactaggagctgtgtttcaggtactagaagagagtgatggggaaacagacatggtctctaccctccttgtgtgggaccgaggctggtgggagagtcagactttaaacaacagagcaccagggagtatgtggttttcatttgtgacaaatgccaggaagcacaagtaaggagttggtgataaagtgtaatttaaactagggtctaaatgataagtccggagtccttccagtgaaataaggacaggaggagggtattccagctagagacaactgcagggaaaggtcttgaggtgggggtgaacctgggcacctgtgaaggaaagagtggcatgaggtgcagtcagaggggaagaggtggagtcctgtaggagaggggaaggacctggatttgagtgatgggggcatgaaagctgaaatagatgactgttgcgtgaacaagccagacagtggtcagaacataacaacaaaccatagtggccccctcagcctaaaatatttactgtctggcttttttttttttcctcttttttgagacagggtctcactctcacccaggctggagtgcagtggcgctatctcagcttactgcagtctctggctttcaggctctagcagtcctcccacctcagcctcccgagtagctgggactgctagtagtagtgccaccacgcctggctaaattgtgtatttttgtagagatggggtt

SEQ ID NO: 118285 - DNA, 1103 bp, Homo sapiens
ctttctcggccaaggactcctatggggtgagactccctttctcaggttggtgctgcttagggcttcccagcggtcttagaggctcctgcaaatcagccttggggagcgtatgtgggagatgaagtgggggctctgcccagcccgagactgttgctcaggtcctttttcagagactaattctctgcagctttctggttgcttcctgcctcagagtgaggcaggaagcaaggccaacagggattttggctccagctcctttgtcctcactcagctcatcctccccctcccctactccaacttctggatcagcctcttttttgcctaaccagggaccttgaacttaatgttcactcccaggccgacttcccagtgtgagagcagcaactcagggctgggaatccagagactgccaagaactgaagggtgcttttccttccgggcgggcagatttggagaaagcctgccctgagatgggagagataggggtgggtctggaatgtgcaagcggcccacacctgcacatcaatttacaaagaagctccacggtgatccagtgatcctgttggttcatccccaaccaccccggttagagatgggttagcttgttatcatcccaattgaacagaagaggaaacaggctcagggggatttagtgacctgttcatgactatgtagacatttaggggcaaaagcaaatgtttacccaattctgcaaagattgtataataatactttttttttttgtggagtcttgcactattgcccaggctggagtgcagtggcgcgatctcgactaatcctgccgccacgcctggctaatttttgtatttttagtagagacggggtttcatcatgttggccaggctggtctcgaactcctgacctcaggtgattcacccgcctcggcctcccaaagtgctgggattacaagtgtgagccactgtgcccagccataatactattattattgcaaatattttctaagttctgactgtgccaaaagctttcctcttattacctcgtttaatcctctcaacaactctaagaagtagtgatccctattttacagatgagggaactaactgaggctcagagaagcaaat

SEQ ID NO: 118286 - DNA, 1057 bp, Homo sapiens
atgtcactcacgaggaatgccccctccccctcccctgctcccgaacaggggaaacttttgtctagcgagggagggggttagaggccgggtcctggcttcgcgaaggctgaggcagccggaccggttttctgcgggctctgagcggcctgctgtctaactcccctcctccctcagggtctcgggagcaagaagttctccctttgcacgcagctctttaacgccctgggacaggggtgaggagggggcgccggtgggacgggtgggctctaggaccggccgggaatctggggactggccacttggctttttgcagattcgagcagcccggtgtgccctgcgaggctaagggaatacagagccccaccccctgaacgcccattgttgccctccccacccaggagagctttcagaatggcctgcgggcagttttgcccccaggtctcttcagagcgacctggctgtttgtcagtttccagcggtgtgaccttgagtgggttccttaccttcccctagcctcagtttcttcacctgtaaaatggggagaatggtatttgctagaatgaggatgagaggagtgtgtggtatttcagtaaatggtgtcatgcttatattcaacaagtacatttcacgtttactgtgtgttagggcgctggactaattcattgctttacatacattctctcatttaattctcccgcattactattaaccacattttacggaggggcaaactgaggcgcagggttgtaaaggtcacacagatagaaagtggtggagcttggattttacctccctctctcagcctgtgtctcagccacagatctctagagtgtcttgctgtgacagctcacagtttatttctccttttttttttttttttttttttacaactttggccctgtacagtttcattttcaattgaaattatggggacatctgtcctcttccccattttccccaccggcaggtaatgctctcttctgcctggtacttgttccaagtgaggtcttgtgccctggctcttgttagcatgggcagctggagcaggagggaggtc

SEQ ID NO: 118287 - DNA, 2241 bp, Homo sapiens
tgctggtcccctatccctgccccattttcagatgaggaaatagaggctcagaggggtggagtcacttatagagctggaatttgaacccaggcctgaactatttctgccttactgtgttgcttctcaggggtcttttgaccaaagatgggagcaagactggcagagttaagaccaggccagagattgcgctcatcatggtcctgcagaaagctgaccacaggctgactcaggcagcggactgacagggaaggagggggaagctgcaggactttgtagctgtcttggcatttggggtcgtcacaggtggttttaaggtttggggaataacccttaaggggcaatattactgctttcaaatccctgaaaggccctctacaggtagggggcatagtcttgtccttcagggttcctgaggatggagaaagcaacaagggtgacagctccaaggaagctagtccggaagtaagctgcccagaaagaaggcgagaacagcatggctgaaggtatgcaaagagcctgagagctgcagaggcggcaggaggatgcatcagcaggggcaggcctgggtggccactctcagttcccttttcacccaagaatctcagcatttggatggtgcctggcccacctccaccctctgttttctcatagctttggagctgcccttcctgcacgtcctggggagttccatatggcctggcctgcagagctccactgggagagtccttgccgtttggaatacactcagcccagctgactgtcaaggggccccttggggatgtctggagcagtggccagagctgggctaaggactgtactttcacagaggatttgaaccctctgcttccatttctcatctgtgaaatggggtcagtctctttttcctcacctgtgaagaaataaggctaaatcatgaatcaggctgaatcagtagggcttagggcaaaagggctggtgagtttgtggatttgaaagtgaagacgcaggcgggggttgttcccctccttccctgcagtggaggttaaaggaggctctcttggtttctgggggtcaccagcaaagttgctttctctgtctgtggggctcttacaaagctctgcctcacagcttctgtcttggaggtgtggagctcagtggaagaggtggatgtttgggggcagcggtcctggaccctgcggcctcagggctaaagccaatttgccatcaaaatccttatctagatggaggagagtttgtgctaagttgcctcctggcccttttatttctactcaccttgtttcttgaatacagattggattaatctaattttaaaatgtgcatgacgaatgagcatttgtttatttgagggcaatgtatgggaagtgcctgctgtgtgactgcagggccccctctcccactccccctcaactctcaagcagaactggcctctttccctctctctggctgtgctcctggcccctcctacctctacaaatctgctcatggtgaaaatgctgcactccagtcacttccccttgctcaccctaaaatcctccctaccagtacacagctccagggtcacctcttccatgtagccatccctaattctccagagctggcattgcctgctccctcctttacatgtgtagaacctgttacctggacctctcatgggcccttcagctcttagctttgaactctagcttcctaaagacaagtcttatctcctctaggctctgtactctggaggcaggggctgcacatgaccgctttccaatgggggtgggcagtgttgtagagtggaatcaaaagtcctgggttcaaatcaccattctgctactactagctgcatgatctagggtaaattacctaaatttccctggacatcagtttcctcaacttcacaatggggataataatagttctgttttgttagggaggttaaggaaatcagtgctttgacatagtaagtgtgcagtaagtagaagctgttcaaagataacagttgttataattattgtttgtagctagaggggatctgtccttttagagatgagagaaagaatccctggaatttgagtttctgaactttctgcctaatggcctgagatggcatgtgcagatgaggaaactgaggcctggagagatagagcaatttgcatggtatgtgggaacatctggtttcatctaggaagctggacaggatttcttttctttgttatgcctctgtttttcttcttccttcctgtcatcaagcctaag

SEQ ID NO: 118288 - DNA, 1049 bp, Homo sapiens
aggtgctggagggcaaatccaatgggtagatgggccaggagaggctgacttcaactcagtgtaatgaggagacttaaaaaaaaaattagagcaagccaagatggaagggattgtgtctgcagggagcgagctccctgtttctggaggtggaagcagaatcctggagctcatgtgatgaagaagtggtggggatggcctcgttcagacctgaggtctggctccacgagggagggcttggatttttatcatcctaggctgtccaagggatcggcctgtctgggcaggtcccagggtggcattaggtggaggtttgctatagtcatcgctgcacggcagccacctctggtttacaccaccagccttgcaagtatgacctgcccaggcagaggccagatgaggagaaatgagtgttgtcatagcagggcctttactcatgctgcatcctctgcctgcattcattccctccccctctccttatgcccgggcaactcctgctaatgcttctgtgagtgtaagcaccatctattcatggaagctcttcctgatccacctgcaggctaagtcagtggttctgaaagttgggttctggatcagtagcgtcagcgttacctgggaacttgttagaagtgcagattatctagctctatactggacctgctgaattagatatcctggagggtgggattcagcaatctgttttaagaaccttcccgctgattctaatgcatgctgaatttttttttttttttttttttttttttttgaggcaaagttttgttcttgctgcccaggctggagtgcaatggtgtgatctcggctcactgcaacctctgcctcccaggttcaagtgattctcccatctcagcctcccaagtagctgggattacagatgcctgccaccatgcccagctaatttttgtatttttaatagagacagggttccaccatgttggccaggctggtctcgaactcctgacctcaggtgatctgcccacctcgacctcccaaagtgctgggattgcaggcatgagccaccgcacctggccgcg

SEQ ID NO: 118289 - DNA, 1052 bp, Homo sapiens
gtgtccccaagctgctgcccaggagcccaagggtgggcagtctttgtctgacacaggaaccccttcacttcacatttaggggattgaggcctagtggagcagggactcacccacggccacacagggggtcagaattactgttgaggccagaatccagaattgtttcagttccaaccaggaaggggtttgtttcccaaaacctgtccctaccccaccccttctttggcaggcggagtagctgtcgccctcagggtggcccagagcagtgctgggggtagagatgaaggtgccttgtgaagacactgccaagaaggggtggggcaacttccaagaggaagagcaccaagaagcccaaaccccagacggaaaccaaatgtattttctgggccctgagaggatatttggaacaatggaggtgggatgagggaagttaaaaagggcttcttgatatccttagaaaaaaaaaatacaggctttaagtttgacttttgtttctctgaaggatgtttgtgtaactttctgaaggcaggatcccagcactctgtgaagcttgtcagatgctgtttttttgtttttttaaatttttatatttttttgagacagagtctgctctgttgcccaggctggagtgcagtggcgcgatcttggctcactgcagcctccatctcccgggttcaagcgattctcctgcctcggcctcccgaatagctgggattactggtgtgtgccaccatacccagctaaattttttttgtatttttagtagagacggggtttcaccatattgaccaggctggtctcgaactcctgacctcaggtgatctgcctgctttggcctcccaaagtgctgggattgcaggcatgagctaccacgcctggccattaggtgctgtttttatagattcagggctttggagctgggaaggactcgatcaagtagtctcctcactttatagttggtgaaatggaggctgagaggtggggggcctgcttgaggtcacacagtgaggcagccgaggtcttggatcttcctatgtgttgcaagaggctgt

SEQ ID NO: 118290 - DNA, 2022 bp, Homo sapiens
gtaggggctgtgtaagcctaaagttgtgtgttcagatgagggagacaatagtccctcattcagtatatttgtattaaacatctactttggtccaggctcttttctagaactgggatgcagcagtgaacaaaacacatggagaccctgttttggacgtggggctgacatttgagtggtgggatgaaatgaacagcccaacaagctcactgtcaggtggtgagatgtgcctggaagaaaaataaaactggcttgtgggtcaagagtgtgatttgggggagtgacccagccatgtcaggtggtcaggatggtccctggtgaggggcagtagactccgggagggtggcccacgggaaattgagggaagaattttccaggcagagggagctgcagggcaaaggcgctggaactggagggcatgggtggccagaggcagggctgaaagaatgagaggatggtggaggagaggggccagagggcatgtggagacaggtagggcctcttggccatggggaggactttgttgtttgagtctgagtggaggggaagctgctggcgggcccgatgtgaggactgactggtttgggtacacattttagagagactgctgggggtgagggtggacgcaggatgactagctgggaggctgctgcagtcttgccacgagagaggttgggcgagtcagtggtgggtggggacggcgggggagcaaccaggggttggttctggatttattttgcaggatgagctgatgggatttgctgatggattagatgtggggtgtgagaatagagtgttgaccgcaaggtttctggcttgaggaactggaaggacagttggacagtattgctatttaccaagacagagaaggctgtgggacaagcaggtttgggaagagcaattaagatttggggtcagctgtgctggggtggggcctatgctggtgggggaggggcatggtgcacatgggtgctgggtcctgcatgttcctgttgctgtcaggaacagcaacaggggttgtgtgaggggccccaatgctaggagtctgttctgtgagaacaaatgtttcctggtcccttcatgtccttttctctctctgcaaacctccctctgcttttctcttccttttggacgaggaaaaaggcagattctgaagcctcattgtcactgtgatggtcctagcctttctgcctggcatgcctcctgacagggagttccttctggggtaggcaaggttgggggcggaagggtggggtggaggttcaggccttatcctggctctgctaccaacagagctctttgccttggtttcccctcctgtatggagaagggttgaggtggccccagggttctgagggtggcagggagcatttgaggaggccacatggcacagtggttaagaatctgggcttggggtcaggcaggcatgggcatgaatccttgcctgctgcttggctgtgagactgtggacgagtaacataacctctctgagcctcaattttctcatctgtagaaatgggccagtgatagtacctgcctcacagggttactgtgaggttgaatgaggaaatgtccataaagcacttagtgccaggtgcagtgactcgtgcctgtaatcccagcactttgggaggctgaggctggtggatcacctgaggtcaggagttcgagaccagcctgaccaatatggagaaaccccgtctctactaaaaatacaaaattagccagacacggtggcacacacctataatcccagctactcaggaggctggggcaggagaatcatttgtacctgggaggtggaggttgcttgtggtgagccgagattgtgccattgcactccagcctgggcaacaagagtgaaattctgtctcaaaaaaataaacaaacaaaaaaataaagcacttagcaaggccctggcatatagcacacctagtaaaccaaggcctctgctcacagtgacccatgcaggcaggcaggtaaggggcttggcctagtgagtgggaggaaccgtgggaggttatt

SEQ ID NO: 118291 - DNA, 1100 bp, Homo sapiens
gtgaaatgcagagtacaacacctggtaccaagtaaactctcagaaatggtcatcattgtcccaaaggcccatcagttggttgaactggaaagtcgtgagcatggaggagtagacccaagcttggactgggaggcagaggatgtgggctccaagttcatctcaaacattgtgttcctgtgtgcgtgttgggaagccacttatcctctggaaaccccactttccttttctgagaaagggggaagaaatccctgctatactttaataaagttggcatgtgataccgcagcaatgcctgtgaaaatgctttgcatctgtgtaatgatttaaaaatggcacagcggtggctgtggtgtgctgatggcgatgagggcattgtaaccacagtggtgggcagctggccgggctggaggctggttcatctgtggaatgcttagtgcccacacggacttccccatccctgcctacctgctcccggctgtccaccagcctgccttcacattagccccggcattatatgctagaaaatgtgggaggtgcaaagagctgatggcatttccccagccctggtgggttttctgttatctgtggctgatgccatggaatgtggggattaagaaccagacagatgctggttcgaatctcagctaagcacttcccaacagggaccttaagcaagttgcttaatctctgtggacctcaggctccatatttgtaaaatgaggccatgatcaagtagaggccaagcatttaacaaagagcccagaacataatggcatcaggtggttgtataatgtgtattctgcctggaacgtggtcactgacaacgtggtgactgacaggttatcgatggcaggaagctggggccactgtgcccatttcggggatttgctgcagaggtcggttatgctccctacagaataacccagcttagatttaggagggtctatggaatcatatggcatgattcaattttttaaattaactcgttttttaaaattttattttttttagagatggggtcttgctgtatctcccaggctgcagtgccatagtgcagttgtagctcactgcggccttgaatgcccgggcttccagcaatc

SEQ ID NO: 118292 - DNA, 1048 bp, Homo sapiens
ctcactgtaatctccgcctcccaggttcaagcgattctcctgcctcagcctctggagttgctgggattacaggcatgtgccacacacctggctaattttgtattgttagtagagatggggtttcaccgtgttagccaggatggtctcgatctcaggaccttgtgatctacccgcctcagcctcccaaagtgctgggattacaggcaggggccactgccccgagccgccatccccctttcttatattggggtgtctgatgggggcgtgaggaccctctggctgaagtcctgccttgctgggttccatggtgcacctctctgcagtgcaggctttcccaggaggctgaagctcagctagagaagctgggtcagcagccctgggcctggtcacctccaggaagcctctctcctgggctgcagacctggcttgggagtggtgtggaaagtaggactgcagaagggtaacgaacaggggctgtggggtgggctgggaggggcatcctagctccacctctgcccagctgtgtgacttcgagcggttgcttaccctctctgagcctccatttccttgtctgtaaagtgctcatagcagtgacacctctttcagggtgttaggattgagcgtgatggagcaggtaaggctcctggcacagccccacatgttcgcaggagcttaacgttggccgccagtaagggaggttatgatatgtgttgggatatgctgctttgttccttttgagtgtctgtgatctgagcctaaggaaaaaatagttctggatggatttgactctgtcataggcagatttggggatagggtgggcagagagccccattttgggaagatttgtggccactgcataacattctgtgtgatggacctgacagccttggtgtgcgtgaagagcctcagtgggactgtcaggactgtcccgtccttgggacgggagggtggcaggtgacctgccgtgttccccacacagccccacccccaggctgtctggtatgtttgctcggtaagccctttttttcagagctggtacaaaggtaaa

SEQ ID NO: 118293 - DNA, 1049 bp, Homo sapiens
gggacagggttttaatggacaagaaaatggaccaaggtaaatgagagtggggcacaccagacggcacaagccaggaggtcctttcctctctctgggtctcagtgtccccaggggcttactgcagggtagactgtgctctctgtggccctgcgactctgagccagacctccaacagtctctttcccggtggtggtggtcctggactctggggtgactgacaggcggcagcttggctcctggccaggcagcactgtgggggtgatgggggatggggcatgtagcagattccagcagaggaagggatttgcttctggtctcggcctcccagggatgtaatcacgctggagaaactcccgcacagctgggaagcaaatgtggaggattttccttgctgagctggatgtggtgggtggggcaggctgtggtagggtggctggtggagctgggaagctgtggggtgtggctgggtgggggtgatgatgtgactgtgctgggggtgtgactggctgggaggggctggatcagctatggggagtggccctgggtgcatgtggggctacctgttccccaggcctgcagccactgctacgccctcccctgctcaggtccctgcccaagtccaggtacccacccattcacatccttctgaggttgctggcagagctctttctgcactgacctcctctcagcccccaccccatgtgcatgtggcccagatgcctatgatgatgccatttgagcctgtcatgtgcatgtgaatgtggtgtgtgtgttgggggggcagggagcagtgtgtggtccacagagggcattgtcaagagtgacctaggctggaaataaaatgtgggctgggtgagcattcaaggccctgggcaccttcccccattcactgcagccatgtcgtaccagagacataaaaccttgggttccagagacctctagaaacccttgtggaaaggtcatggtcgccactgcattttcagtgcctagtggcatgcttggcacctagtggtgctcagtaaatacaggatgaggaaacaggtcgtttg

SEQ ID NO: 118294 - DNA, 1092 bp, Homo sapiens
ttcatattatttattgtctgccccattttacaagtagggaaactggggctcagagatattaaagagcttgctccaaatcatgcaaccttggttcggcagccgtacttgcatttgggcattcctaggtcagctcctgtgtgtccacagttagctgaaccctgaagcccgcactctgacgctcctgttctctccactctccacagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattg

SEQ ID NO: 118295 - DNA, 1011 bp, Homo sapiens
cttggttttgagcagaggcctgtgattttctgctcaaatgcatgccctctggtggtcaaggcacatctttccactctttctgcaagaccaacttccccgctgtgtgctgggcttgccaagtggggattgtctgtgggctccagggatctgaaaactcattttccagttcccactgatgctggattcccagggcagtgtgagagcagggacttaaaagtccagacaggttcaaatctctctgtcatttagaaacagagtgacttgggtaaaatgctcaactcatctgcaaagtggggctaattacagctgctgcctcactggtctgtgttgaaaacaagacagtgggtggggagcactgagcccattgcctggtaccggagccactcaatagatggtagctatcgtgctttgtcatctccaggttcagtaaacagcagtggtagcactgtgtccgtcttgtggccctgaccaatgtgtgcccctgtgagatcctggagggtggtgggaatagggtcatcctcatctggatccctacttcctggcactgtcgtgcctcaaccttgaaattccaggtgacctggggctaaacacaccctggcaggggtctggcaaggagtacctgacctctttcattgagcacttactgtgtcccagtcactgagctcggtgctttgcaggcatttcatggctaattctcacagctatcctgtgaagtaggcactttattttcagataaggacctgaggttcaaaaagttaaatggcttgtcccgaatgacatagctacaggttgagtgtcccttgtctgaaatgctggggaccgtaagtgtctcagattttggaatgcttgcattctacttaccagttgagcatccctagtctgaaaatctgaaatccagaatgctgcaataagcatttcctttgagcatgacctttagaggtcacattggtgctcaaaaagttttggattttggagcattttggattttcagattagagatgctcaacctgt

SEQ ID NO: 118296 - DNA, 1147 bp, Homo sapiens
tgaggctgcagtgagccatgactgtgcatggcattccagcctgggccacagagcaagaccctgtctcaaaaaaaaaaaaaaaaaaaaaaagtttttactaaacaaaactgtgtaaaagtactttgcagaccacaagattttacacacatgtgaactgtcattgtgagaaacagcctacaaattaagaccattaaacaatctttaaaatacagttttcatctactcactattttatttaaacttattcgcaaaggagatggcatcctagtgtaaataggaaatccggatcagttgccataaatagagggcaaccataacaataaatccaatgaaaacaaaacagggggattaaattctagagacattctgctgcctgctgacagcctgtcctctcttataggagattagcaagtgttagaaacatattagcaccaaacccaggcttgtctttgatgttagcaggaggctttaaaaagagacttgtaagaggaattctgaaatctctggtaggggttggccctggggcctggaaggagggtcctggtggcattcatcgccctgccttggtcaggagtgaactttgctcttccttacacctctagagaagagcagaatggatgacattcgggagcaggcactgtctggggagttaagacctaatttgaatcgagtcctaatttgaccctaatgaactaggtgacttgggcaggtcccctcccatgcctgagcctcagctataaaatgatgaaatggggtgaatgggaagttttcaggctatttcctggtgcccaggggtctcccataggtgcctggatagctggggtgggggttagggggatgttttggtgccaggctcagccctccaggctccaccttagttgctccagcggtgctgctttgcgctgcttttacgcattgtgtttcctcctgaaattccattctcttaaaggctctcctgtttaaagaacgttttagccttccagtctaagtcttcatgcagtgccaccacctgcctctggcaaggtagattgctctgtgttctactcgaggtgttcttccagtggcccaagctcattttctcctgcaggaacccaggttcttgctgtctgtccagtgagttctggagagactgtggtccagggtcagg

SEQ ID NO: 118297 - DNA, 1086 bp, Homo sapiens
gacacacagaacgaactacgcgcacacatcccaaacttcaccttcaacctgggctactcagggaaattcttccacacaggtaagtgggcctgcccctgccctcactagcaacttccaggactcctcagcacccaaaccctcaaagcacccatccatgagggcagcgggtgggtttactggcccacattagaggcagaggtgacccctctgcccccgtggagccaacagcctacaagagcagtcacaacccaggcagaggccatctggggacaacagcagcggcagcaacagcagccgcttgtccctccctgtcctttcgggctgagctggcctgggtggggcatcttctccctcttgcctctccctcctatcttttacaattatgtgtattatttctgcttataaaagaagctggttgagttttaagaacattacagaaacatgtagcatagaaagtgaagatgccctgtaattgtacccaccttggatgaccagtgtcatgggtttattttagagtcctaagggttgagggtgagggctataggttgcttggtgcgcactttccttcctctttggggctctctcacttgctgtcctctcttcatctgctgtccttcagggactgggcagaacccctcagctggtcatctgcagtgaccattccccctagctgccttctgcccaggcctcagtgagacaacctctcttgaattctaagaaaaccatttattcaataattcagcagatggaggggtatatgcaacatagccccaaagccaaataggagtgatcctgggttgtctgtctgtattttttatattctttttaaaattttttatatatttttggctgggcgctgtggctcacgcctgtaatcccagcactttgggagggtgaggtgggcatattatttgaggtcaggagttcaggactaccttggtcaacatggcaaaaccccatctctacaaaaaatagaaaaaatagcccggcgtggtggtgtgctcctgtagtatcagctacttgggaggctaagtcaggaggattgcttgatcccaggagttcaaggctgcagtgagctatgatcgc

SEQ ID NO: 118298 - DNA, 3017 bp, Homo sapiens
cccagctctgccagttgcccacactgagattctgggcacattccttgccctcccaggcctcagcttcccatcttaccatgaagtctcagaccagcagccatgccgacctaacctctgatttctctctcccattctacaaaggggggataaggcccaaaggggaaggacccctatgctcaccctggcctggtcatcctctccctaggagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggtgagtgggcccctggaagcccaggaggtgggagaatggagagcacagtctgtcatgtgtgtgcatacgctgtcctggtaagcacggctctggtttgctggcttaggggttgcagatcagcttctgctgcctcctctggcacccgaggctctctgccccagggaaggtgggctgccactccgacccctttcatgagctctttcttagcttttgtgacagaggatcaagcaataatcagcattcttgaaagaggtttctgatgaggatgtgggacagggctctgttacagtctttttgctgattaaaaatttttttcttggctgggcctgatggctcacacctgtaatcctagcactttgggaggccaaggcaggcagattgcttgagcctaggagtttcataccagcctgggcaatgtagtgaaaccccatctctactaaaaaagtactaaaaaaaaaatatgcctggtgattagccaggtgtggtggtgcatgcctgtagtcccagctacttgcagggctgaggcaggaggatcacttgaacctgggagatcgaggctgcagtgagccaagattgcgccactgcactccagcctaggtgacaaagtgagactctgtctcaaaaaaaaaaaaaatttttttttcccctggggcttctaccatgcatctatccctttttttttctttctttcttcttttttgagacagagtttcactcttatctaggctggagtgcaatggcacaatctcagctcactgcaacctctgcctcctgggttcaagcaattctcctgcttcagcctcccgagtagctgggaagacaggcatacaccaccatgcctggataattttgtatttttagttgagacagggtttctccatgttggtcaggctggtctcgaactcccaacctcaggggatctgcccaccttggcctcccaaagtgccaggaattacaggcgtgagccactgtgcccagcctcacatctatccctttccttggcactggggacacagaaatgcacagaacggaggaaagttcctgcccttgtagacctgacattctagtggcaggagacagaccatatgctcatgcatgtgtgttgtgggaagtcagggaccccgaacagagggactggctgaagccatggcagaagaacataaattgtgaagatttcatggacatttatcgcttccccaatcaatactcttgtgatttcctatgcctgtctttactttaatctcttaatcccgtcatcttcataagctgaggatgaatgtcgtctcaggaccctgtgatgattgtgttaactgcacaaattgtttaaacaatatgaaatctgggaaccttgaaaaaagaacaggataacagcgatgttcagggaacaagggagataaccttaaagtctggctgcctgtgggccaggtggaacagagccatatttctcttctttcaaaagcaaataggagaaatatcgctgaattctttttctcagcaagaaacatccctaagaagagaatgcgttcccaagaggaggtctctgaaatggccgctttgggaacgtttgtcttttacagttgttgataagggatgaaataagccccggtctcccatagcgctcccaggcttattaggacaaggaagttcccacctaacaaattttggtcagactggttgtctgctctcaaaccctgtctgctgataagatgttatcaatgacaatgtgtgcccgaaacttcattagcaattttaatttcgccccgtcctgtgatctcgccctgcctccatttgctttgtgatattttattacattgggaagcatgtgatctctgtgacccacaccctattcgtacgctccctcccctttcgaaaatcactaataaaaacttgctggttttgtgacttgggggtcatcacaggacctgccaacatgtgacatctcccctggacacccagctttaaaatttctctcttctgtactctttccctttatttctcagactgacagacacttagggaaaatagaaaaggacccatgctgaatatcgggggttggtttcccccaatacatgtgtaaaatatacagtggtcagatggtgatgagtgccacggacaaagttaagcagggaatggaaggaaggaatgctggcaagagaagctggtttaaataaggtggctaggtgggccttcctggaataagccacgctgccacatgaggaagagcactcaaggcagagaacacaagtgcaaaggccctgaagcgggctgtgctggctgtgtttgaaggccaaataggaggccgggatggctggaggggagtgagggatggtggtagatgaggtcggggtgggtgatggaccagatcgatagggccatgtaaggccagccattggatggccatgggcttttaggctgagatgggaaggttttgaatggagcatgatctgactcatctttgaaagggatttctatcattctggctgttgtgtggagcagagactgtaggggacaaaagtggcagcagggagaccagttaggaggcactgcagtcttccagaccagaggtggcagcagcttggaccagggcccaatgttgggatgtggccatactctgggcttagaatag

SEQ ID NO: 118299 - DNA, 1071 bp, Homo sapiens
ccctctacctgttcctgggcatgcaccctgacctaagcagcaactaccccagctctgagacctttgaggagatccagttttttaatggccacaactatcacaaaggcatcgactggtgagttggcctttctgtccacagcgggacgggaaggccatcctggggcctcccaggagtctgctgtggccacagcaggaagcagctggagcttgctcacacacagctgtcattcctgtaaacagggacaaagtgcagtgacccttgaatcatggtgtgacagcgttgtcatagacaggacactcgatgaggaggccctttgcccctttgctctaccgcctgtagtcagacgctgaggtcgaagtccacccctcccttgcttgcagagaaacatcctgagtcttggggaggagaagggtttgcccagggtcccaaggtcggaaatccaaatgttctggctctcctcactgcgtgtggctgactgtgaagcagaggtgttcttgtgggcccttcagggacaggtcgctggtctttgggcgtcacttggggaagtcattaagattgccacttcccaccagagcctgcagaggttacctttgtagaggttcccagcagagggtcctagtagaggttcccttaagggtgtgggggccagagcagagatggttttactctccaccttttcagttggcatctttctctatttgccttttttctttctttttaaaaaatgtttcatgtcaggtaggtaatgtgctgagatcataacaaggttcgaggtgggtacacctcacacgtgtgtgaacacccaatcatcacgtgcatggactgcaaagtttgcctttttaaaccttgtccatgtattaccattatttattatttttatgtcagtgggttccctgggtggagaggttatgggccttctgtctttcttttttttttttttgagatggaatctcgctctgtcacccaggctgcagtgcagtggcgcgatctcggcttactgcaacctctgcttcccgggttcaagtgattctcctgcttcagcctcccaagtagctgggactacaggtgcc

SEQ ID NO: 118300 - DNA, 1504 bp, Homo sapiens
ttttttttgagacagagtcttgctctgtagcccaggctggagtgcagtggcctgatctcaactcactgcaacatccgccttccagtttgaagtgattctcctgcctcagcctcccaagtagctggtattacaggtgtgcaccaccacgccaggctaatttttgtatttttagtagagacagggtttcaccatgttggccaggctggtctcaaactcctgacctcgtgatcttcccgcctcggcctctcaaagtgctggcattacaggcatgagccactgcgcccagctgaaccagagctctctttaatgcctatggcctgacttaatttcctgcctgccagcccactgagcctgcaggaatgcttttaggccttccctggtggggtaggcggagtccctcccctggctgccagcattcctgtgattatgccacacagccaagcactgtgattcagaagtggcgccccagcagaaagccaccctgttgtccaggccgaggtcctgagcatcctcgttaacccagcagaccaggcctgtgcttggtgttggggagggggtggggccctgggtcttagcccatggttgccagagaagtgtcccctgtcctggctgggacagcctcttcaggcctggccactgtcatagttcccaccctgctttgaggctcttttctcagatgtgacagtggctgtctcccgcctgggaccttgcggtctcccgcagggctggcacctgcctcctctttgctcccatggaagtctctcctcctgccactctctgaggctggtgaggaagccccttcttactcttgttctctagggcttctgtttatgccctgatgtctgctttcctgtggctttttctttaggagaagaaaaccgagaaacacttgtcaagtgtttctgttttctgccgtgctgtgtgcccccgcctcctggcgctgtgcagggaatgggcagtctgctttcatgggggaacgtagggtagagagagagccgccacaggttgggtcagtccctgttctgcactgacactgctgtacatctgcaccttactggagagtcacagctggtttctagaaggcagaggaggggtttcacgtttgtgtccccttctcaaagattagaaaaccaagtttcagcaagtttcatgtggtggcatttgaatccaagtcttctaaatctaagaccctattcctttttctgtccatgatcaagaggggtaagggatagaaggagaagggagactcattctccccaggaggacctgggaagatgttggaggagaggaagggtgggggcctgtctcagaaggaggtcgggacgaggaggacgctgctgtgcaccatattgccccagccctgggctgtgtgtgatcctcaggggagggggttggcggctgggggatagtgcctgtcgcacaggtgcctgagctctggctttctggacttagtgaattctgcagattcggacctcccatggcattattttaagtgattcagacc

SEQ ID NO: 118301 - DNA, 1066 bp, Homo sapiens
attgtcagcttagagggtccctgtgtgggtgcaataagaagattcacagaaaatacttagcacggtgcctgacacgtgaagggtctcgaaaaggaagggctgttatcgttgttgctggtaatgacaataaagaagtgggaagggggcttctaaggagaagaggctggtgcagcatagacttgctgctatacctccccgtcctcagcccagtcctggtctaagaagggactggggccttctctgcaatccagggaattagctccttttctgcccccctcccagcccctacctctaattccaaggctgtcttctgagcctcagggttagagggggtggggaacagatgaggcaaaggtgccaggcctgggatgggggcactaatggtgtctgggccggaaggtctggtaggtgggggaggggtgtctggaggacatggcccgcagccctgactcccggaggcagccagagtggaagtgggggtgggtcttggcaaagctgaaaaggctgggatttgacttggaaacacattgagaagtccctggcggctgcctcctcagtaacagcccctctgaagctgagcccgggacggggaggctgttttgtataaaggggctctggggacctcagtgatggagaatggactgaaacctctcccccagaactgcagcatgcgcagctgagcccccagcacttcctgcaggcctgccccaggggctgcagaattccagccatcaagcctgtgtggacaagggacggggcaggggaggaagggaccctggagttcacagatgggaaagggcagaagcgccgtctcagatagccccaagccctggtctcttggccttcgccttcctgttttttgtcacaactgcattgaacctgtgatgttacttacgtaacagttttctttaaattgattcactttttaaaacctgaatacagttatttcaaagggaatttgatattgctactgtaaagggaagatagtaacactcaccgtacatagtaaccatgtaaataaaatacaataaaaacaaaacaatgttgttaaattttacctagagcc

SEQ ID NO: 118302 - DNA, 1016 bp, Homo sapiens
tcctgtgtcgctgggggctttttcttcaggttttgaaatgctacagaagtcagtactctgatgtgtgtgtttgtcaagcagaatatgggctgtatttattcatcctttagcccaagcccttaaaaatatagacggctaatgtcttcagtatgtatgaaatatcccatatgctcggaaacaaaaggggctctgttattaaagtttcatttccacacgccccctcccctccctcccgcccgcccccctgacaccctgccctcctcccatcccgctcagcctgctccagacagagcgcgagtgaggagcaggcgggcaggcggcgggcagccgggcagccgtggacagaggcccgggcacagccagttgctgtgccagagggtgtggtgtccggctacaggtgagggggcgaccacagggaaagagaacagggccttccaggggagagggggcctcggggtccctgggatggccagtggaggagtgggggtggaggtggcccttcttgcgggtgcctgtagggccagggccctggcagggcctggctgtctgggacggaaatgccagctctcctgttaactgaaaccacatgtgtctcccaggcagcggggcagagacgccgccaagcctggggcttggggctgggggagaaaagatgcagctggccccaccatgtgccccagggtgggtgaggggctgtgcaggagggctcggggtcatttgcatccgtacaagtgagagtgtgtcagagtgtgagtgaatgagttctgtgcgtgtgcttgttgtatgaatgagcgtgtgtgcacacgcgagagcctgtctgcaggtcggtggggtattcctgcttgcagggctgaagtggcctcctgtggcctaagtcctgggcacactcctacctgtcacccagagcttgggagcctgctggctgccccctgggagggtcctctggggtgagaggacactcacctgagtagggggtggtcctcactgtgcagagactcccttgtgaccaccatcct

SEQ ID NO: 118303 - DNA, 1078 bp, Homo sapiens
tatctacacatgatgtatagatgccatgttctcatgcaaaccatcacacatatgcactcacacaactgcacacacatggaggccctcagacacacatccatgcatggggtacacactggcacataccttcctgaaggccccctcacccatgcacagctgccacatgtgaacacgtctcagatttgcttacagagctgcagttgcatctgaaaacatataagcagacataggcacactttctcacacaaacacacatattccctctcatagatacaggtgaaaagcatgttcttttctccatttccttttgctacacacctacactttgaaatctttcacacattctctcctacagacctagccactcttgcacacccactgtcacacacctacgtacagaccgaatcactttctctcctttcttttccacatctctttctctttcataccacccacacagcaatcctagcctctctctctcttttcctctcacccacacacagcttcctggtttcccacaggctgggctgcagccacttccctagagcaggcactctcagggttagcgataccccaacctggtgggggtcccaggatcccacccccacccctcactctcccaacctgccctctaccctgggtacaagatgatgagagcagagcagccacacgatcagaggaattctctgaagcccatgaggccaggaggagaaatgggaactgccagggagggttcctgcattctgagtctccccagtgtgaacaggggacatcccaaacccaggccacctgcaggtctgtgtttcacaggcccttgtgtggggtgggcttacgctagcacattcctaacttcctttagcagaaatctaaacacacaactcttgatgcaaaagacagatgaaagtggaaccaccctggtcaagggggtggggaacccggggaaacttcggtgaaaacctagaccagcatttctccaaccgtggttctgtttcaaaattgctggggctgtggagggtacttgccatcagtcctgtgccaagcccaccagctcgtgccctcaatgggagtggtgctggaa

SEQ ID NO: 118304 - DNA, 1076 bp, Homo sapiens
gtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcattcttctgcctcctgtgtcattttcagctgtgtctgatgtccttcccttctccccaagcatggagcagtccatgggactctgggtggctgggaatatttgagacatatgggatgggagcttgggaagaagcagccatggggagagatgggaacaacggacaacttgaggccatagaagtacctggactgcagtcctggtcctgtcatggacgagcg

SEQ ID NO: 118305 - DNA, 1033 bp, Homo sapiens
aggtaatgtctcagggtggtattgtccaggccctgaccacagagcactatcaccagagtgggcagggccaagctgggtcagggctctgtgctctgaggctgtttcctcatggcaggtgggggtgccagggcaggaaaggcgccactgtaagaggtcccgtctgagccaggcagccccagtgaggcaaggactcgggccatgaggcatcctctcctggcaggagtgtcctttggccagagaaggggattgtgatcctgctcccaggtgaggctaagcttgccctgggaacacacctcactcttcctctctagaagctcaggcccaccgagggccaggaagctaaggtcagggtggtggacagcagaatctaggcttctgatttgagaggtgtcagaaatacaccccaggatagtctgccagcacacagacaccggtggtccccaccctgcacccagcccatccttgctaggcccacccttccccaggagtgtgtgccttggacccaatctttatcttcggctggggcctcactgcagcacagtgtcccattgcctactggtgatctcatcccagtcccccgacacctcaaagttcatccaaaactgacctcagtgtctgcccccacccctcctgctcctccccttccagtcacccaagcatgaaacaggggagtgggactccctttcctcaccttccacatccagttcctcaccaagacccaagggttcttcaaataaccctcaactccctctcctctccatctccttgtcactgccctgatccagccacccctggtgacagtcaggtcctcctgcctccagtctggccccctccaacccatttcccacatggcagcaaagatatctttggaaaatgccaatccgatcactccatttcaccactttaatcttgtcagcaaccctttataaacacagtttccttttgaaagcctgctgggatctggccgctgcccccactgtctgggctaatctctcagcactgcccccagctccggctctacttgccaaccccc

SEQ ID NO: 118306 - DNA, 1014 bp, Homo sapiens
gtaatcatgtgtccctttctggggggcgggagggggtggatcatgtcaagagtatttatttataaggaaagtttggcatcctagatggcctaatggcttttaggaggctagtaattccttccgtgatacagtaaatctcttggtattaggtctattttggtaattatattttggtagaaaccatagtttctagttcaaaaggcacttcagaatatgtatctaggactttaatatgtagctactcttggaagataatcattttttcaccttcgtttcacctttatgccttgtttttttcttgaatcatagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaaggtttgtgggtataagttagagagttatttttgcctttaactgccctggaataatttatttgcaaaaactgcaagaatgatcattctgtacaaaatacatttttctgtagtctctctattgttagtatcatgctgactggaatttttgtaaaattgtcctttatggtgccacagtaataatgtgcttatgtggctgggcacagtgcctcatgcctgtaatctcaacactttgggaggatctcttgaaccgaggagtttgagaccagcctgagcaacatagtgagaccacatctctactaagaaatcaaaaaaattagccgggtgtggtggcatgtgcctgtagtcccagctgtttgggaggctgaggcaggaggattgcttgagcttgggagatcaaggctgcagtgagctgtgattgcaccactgcactccagcctaagcaacagagtgagaccctgtctcagaaccaaagctcaaagagtgcttatccatcctggcatatggt

SEQ ID NO: 118307 - DNA, 1443 bp, Homo sapiens
tgactatccagaggatctgtaagactaacctagaaagaaaccacttttacatttactttaaataaatcatgttgtaataaaaactaggagctaatttacaggttgaatatgaccatgggcacagtttgttcatctaaaaattttcttttataatttttttgttttttgtttttgagacagggtgtcactctgttgcccaggctggagtgcagtggcatggtcatggctcactgcagccttaacctttccaagctcaggtgatccacctcagcctcctgggtagctaggactacaggtgcataccaccacacccagctaatttttgtattttttgtagaaatggggtttcaccacgttgaccaggctggtctcgaactcctggactcaagctatctgtcagctccagccttgcaaagtgctaggattacaggcatgagccaccacacccagcctaaaagattttttctaaagcattaatttcatcaaatttcctgacagttcaggaatttggacaatttcttagcatgctgtgtagcagaagtaacctgatggtgctaaagagtttgaataaaaacatagtaaagtctctggtactaaataggaaagaggagaagggaaagatgatgtattctgtgtgcatggttagtatggatatgttttaaaatacatctgaggtctttttcctctttttttgtaccaggcctgcccatccaggttcgtgacgcaggattgtcttttaaagatgacatgccaaagtcagatgtcaacaaagagtactatacacagaatatggagagagaggtatgctgccactttttggataaaaatcctaatgaattgacacagtctgtataatttatcttttgaatttgtcatccccacttagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacaggcaagagcgagcctcattttcagtatttgctttcagatgatttctcatctaagaagtgggaggtcctaacttaaactgtttctgctttaaaatctaaaggtcatacaactaatgtggtatacctcatgtcttagaactatgaaatttagaagagcatgaataaattgtagtttttacttacaattgagccttggaaactaaattgctatgccatacaatatagatgctgaccctaaacatttctgcctgagaagtaaatcttcactgccatggtttaaatgagttgactctcaatgtatagttgaagtcaaagtaaggtcagacttctaaagggtgtgtatgttttggttaagactgccaagcatctggattaggagttcttaa

SEQ ID NO: 118308 - DNA, 1690 bp, Homo sapiens
caataataaggttagggctgtattattgtgtagtcgtagaggtgttgatatgttagtatgttcacgatgtttgaatggttcaagatgtttgaatagttctgtttaaacagaacatttactatattccgggcattggcacaggacaagtctacagtagctaccttttgactaaactttgtaaagtgggcgggccacagctgtatcctctctgatttagggattgtggaaagcattaggaatgttagttcttgggagtgaacttgggagccaaaaatgaacctaagagttgtggctgtggaaagacactcacttacctagcattagatgcatatactctatttcttttttctgtagagacagcatctcgctatgttgcccaggctagtctggaactcctgggctcaagcaatccttccaccttggcctctcaaagtgttgggattacaggcgtgagccactgccacccagcccagatccatatactcttgagatgttatcacttataatatgttgttatagtatgttccctaccctcttcccaaaaaaggttgggttttgggttttgttgttgctgtttttctctctctaggatgccagggatttccagacacatttcttgggttatgtttaaggaaagagtagacatctggcttttttctttctgtaactccagttcttttctattttttttctattatagaccaaagaaaagtatgggaaggaatgcaaagtaagtatgtctgttaaagagtaatgatttctgtttcatttttcttttctctaccaaattagccttcagcttactaagttttgaggtcttccagtaaaaatcagtgctatacaactttttatgtattactgatatattcattggctggcaactgtttatgtgggaggtaagaaaatgaaccctctaatgtagagattcttacggtgtcagtggatgggcactggaggagtttgtacaccaggtggtgtatgactgtccactcgagcattttagctgaggaggaaggtcattcttgtcagaagcttctcaaaaaattacatgacactccccactccccctaaaaaagattaaggttcagattattattggtgcttagctctaggatgggaagaactttgaccctttggctatttcatttctgtactctgaatttttgctggagaaggatgctgaaaattgtattgaaacatcaaatcaactagatgattgctaaggtctcttctaaatcctacattcagggatccttttttgaatgccccgttgttatcagatctccagattgcccagatcaggaccattgacattctatggctcttgctttgtgttccagatctgtgccaggccattcacagtgtttcgctggtgccctggagtccgcatgcgtttcaagaagactgaagtgtgccaaacctgcagtaaattgaagaatgtctgtcagacctgcctcttagacctagagtatggtatgtttgacctgtccaataaatctgaaagtgtgcaggtgcctaaaactacaagtcagtcttttgtctcccacttcgcaccctagctctggttctgatttcactttggaatgtctgccgtggtctgcttttcccaggaaaagaaccataattaggccactctagagtcctgaacaatagtaggaacttaaggaaaagttgggaattaatcaaaagt

SEQ ID NO: 118309 - DNA, 2741 bp, Homo sapiens
ggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttgagcgtgtcttttgtttgctctcatgtagatactaagtagcatggctcagagccaaaagacaagcgtgaagttaagagagttggctaagagagttggtggggcatgctcccttccattccttaaatgaagtaatctaaaatctcttagcaggttagttcaccataatatataagtagatgttgctttgagcttcttatatacatattcacagaaccattatataaatgttgttagacctctaccagtttttatcctgggtcattgcttctaaagatatcctttacaatatacacagtggtctgactccaccagtggccactcatcaccttcatctgtaccttcataactgttccttccctcctcttacttagatgaattattcatactcttcctgttggaac

SEQ ID NO: 118310 - DNA, 1991 bp, Homo sapiens
agtaatacaaataagcacaaactgtaatgtaaagttacatattttacttcattaaaagtaaaacttgtaccctcatgccaaagaaaacccataaagaaatgaaaagataagccacagactgagaaaagtagtttgcaaggtatattattaacaagagattaaaatctattgttaatatcagcaaatcggcaaggaaataaaaataaccagtagatcctaacattcaagttatggcagaggaaatcccaatagccaataaatatgaaagatattcaaatttatacactaatcagggaaatgtacattaaaactgcaatgagaaaatgaaaaattaaaaaaaattaactgcagtggaatatcatttcataatcgtcagattagtcagttatatttcagtatccattaaaatagcaaatgcatacaccctttgatctactcttaggaaattgtcttacagatacttagacacttaggaaatgattcatgtacaagaacactcatcgctgcattacttacagtagcaaaataatggaaacatcctgaatgtccatcaatttctatcttatgtaagttatagaaattgttacagtgggacacagaggcctctctatatgtactgaaatggaattaattccaagatagaataaatgaaaaaagcaagagaataaatataaaatgttcccttttgtgttattgtgaaaaaagcaaggtgatgtatgcttgtacttttatgtgcataggctatctggagaaaacaaggggacagacagataatgggtaatctttacactggacaccttttttgttctgttaaaaaaatttttaaccaggtatatgtagtatgtatttaagaaagtagtaaataattattactgtcctagtgcagtggctcatgcctgtaatcccagcactttgggaggccaaggcaggaagattacttgagcccaggagttggaggctgtagtgagctttgattgtgccactgcactccagcctgggtaacagagtgataccctatctcaaaagtaatcattgttactgtactttaaagcataggatctggaattttactacctagatttaaatcccagtgtccatttttattggctctgtgaagttggacaggttacttacccttcctgtataccattttgatcatctataatatggcaaccttaatgtaatacctatacctagctcataaagttgatgtgatatttaaatccagttaaaccagtgagcacgttgtttagcaaatacagtatgtactcagtatgtgttattttagtagtttttaagtaccacagaggtataataatattggatagtggggttgcacatatcaggaagtgcgaacatcttttataaactttggctgctatacattattcaaaaacatatggtcttatagcagaacaaaacaaaacaaaattctcgtaaatgctgtccttctgaatttagcagctctatggatcaacaaagtgtgttgttgtcttctgatacgtgttatatttgttttctttttagaaatgtgaacataatttgagcaagccagaatttaacccaacgtcaatcaaattcaaaatccagctggtcgctgtgtaagtattttgggattggtgttttcagttactgttttgagttattttggtttattcttcttccccagtatgaagtgtgtttactcttggcctaaaaaaaaaaaaattacatcaaaataatcttgacattctgttcctgtttaggtttttaatttagttacatgccatgaagtttaagataaatagattcaggggtattgggatcagggacacagtgtcccagtatgatctggagcaacaaggtatgttgattatttggtggaaagtcactagtcatcattacaaattataaagtatctgagtttgggaataatccttcaaaaaaaatttaaaaataatgaagtatagctgattgaagagtatccctgtaacagtgttcattttacttac

SEQ ID NO: 118311 - DNA, 1090 bp, Homo sapiens
gaggaaatgggacctagttaagcaacttgtcatactgcatccacatgaaaattagttaagtcattgaaaccctaagggttggtaaagtccatataaaaatacctagattaagctgggtgcagtggctcacgcctgtaatcccagcactttgggaggctgaggcggggggatcacttgaggtcaggatttcaagaccagtctggccaacatggcgaaaccctgtctctactaaaaatacaaaaaattagctgggcatggtggcgcacgcctataatctcagctacttgggaggctgaggcatgagaatcgcttgaacccaggaggcggaggttgcagtgagccaagatagcgccactgcactccagcctgggtgacggagtgagactctgtctcaaaaaaaatctagattagaatttaaaaacattaacacttgcaaagcacctacatttgcaaaaagaagtgaatttttctgaatagtccagtggtatagtcagcatatgcaccaatgtgtgttatatttagaggtagaatttgaattaaatgaattattcttccaattttcccatataacctgcctgctatatgcgtttgcttctatcttatgctgcattttttgtctctgttgcaacctgctgctattttggggctctacagcaacatactattcatgtagtggtaagttctcctttatgattcttgctgaccctgaagaagttagcagatgaccactggtgttccaggaagacgtctgttgtgtatcttagacactccacatagttcttgcctgagccgtagcttagatacttttagattactagcagaagctcacatttggttcatttttactgtattaatatagtttcaatctccatgtttagtgctgttattattttaagaatagaataatgatgtggggctacaaattgctttctttaaaagaagcctttagattagctttttttttgcttatttccctgagcttctcatgctatcctacccaaaattctttcttttgataaatagggtgtgtaaaagtggactttctaataggaatttctgaactttgtttaggacaaatatggtcttggaa

SEQ ID NO: 118312 - DNA, 1050 bp, Homo sapiens
aaagcaaagttggtaagaggcctgcagaatgttactgttttttcttgagagacacttgtccttatatttgttctctcttgaattccttgataaatatttgttgaatgaatggttgtgtttgtcatgtcacagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtaggtgagtgagatggacttcaatatgaaattttgtacaattgacagtgctataattgcccatagattattatttctgtaacccgttggggcgataggagctaaattcagaatattttgtcattaactcttctgtgttcccatatgttcacatttgtagaccttagtgttttatctgagatgggataatatttagttttcttagacttgataaaatagcttttataaatctggtactttcttggaatcaaaatattaatgctcttcatgaaaaataaacattcatgttaagacatcatggataaaactaaaagataaggccgggcacggtggctcacgcctgtaatcccagcactttgggaggttgaggcgggcagatcacaaggtcaggagatcgagaccatcctggctaacacagtgaaaccccgtctctactaaaaaatacaaaaattagctgggcgtggtgggggcacctgtagtcccagctactcgggaggctgaggcaggagaatggcgtgaacctgggaggcagagcttgcggtgagccgagatcgggcctctgcactccagcctgggtgacagagcaagactctgtctcaaaaaaaaaaaaaatctttaaagataaaaatgacaaactaagaaaaatagttgggtcttatataacaggctaaagatgaatactcagaaatgaggaacgcttataagtcaataagaaaaagacttagtagaaaaacaggcaaagg

SEQ ID NO: 118313 - DNA, 1050 bp, Homo sapiens
ggcacatgctaccacacctggataatttttgtatttttttggagagataggcttttgccatgttgcccaggctggtcttgaactcctggctcaagcacttcacctgccttggcccaaagtgctgggattacaagcgtgagctgctgtgcccagcctcatcttgtatattttctgtctcagtcttagagttgtttctccaaggagccttggttcactttattggagaatagtcttagaaaccaagatatggctgctaggcttgctcattgctactggatggtgtttagtttttagcttgaagtgaaagtccttttgctgttagtcatacccccatacctttatggatgtgaaccactattatttgtctttcctgccctgagaagtaacccctgataaccagatactgttttgtatactttccacaaattaatttttatcatttaatcctcaaagcttccttgtaaggtgagtactattattatcttcttttgatagtatccagatggcagactataacagataatgcaagttatattatagaacagaacttcaagcaggtacaggactgcaggtgaaatcttgataatctgtgctggtgggagagttaaaagcaagaagacatagggacctcctaaaggagaaatgttggctgagcactaggaaaagtagcatttaaggagagaacagaaagccctgaaaatatgctgcttctgaaccattccagtttgatagcattgtttgctttctgttgaagctctctggcacagcagtcggttattttccaaatccagtttcacagcttcttgtattgttgactctaagttttctatggcacagttggtctgtcctctctaaaggcataagctgtgacagttctcttcctcagaaatctttgtgatcaatataagcataaaaagagtctggaatcataaactccatctgttaacaatggttctctctgtggagtaggattgggttgggctctaattcttactttggcgataactgcatattttttaaactaatgaacatatagtactcttgaactgt

SEQ ID NO: 118314 - DNA, 1101 bp, Homo sapiens
atcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtaacagagtcgccctatagcgagtatgtggggtggggggggcgcggcgttcatgctagtcactgccaccggaaggctggagctattttccttccttactgattggttatgtcttccgtcactcgggtttgcctgcgatttaatttgcttctaatctgtcacttggaaaggaggagcagcctcgggtgggactgagcggatcttctggttctagagcggcctctgattggacaaacttgacttagggaccgtgtctgtctgcgatggggcttggtaattgggtggactacggagaaaggtctgggggtgcttagttcaggccacttaaggggcgaaaaactgcctttccaggatttattgcgaggatggagggaggcgcaggcgttctcattcatagttctcccatcctgaaagttctgttcctcttttgtccagaaactgggccctcgtcagactgccttgccctgttcctgactcaggccaaggcctgcagccgggaagaggttggggcggcgtgagttatgtgaaaagcgctcagaatacagtatgtcatgtaagaagctgaaagtgtatttatggagctagaggacaatgctgtccttccctggcacaagtgggcgtccgaagttggatttttcaaaaagaagaccccggccagtaaaaagtcaccaaataacaaaaccccaaaacttctgcagcgcttggcacatcttgtttattcagtaagctttagggattaaaaggcgagtaagacataaaatgcgctgtttaataagccatagtcttagtgaagaaaaagctgatagtagtaatagttgctgcttattcgatacttgctatatgtcatgtgctttatgtaatcttcaaaccaatttaagtggatactttttttaaaaaattttttttacaggtaaagaaacagatacagagtgttcgctgtaagtc

SEQ ID NO: 118315 - DNA, 1059 bp, Homo sapiens
tcgggcagactgccacctcctggctctccaggcccagcgtcagggttcagcgcccgggcctgagcacctgcttgggcgctgcgctgggtttgggtctttgcacttacctgtcccgcttttctcgaggccccgtgtagaaggcgccaggagtttggagtcaggagtggcgggttccagccctggttctgtcactaactgcttcaccatccttgtttttccatcagtgaaattgggaaaacattttctgcgtgcagaaagcaaaggagaaaggacatgagcaaagtatcttggagagaaggcttccttcaagctccctcctgctggttagctgtccctttcctgaggacgtagttgttccagttgctggttgttttgctccctagtctcccccatgccagtttcttgagggtagggactgcctgtctatcgtcatctctgaggcattctcagctcttggagcagggcctggctaacagtaggtgctccatacatatgtactgagtgaaaggatgaaaggtgtaaccccccccgccccccccacaaattgaaacaaacctcaggggctgttattctgattgagggccaggctgggctcttacttatgcagctgcacttgtttcttctggaccagctggaatcctgctgcacctgggggctgaggagtctccggttcatctgtggtgaatactaaggtcctcaaagctccagggtgtggtggtgaaggctgcgcaatcacacaagtatcagagattccttgaacatctgctatgatgcgtgctgctactgcagtggccacatagtttggaaggattggggatgcctgaattaggtggaggtgggagcgggaagaacaggtactctgggggttaggagaccctctgaattaccctaatggaggcatttcccctctctggcccttgtcttccctatctgtaaaatgaagacatgggagtggaacagatgtttgtctgtggttgagcatgacatgctctttggtttatgcaggccgcacagcagccatctagacacacgcaaagcagcacagctgagctttaggac

SEQ ID NO: 118316 - DNA, 1017 bp, Homo sapiens
ttaggtagttaggaaggggaactgctcagaagtataattgcctggcacattaaacaacagcaagctagattccacgtctaaaccatatactttaaattgcttagttgtgtatagatagagcttccttattttattgatttgcactctgattggctgattggatatgtttcttgctagtgacccactatataggatcatattcaagattctggggaccaggacatagatgtctttggtggtggtggtggtgggcattattctgctttccacacacatgaggctgactttgggagagcgacctgttgaggctcacacattgaggcaaggcactaccaccgcccggtgctcttgcagctctgtcacggagcaccctgccagcacctctcatggacagtctcctttgttagcccgacacacagcaggcacttagtcactggcaaatagcaatgatggatagtagtgccttaaacaggatgctggggatttggcctgggctttctcctctgctagctctctgttggtttctaagactctgtgattggctgggtcagatggtacgtgcggtcttacacagctctggctgtgttccgatctctttgaaatatcttggtgtttttccatttttccagccacagaggagcagatggaaactcaggcaggtctgtagtctgttaggaagtttggagagacaggggccagttggggtgaaatgagaacagagtgctccttagggactttgggtcattggagaaaaggctgtgatttgattcatttcacatttttggtagttgtatgtcctgtccattccttcctctggcccctttatttggaccaaaggtccctggtgaaatgactgtgctgggttggtaaatgtttgaggctgttacacagtgggaggagaaatacttccaagagtaaatgtgaagctggtatgtccttctcatattggacttggcatgggaaacctgcccccacttttatcagcctccctgacctcttctaagaacagaaagattc

SEQ ID NO: 118317 - DNA, 1037 bp, Homo sapiens
tgataggtgctgaggacacagcaatacacaagaggtgaggcttctgctctccctgtgcttgcgtttgagggagcaaatgaacaagtctttagcctgataggaaaaaagccaataaaaacaaacaagcaacaaacaagctaattttagattgtgaaaagcatatgcagaaaataaaacaagataagagtgatagtttaacagagtgggtcgggaaaaactttactaaaacgtaacatttaggttgaggtcatggacattgagacaatggacaggggaggaaaagagcattctgagaaggaacagcaaacacaaagttcttcaagtgggatcagcccctgggacacagttgttaggttccccaggctacaaagtggccagtgtggccccatctaggaacttgaattgccctctctggcttaaatgttccattcttccttgacaacctcagcagcatcttctgagggtggagactttttggaaggggtcctataaggtggacaatgctggcaaaccctctagtcctgtgccctgggaaccatcagccttgttcacattctgcaaaatacttgaagagtcatgtatctttggacgcctcagcatcagtgacttggagctggttatagctgtctgctctctggccaccgtggctggtggaaacaaaacagcagcagcatggtctgcccagagttctggcagtgctgggctaaggccacacctgcaggaagccacctgcctctatctgccttgtctcccactttgagataattaagcttgcctgccagcaggcagtcacttcttttattgccttcttcctcagtgaactctggcagtaaaaccggttggataaccattggcaagctctcaaaagttgactgttagttgcagctcggatgtggagggtgtaagtttccggtgggaggttcaagctggggacagcttaaaatttttttacttaaaaaaacttttcactgtggtttcctacattgggcccagatcagtcacgaagcagtcacggcaccctaactaatggcagaggc

SEQ ID NO: 118318 - DNA, 1122 bp, Homo sapiens
tcatttattcatctacttgttctgttttgttttagttaggggcagcgacacgatcagatctatgtatttgaatgattattcccttaaggagtaagactgcaggagggagaagaccccctggacctcagtttcaccatctgtgaaatggcactcattctagctttaatgttccaggattcttgattgtggatgagccccgaagcctgagttcctgtatcttacaggctttgcttatgaaaatcagccagggtgattacgtcttcctggcatttgaagtcaggaagactgtttgatgttaaagggtttacaggaaaggactcttgtggggttcctttagtctaaggcagctagctgttgatgtagtcaggagaccacaaagaatgatttatcccgcccccggtcctctaacagtttcagtctcctgtgactcatgcttctgtgtcttagaccttggggaaagttactccatttcctaggctgagacagggccagcctgtgcttctgtctcctctgcaagctcggcagataatcctatggccctggggagctttgtcagaggcttctccttcatctgggaacttgcccagatctgcccagcctggctgcagagcacctgggaatcaattcccaaatcttaatgccagaaaaggccttaggggtcttaaagatttgttgagtccagaggttcccaaatctggctgcacgttggaatcacctggacaatgggaaaaaagggctcctcctcatcccctttgagtctaattcagtatgtatggattgagacccagaaatcagtgttcttttatactgtcttaaggtcacttaccatggtatgtggcatttggtgactgctgatctagtctcatctcttaattttatttgattttaaaattgtatatgtgtgtttttactttttaagatggagaattattaagacaaaaacaaaaaaaaagcctctttgcccccttaacccagttggcataaaaaattagaagtaataaatgctcatgttgagaaaattcaaacggcataaaatcatgttttatgaatgaagaatgaaaagcaaaacctcttattcctagtccagctcccgaaaaggtaaccactattaacactttcttg

SEQ ID NO: 118319 - DNA, 1034 bp, Homo sapiens
tccagtgcccacagatacgacagagtgtcccaagtgcccctcacactctattagctgcatccttaacctctttttgccacaccataagcattgggttttgtttgttttgagatggagtcttgctctgttgccaggctggagtgcaatggcgtgatctcagctcactgcaatatctgcgtccagggttcaagcgattcccctgcctcagcctcctgtattagctgggactacaggcgcacaccaccacgcgcagctaatttttttgtattttagtagagaaggtttcacgatgttggccaggatggtctcaatctcctgacctcgtgatctgctcgcctcggccttccaaagtgctgggattacaggcatgagccacggcgcctggccagcattggggtattttattgaagatggaagccatgaatgttgagaaagcctcagcagatgggaacttgccagaggtgatctctaacatcaaggagactctgaagatagtgtccaggacaccagttaacatcactatggcaggggactctggcaatgggatgtccaccttcatcagtgcccttcgaaacacaggacatgagggtaaggcctcacctcctactgagctggtaaaagctacccaaagatgtgcctcctatttctcttcccacttttcaaatgtggtgttgtgggacctgcctggcacagggtctgccaccacaaccctggagaactacctgatggaaatgcagttcaaccggtatgacttcatcatggttgcatctgcacaattcagcatgaatcatgtgatgcttgccaaaaccgctgaggacatgggaaagaagttctacattgtctggaccaagctagacatggacctcagcacaggtgccctcccagaagtgcagctactgcagatcagagaaaatgtcctggaaaatctccagaaggagcgggtatgtgaatactaattcctgtcttcattaaacattttccatctcctcctattgattccttttctcctttatttcactggactcattgaaaca

SEQ ID NO: 118320 - DNA, 1045 bp, Homo sapiens
gaatggggttttcaaaatcccaggacacccactctttgtttcttaagcactaaacctatatatagtaaatgtttctggaagtttaacttcagctcttgctgaaattttaaaccctcaatttccagaggaccatcgccaggtgtttttaaaacctcgataggaataagaaatgcttcccagaatggagacttccatcagttctagggagctattagcccccttgccctggctgtaatggagaccgctgtgtctgcctcctttcgcactttggagccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggtgagtgagcctccgggccgggggccgggagaaaaaacctagcccctcggtgtccagcgctcagtgcaatgcaccccttttcccaggctccccgccagatgggcaatccccaggtgcgagagacctcctgaaccccttttgccgccccctccgccgccgggaccccgcccccgaccgtcgtcgtctcgtagttccatctgttggagagccgagacctggtgcttcaggcgggcagaatgactaagggaggaaggtctctctccccgagctcgcactttctccccactgccacctcgagggtcgccttgctacatctatgtcacctccgtgcctgagctgctccccttcagtagggcctaagagggagggcgtcacagaaaaaaatgccca

SEQ ID NO: 118321 - DNA, 1038 bp, Homo sapiens
ggaaactggggagctgggccagggcctcatctgtgttcctgatttgccaaagattatgggagggttgtaacctcaccccaaagaagttctctgccttgtatccagggatggatagttcttgctccagaaaactcaatcctgagggttctgaatgagtgctctagctggcccaggtggagggccttggcaatgggcaggtgactgacagctgacttgaggaagggtattattcttgtcctccaaacctccaatccatccagattagagtcaagaggataggacctgagtcccagcattgctgtgaactcactggtgatcctgcgcaagtccctccctttctcgggcctcagtagttccagcggcacagcgggtgagccgggggagtggtgtggatgagacagggctcctcgccaggatactcccacatctgctctttctctttggcccagaactgaatgcactacaggaagagcttgcaccattcggtctggtcattctgggctttccctgcaaccaatttggaaaacaggaaccaggagagaactcagagatccttcctaccctcaagtgagtactcactcagcatcctgagaaagctcctctcacatggcccacatcttgttatcaaccccaaatcatggtggacatttatcggccaccaagaactactctcctcttctaggatccccagtggaatgagggaagggaagggacaagagagggagaaggacagggacaactggttgtgatgtgcatccgcagggagcaccaaggttgagggacactgaaaagggaccaggctagaaaggaagaccgtggactcacattatgcctatgcccactgcacattcactggctcctgctgcccactgcagaataaatccagactcccaacaccctctcccctgttctgtcccttcctctcatttctgagccctgtgcccacctccttgggacccacctaagaacatttctcaacaggtatgtccgaccaggtggaggctttgtccctaatttccagctctttgagaaagggga

SEQ ID NO: 118322 - DNA, 1039 bp, Homo sapiens
accagccttctgtgcccatgtcacaaccttccatgcatgtgtacccagccttccatgcccatgcagccttccatgctcatatatccagccttctatgcccatgtatccagatttctgtacccatgtagcagcctttcatgaccacataccagcctttggtacccagcctgctagccttcagagagctaacattctatttagagggtgatgagatgggtgtcctttgcagcctgttgcaggccaaagccagacgtcagcctttcttgcaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctggtgagtctgtgtccctcccttgctccagggcacacacagaggctgccccagacaccttccagagaggaaggttaagtgaggggttcagaaactgcatccttctgaactaaacagcaccgtggtggcaggtgggtgtccagggcctggctctgggctgctacccaggggcagggatctggccacagtcccgcagggctgccccacagctgttcagggtcactggtctaggacggagaaggctgagtaagagtgcagggtgggaaggaggactccctccaggccccaggccatgggtatcagagtttgggtttgctttttcttataacttccacgtgtaactaggttccagagcctcaccatgtttctctctctttcctttcctttcctctcccctcccctcccctccgctcctctcccctcccctcctcttcttctctcctctctttttttattttcttttccttttttttttttttttttgagatggaatttcactcttttttgcccatgctggagtgcagtgatacgatctcggctcattgcaacctctgcctcccaggttcaagctattctcctgc

SEQ ID NO: 118323 - DNA, 1053 bp, Homo sapiens
aacctagccagtgtctcagctgatctgcactaaggatgtgaaactacaggctaagagacagaggcaggccccacccaacccacctctgccagggcaccctggagccctagcggagtttgtagggtctctgccctcagaaccagcagatccaaactctggtctacaccacactctggttctgtgatcactgcccctgtgggtctcagcggagtgaaaggattgcactggttgatggctttcaacgtttttttaaaaccatatatcctttgttcaaataaagtcctagcttgaagcccagaatgtaagatagagggacacagaactactctgtttgaagttaaggtggaggctggaggtgtagctgtcccactccccatggcgacccccagctctgccatctgtgaccccagcaggaggcatgggagtctgggcctgaggagaaatccccactcaggaccatccccctccctctcttcaccctccctccacaccaggtgaagatcttcgaggaggacttccagagggagcgcagtgatcgtgagcgcatgaatgaggagaaggaagagctgaagaagcaagtggagaagctgcaggcccaggtcaccctgtcaaatgcccaggtaagagtgactggacccaggaagggcaactggcctgtcctcgtggggagagggggcatggattggagggccctggtgaggctggatgtcaggaccctcactgcttctctccagctctgcaatcatatttgagctcggcaaggcccttcccctctctgactctttctttgtacaattacgagttttactctaagatatctctacctctgactttccacagtcagttctgggctttactctcccagagtggaactaaaagatgttagcagagaagcagcgaggttcacgtgaaccctcttgacctgtgcacagaccactgtgacaagcaggtggcctgcagcaacagcctgggctgtgctccgccctcagggccctttcccggggctggcccacgcatggtggcccagagggaagcatcagccggtcagtcctc

SEQ ID NO: 118324 - DNA, 1050 bp, Homo sapiens
cttccttctaggtctgggtgctaagaattgagccacacatgttcagggaaggggaggtttccccttctgcatgacaaccccagtttagcctgctgggtaggagcatgtgctgggcttgaatctgtgctctgccacttactagctgtgtgaccttgaccttggacaagccccttcaggtctctgagcctcagttttcacatctgtaaaatgaggatgatgatcatagtcttttcttcatggcactgtgcagaagatccaatgaaatgatatgtgtagaatgcaaataaatagggcagcatttattaaataggactggtagtggtggctattattagtatgattattattaggaaggagttccctgaggatgacccctccaaagggccctgatttccaggggttcctgctgatggtcccatcttttcctgattccaggccctggaggaagcactgagcatccaaaccccgccatcatctccaccaacagcatttgggagcccagaaggagcaggggccctcctaaggaaacaggagctggtcacgcagaatgagttgctgaaacagcaggtgaggcttccgggaggaaatcaggtgggaggtgctctgtgggagctggagctttcctgagggcccagacggcttggaatcacatggaacctgtaattagtaatccactttctggccattggccagggccccccactggctctaggtttatcctttccagcaccataaccctagcttaagtcgttcctctaccacctttatgatttagccatctctatgccccacacgtgctattatttacctagtatttaaaaaataaattctaaataaatgaatttaaaagggagctttatatcactgctgtaattggaaaaaaccatttattatttgtcacaagtagaaagtaactgtacgcaataaacaataaaaacagaacaatgttattaaactctagccggatactcttgccaaatgaagactctgaactggagttcttttctcctttatttaaaggagattggcaggtactaaaatggtattaaa

SEQ ID NO: 118325 - DNA, 1049 bp, Homo sapiens
aatgtttttaaataaacattttatataacttcaacttttgtaaaagttttataaaacatatatgttttatagaatgagtatatctatatctatatctgtctgtatctacatctcaaatgtcttaccttccaggccagagagttttttggctgatgtgtgtagggagtgaggagagtggctggtagtaccttagaggttgtacctaaacagggagaatgaccgtagggaggggagaagggaaggggagagggcctggcagccaccctgagtcagggagggggaatcatcatcttgtagacttctagaaggggacgtagtcatgactgggatggttagtggtgtcctgctgggtgggaggaatagggagacagagggctggggccacttgggtgaggggtcttagaggagcaccgagactgggtgagataatttgtattgaggttttggtgaaggctcctctgtgcttctccccaggctagtgtgacggcaggtaaggtcccagaggtggtggccttgggcgcagccgagaagaaggtgaagatgctggagcagcagcgcagtgaggtaggtggccgaggtggcagtagtgggaggatccctcttacctcccgggaccagcagcacaaaggcttgccctggcctcctggctctggcaggtcccaggtcaccatgaggagttggcatggtgaccactgacctgcctgcccatggatgaggtctgactccttgccctggactgtcctctcttgatcagtccctttgcctacagtggtcactctgaggaggtggcatgtggggcatggcctaaaattgttggggctacagtttaggcaggctcctatggtagaccttggatggtggaaagaggttgtgataagttaggcaagttttagcatcaccgatgaggagtggagggacccttgagagatgctttagggaggacccatcatggaaggaagggattaaggccgcttcccactagcctggaggctccataaatttactgtcaaaatttttaacgttaaaagctaccttggctgggtgcggtg

SEQ ID NO: 118326 - DNA, 2330 bp, Homo sapiens
gcaggcgtgcttccccccgagctcttcccaccttcctgctcctgggaatccactggtaccatggggacttctgaaggctgtgttgtgggcagacttcgggctttttgttcagggtgatgaacaggataaggaagttgtggggagggatgaggaagaggaaggaaatggggaaatacgggatgggcaatgcgagtgtcatggttggggatacccccagcagccctgcctttatttctcatgtgcagggttgggggatgggaagggagggaacaaaggtcaactcctttcataatgcctctttccccccagggtaggcaccctcattatcaccacttcacaggtggggaagcagccctttttttgcccaaggtcacccagctggtaaatggtgaagtagggattggaacctcgatctctcgcattccaaagcccatactcttgaccaccatcccaacctgcctcccctattgaattccttttgaaagcctccctgtgctgtggggaatggacagatttccttgctaggccaggccagaccttggagttatatggtccttggttccagtagtgaccctttattgctgtatgaccttggacaagtcacttatcctctctatcccccaatgttcctatcagtaacatgagctagaagtgcctccatggttagattgctgcattaaatgaggccatgtacatgaagcacccagtgcagtccagaacctagtccatgctggaagagaggtccccattcggagttcatgacgggcatccacactgggcagggggtcttagccttgtgggctttagcagcggggaagtgttcagttataattggtgaccattctaaagatggcaaaacggaggcttctgagggactgctcgtgatctgagtgcccgccaccttagtgacagagccatgacttgaagcctccttactccctgcagactctcctcccaggccattctctgatctgtggtctcattcatgtcagcaggcactcaagtgccccgctgatggcagaagggggagtcccccttgcgtgaccttggttgccgagggcatgaagggcaatcaggttggagatgcagtatgaggagaggtgtgggggtagaggagcacggaggatgcccatcccacctggaggggaggggtgtgttgggaggtgaggctgaacgagaggcagaggcctggagagccaggctgagagaagggaacccctttaagatgtcagtgaggcttcaaggtatccaggctgaaccctggcaaggtgagcctggcacagtgcctaggctgtgggcagggtaggaaggtgcctggggtgagagcactttgcgcatccacttttcagctttgagatggggatagatcctaggccccttaaaaggggtcctgccaacctctgttattttttatttcagtcccctccttgtttatttccttcttagctcttatcatagtttgtaataattttatttaatacattttttcttatactcttttttttcttatactctctgctagaaggtaagcttgaggggggcaggcaccatgtctgttgtattcactgttgcgtcccagttcgtggcacttcatacacacttggtgaatgaatgaaaggacaaaataataaatgatcaaatgaactcatagctctcgtagcaccttggatggaaggtgatgatctttgtgacctctgatgattctatccattggccggtttgcacccagggcattggcccagagactccaaggaaacagctctctagactgcaagggtaggacagcaagtgaggccttgtcctggccttcccttagggactaggagcaggccattctgttccctggaggcctcgcccagagacatggcatcttgggtatttttactgcctgggtggaggtgtattgatccagttcctcctcattcattcactgatgtgtttcttggttcactaaacaaacatattcaaggtcaggtatagcataaggctctctgctaggcattgaatggactcataacaataattttttgatttcttttttttaaggggtgttgggggacagggtcttgctccgccacccaggctggagtgcagtggtgcgaccacagctcactacagccttgacctcctgggctcagttctcccacctcagttccctgaatagctgagactacatgcatgcgcccttatgcctggccaattttttggtatttttagtagagacagggttttgccatgttgcccagactggtgttgaactcctgggctcaagtgatcctcctgcctcagcctcccaaagtgctgggattactggtgtgagccaccatgcc

SEQ ID NO: 118327 - DNA, 1049 bp, Homo sapiens
ggaggcaagatcccctgctcagaaagtgtttcactctgactttggaccgataactttaactgacgtagtaagttcctcattagctctacagtgtgcctgtctctgctgagccacttgagccaagacaacacagcctccctgtgctctgaagcttgtagtctggagaagtcgcaggcatgggaagcatcgcatgagccttaaatagagcagcatctgccacctcagctcctttgtggaaagaggcagtgggggaatggatgcagagttgaaacagcagcatttcctcttgttagaatgcggcacactgacgccattacacaggtgttcagggaatgccaagttggggttatagtcattgccattcctccagagttcagagaagtgggaggtcagtgcagcagagcactggatggcgagtcaggaaacctcagttctcgttatacctctgccactgacttacagggcaactttgggcaagttcctcctccccatagcttggtttcccggcctgatctctgaggctccctgtagctctgctgtcctgtgattcccataactgtttccgggaggctgctggaggagctgagccgtggacagggtgggaaggatgagcagaacttgcagaggcagagaggacacagagaggacacatgcagagacaccagacctggtgtgtgtgggttcaggcagggtaaagtggggagcccaactggatgctgctgtggatgggacctgcggctgtagggccttagatgcccagcaggggagctgggcccagtgccgtctgcagtagggtaacactgcaggtccttgggagtggaattggtgtaacaaaggcaatgtctttggtaggagtattccagatagactagagagaaagagtcaactatctggcccacggtgtgctttatttcttacatactgtactagtttgggactttctgaaatagctaaagctgtggttccttaaactgttttgagtcttgggtcctcagaagctgatgaatgcttgggccattccccagaagacacatgtgtaggccaggcat

SEQ ID NO: 118328 - DNA, 1764 bp, Homo sapiens
tggagaagttttgcttggtatcctacaagggattgcatagttcagcatccttatcctacagatcaggtgcagggaaagaaggacctgttctgaggttacacgggtaatggggaaaatgtagatggaggagggagactttctagggcagggccaagagccagaggtgagttcttggtggccatgagggtcagctggaagctgagcactgactcctctcatctatcctgcccctttctgggatgaagggaggctgcagaccaggtttaacgggacatggaaatcccagatcccagagctaatggctggttcaggtgggccattggcttcttggttggttgaatgaccagtaattctactaggaatgacggaaagatgtgaaaaaatctgggatttcttggccaccgtggatttggttgaatcctgaaatagtctccaaatttggtgaatcatctctgggacttttctcagatcagttcactcctctgggatctccaggactggcttgggaaggccagcacaggacatgcttggtggtggccgtaacagctgccatctgtgttctgggaaaccgatcagagacgtctgggcctaagagacagctctggggccgtggcaggaatgctggatctgcagtcttgggttcaatccctgcttttgcattaaccaactgtatactgtagtttcctcatctttccaaagaggatataaccttctgacccactccatgggtcaccctgagaaataatggagctcatgaaagcatttaaaaagtacacggccttaaaaaatgcaatcctacagtgctgctggttcaaggtcagctagtcccacatctcccttctacaaaagaggattggccatcgaggggatatgacctcacattatgcagagggctatgacaggcttgtcgagaatcctgctttgtgatctcatgtgagatgatatgtaacggtccctgtgtactcaaaatgggaagagattttgtcccccttgctgctctcagccacagggccgcagaggaggggtgagctgtttttctctcgggcagcacctaacttcctttctgcacagggcacctcctctgaatttgaagtggtcactcctgaggagcagaattcaccagagagcagcagccatgccaatgcgatggtgagtggacgggcaggaccccgggcttgacctgctgccctctttgtgtcctgtcacttgctaccatgtgagaggcacagaacctgttcagatcccttaggtaccctggagtcacttggggatacacgaggggcaggagcaaagggtgcttctcgctcacatatgcaaattcctgggctagtgacttccccgacttggagcacacgggcacccgaccgttgtgaaagcctgggctctttgccagccctgttgccttctgccaggggccaggcacctccgcacactatgactcagccctttgggtctgtgggcttccaaccccgggggagaaagaagggtcaggaaggcccagggccctgtaagacaggtgatttgctctttgtgcagactcttggagcacacaggaaggaggttcaactttccacttacacgcatgcgcgcgcgcgcgcgcacacacacacacacacacacacacacacacacacacactctctctctctctctctctctctctctctctctctctctctctctctctgtctctcgtacagctctggagcgtctgcccagcatcctcattccacaccttacaacactggctgcctttttcctaac

SEQ ID NO: 118329 - DNA, 1026 bp, Homo sapiens
acacggtgtattcatcttgtatctgtcagtctttgggagaaggggtccttctcatcagaactttgtttttctttctggcccattccatcctatggacgctcttggacaagtccttattggttcttatgctgcagggcaagggaaactgcccagaggtgacctgatagcatggtgctgccctacaaagagatttgaactccctgtctgcccctctggctctgtgtcctggctgtgtgagtatggtgggggtcagagtcacagcaggcagggctgactttgcatcttggctcttattgcggccgggtcatcgtggctgagttacttaaccgccctgagcctcagtttctcccttgtaaaatgcagatgagattagtatgcatgttagagttactgtgcagctcctccaagattgtatatctgaaacatttaatgcagtgcctgacaaggaggcgattcaagcatggtggtgttgctgttaatcctttctcactctgatctttcatttacattctgggagcagggtggtatggtcgtagtcacctggcagcgccaaggacccacggagcatggtgtgtggacttgggagggtctttgaggattcctgatgaaacagtttttgtcttgggggtggtgaccttgggaggaaggtgccgagcccccaaacccttctgaggtccccagtgaaggccttggccctttcatgctggagagctatttggagggctggaggctggctcggtgtttcagccttagggcctctgcccttactgttctctctgcaaagaatgttcttccttcagatgtcttcatggctagttccctcacctctttcaggtcttggctaaaatagctccttatgcttggggccttttgtgcatagactttttgattacctgaaatattgtgttccccaccatcctcctctgctttcacccctagactataagctccatgaaggatttttgtctgttttatttgctgataattcctcagcacccagactggtgcctagcacggagtcgatgc

SEQ ID NO: 118330 - DNA, 1034 bp, Homo sapiens
atctccagagagggttttcccacaataggatatttctcctgcgtctcctctgcccactgcctttctttctccccaagctctgccccctgaggctaaagtaggggagcatagctctgtctgcccactttttgtttcccatgaacccctttcccgttgactccccagcgccaagagaaactgagtgttgcgtgttttggaggacgtggggtgggtttcagttcccacatcctgcatcctgctttgtcccttcgccttacatctgggcctctctgagggagcatggctggcccagcctggattctagaagtgtctgggcgtccaagtgcgtctggtcagtgggtcagggttaggctttctctgggatgttggacatggccttgcaggaggcggggtcggggtcaagggcttgttcccttcagtctgacttctctgaattcaaggtttaccgaggccctactctgggccactctgaagataccctggcacacaggatggacttgctccctgtcctcatgcagcctctaatctacaggacaaggcagacattgagtaagaaattccccatgccttcatgtggtgttgactgtgagttccatttagggtgaatgcataatggtggacaagaaccaggacactgctgcctttgtcatgcaaggtggctccaggccccttgtagccctctgtttcactgttcttgaactccaagcagctctcaaggaaggcccaccctcctgtgctcccgacaggaatacaaagatgtgcaaagtacgctcctgcctcaggaagttcccagccagatgggcaatgcccgcaccagtcagacacatgctgtaccaggtggcaagcctcgtgaggacagaggcaagcagaggggaaggacccccaatgtctgccaacatttttgagtactttactatgtgccagttccagtgctaagtgcagcccccacactgtttcttagttcggtggaaacatctgcactttgtgctatgctgtagaacactgacctttcaggttaaaaacaagtcacccct

SEQ ID NO: 118331 - DNA, 1051 bp, Homo sapiens
ggtacttggagcttgaggtcacacagctgtgagttgcaaagtcagatatgaactcaggcatttggctccagagttcctactatactatttctgttgaacatattttgtatgcacattgttggaggcatttgtgtgcatgtgcaggatggatgagtttccaggagtgcttctggggatggagtatgaaggctgagctttccactgtaggacatttgtgtgcacgtgtgcattgtacattcattgtgcgtacaggagcagatgggaattttgtgcgactgggtgagagattgtgttttggtagggggagggagggacttttgtggatgatgcagaagaatcagcaacgtccttccccacccccttgcagaatgacagtgcagggaaatgtgtagattcctaatgcatcatttttttctcacagtacggtcaaaatgggatttaatcagcacttactcattttccaaacaatggggtgtgatagaggggaattcggcatctgatgagaggtcagaaaaggggactcagaatgttttaaaaaaatccttgacaaaggagggtagaattgtattaggagggtagaatattagtacaaactcagcatccccgtggtggtctctgttttgcaacagaagaaactgaggcagtgaaaaaactgataatgctaatagcttactatgtgccaggcacagtgcttacattccgtatctcatttaatcttttttttttttttgagacagagtctcactctgttacccaggctggagtgcagtggcacgatctcggctcacggcaacttgcctcccaggttcaagcgattctcctacctcagcctcccgagtagctgggattacaggcactcgccaccatccccggctaatttttttgtattttgagtagagacagtttcaccatgttggccaggctggtctcaaactcctgacctcaagtgatccgcccgtctcagcctcctaaagtgctgggatcacaggtgtgagccgccccgcccggcctcacttaatctttctaacaactcttaattttcagatgagga

SEQ ID NO: 118332 - DNA, 1010 bp, Homo sapiens
atgtatgaatcacaaactcaacgtaagacctcccgcaagtccctgccgctctctggcccttggtgtggctccagccctacaatgaaaagactgggttgatcatttctttctttctttttttttttttttgagacgaagtcttgctcttgtccccaggctggagtgcaatggcgcgatcttggctcattgcaacctccacctcctgggttcaagtgattctcctgcctcagcctcctgagtagctgggattacaggcgcccaccaccacacctggctaatatttgtatttttagtagagacggggtttcaccatgttggccaggctggtcttgaactcctgacctcaggtgatccacccgcctcagcctcccagagtgttgggattacaggcgtgagccacggcatgccctgcctgggttgatcatttctaaagacccttcaagcctggcactctgagttctatgtcttgctagctggcaagactttggagcatgatgcttaagagtgttaagcgtttaagagcctggatcttcaagctccggttacttgctgtgctgtaagaccttgggcaagtcatctaatacctcaaagcttcagtttcatctgtgaaatgtggatgataatggtgccgacctcataagctggttgggaggcaaattatgaataaaagcgcggagatagcacacagcaaatactccatacatgttaccttttaatgcttttattatgcagcctccacccctcttctggaacttgctctagagttaagttggttatagatggatttttcatatgttttttattaccttcaaatgtgtatttgggtctgactctgtagctacctcagtaggggtggtggaggagggagtagcagaaaggagatcgagaagttgcgtgctttaaaacaaaaccaaataaaacaaaacaaaacaaaggcagtttgattctccttctgggtgtggctttgtgcgagtgcttgtcattactctggaagaacaagaggttgcacc

SEQ ID NO: 118333 - DNA, 1050 bp, Homo sapiens
tatgcctccgattcattcccttgacactttttatttctaaggaagaaataaaaagagatacacaaacacataaacacatttccagtgagggcctctgtcttctacctagagcctgcagcctggattttcctcattagagcttgaggttgtaaagtctgtccaggagcgagttacgtctttaaattcttgcaaggtgtttcccgggaagcgcacaggagaatctgagtttgcagcaagcctgggaaggctggcccagccctgctccgggcctcaggttccccctcatcccctctcgctgtctggacatttctgtatgctcttcatccatttcaaccaagcccaaacttcctcttttgaactatgcaagggtgcccgatgtgatcttgatctggagaggtgcatggaaagtttccttcatgcaggtcactgataagcaagtaggcgcaactgcagttcctctgccttccctcccccgctgccctacttctggtctgtggctttggtctaagattgtccagtgaccatggcatggggctggctgctggccaaagggcacttctccctaccctggctgaccagactagtttattgcaggttagcgcgtgtttgttttcttttctttcttttctttttcttctttttttttttttttgagatggactttcgctcttgttgcccaggctggagtgcaatggcatgaatttggctcactgccacctctgcctcccgggttcaagcgattctcctgcctcagcttcccgagtagctgggattacagacatgtgctaccacacctggctaattttgtatttttaatagagatggagtttctccatgttggtcaggctggtctcgaactcctgatctcaggtgatccacccgccttggcctcccaaagtgctgggattacaggcgtgagccaccgtgcgcggcgcatgtgtttgttttcatagctgtgaagacagcaacaggcaggtgagagagtctggtctcgtccctccctcacttgtgacctcagaccagccattgccctcactgggcctcagttac

SEQ ID NO: 118334 - DNA, 1899 bp, Homo sapiens
ggcaggtcagctccccttaaggcctcagctggccagtctttcctgtctgtaacatgaaggctaaaattacatgtctcttgccttggaactctgaatatgctaaagggtgcagagaactttgcactgctcacatttacatctcagtggttctgtaaggaagtggcagggattatttccactttcagacaaagaaacaggcctggaatctcctctgggttttggggtgcgaagggcagagttccccatttctgtgtctttctcttacccttcaagtgaacacgtttttagttattgccaggcctatccgcattctgagctccagcccaaaaggtcataggaaggtatttttatcttgtccctaccccccttcctttcgcatcccgggttctctcaggtctcttgggacctctcccactcccagccaggcccctcaccctgcaccccagggccccagcaccagcctccccaacctcctctgactcttgcctcccttctctccctcctctctcccctccctgctctcaggtggctgctgagatcttggtgagtgtcctgttcttcatttgggttttaacggcctctgagtaaagtccgcctttactgggccgagcggggcagtatcgagcagtgatttgggagcttgctgtgcggcttctctctctccccttccgggccctgcttggtaaaagataggccaggcaagtgtttcccaaacttcagctaatcatctctggcacgatttgtgctgtgtaaccaccagctattaatactgatctttaaatcgactcactcttaaacccaaaatgagttaaggggaatttactatcagtataaatagaactagtagctagctagaagacaatcatggaaacactaatgtgcagtgtgatcgggtgtgtttgcccttgaccccgcttggggaaacactggccaggccatcttctctgcatatgaccccatacacccttcccagaggggcttgcagaaaggttgagggatggaaggggaactcccagttgctatgctcagagtctatgtgggtcctcctaggagccccagccccacggtcctgaggctaggatggaagtacccagtgctaaggccatctttgtcagttcacagggtccttgtgaactggagaggggagtatagaagccattgtgcttgaggaaggaagaggggaccagtctcggcccccttggatggctgggtgagcccagcttctgactgccctcagcccaggcaaagacatgaaagtgaataataaccaaggctttctcatgtctcccctcccaaatccttgctccaactggggctctgcaggaaatagcagacacacctagtggagacaaaacttccttggagacacgtttcatgacgatcctgtgtacccggagctatccgcacctccggagaggtgaggcctgacctcctcccttcccagctcagcaggaagatcccagaatctgatgagagcctctcagctctctgtggcaagaggagcccgttgcccacccacctcctccttaacccagcagtagcgtgtcatgggtgacggcgactctggagccctgggttctagtcctggctctaccacttatacctcaccttctttctcctccttagggaagcaggtgggatgcccgggattaggtatagcaactggatttcacctcaaaggccaactctgattggtagtagctgcctagagtgctgtgttaaggattctggggtcccgcgtcatgattcactggcgatgcctgccaggagcaaggcagcgagaggtggtggtggcacaagacccacatagacatctttgaaccacaggctgccgcatgctcagggcacacctgtatgcagtggccctggcactcggtaatcatgaagtgtcctgcactg

SEQ ID NO: 118335 - DNA, 1175 bp, Homo sapiens
gggctgtggaccctggaacccaagagccctccctcattctgtggtgggagtgtgccctgctgggcaggtctttcagacctatatttggcaccagtgggaagagtactgcacccacaggttcagatcagctgggcctgtgctcagaaagtccagcctgggacaggccatctagggtttggctttctttgcctttctgccccatctgtctgacagcaactcccaggaggctttaggttaagtccatcaccctcctgagcctcctttccatgtgtctcatgggaatgatgatacctgccaagctcgcctgggactgtaggatgctagaggtaaaaatgccatgaaagacccctgtgctgggtctgtggttgatggcattaatctgagaagcaggaagtgatattctaatgccttccagagtcaacctgctgtggttagagggactcagggtccagcttccagagagctgaagagaaaggacatagagttgctaacaggacttggactgtcagggttggaaggatcccttggtgactactccagcctcttcatgttacagatgtggaaaccaagtcccatcaagggaaggggacttgcccagggtgggcagccattgccagagccagaactagaactcagaggcactgactcccaacccagtgctctctacctcccagctgtcctttttcctcagcgtgtcaaaaggaaagggagggaggagtccagcagaaatcagtggcctgagccataggcaagcggactgcagggactcaggagcacatggccgcttagccaggcttctaccctgacaaagatcgatgaggggccatcagtgggcggtgcatggggaaagccgagagccacaggccttcttctgaggcatgtggctttggtgactcagggactgacgaagacacaatcatcgatatcatcacgcaccgcagcaatgtccagcggcagcagatccggcagaccttcaagtctcactttggccgggtaaggacctcctcctgggctctctgtgcaacatgcatgcaccttgcctgattgagctcagcctgtccccatcggttctgcacagttgggcaccagggtcttcatggcagagggaccctgtgtggtcatatgatctcagagtgtctccagcactgggtttgggcagacatatctttccatgc

SEQ ID NO: 118336 - DNA, 1070 bp, Homo sapiens
aaagtcatattggtaacttgaaattgtccattgctagaagtatttacaccacagaaataggcaaatgctataaattagggcttcctccaacctgcccgctgagaaccagttattcaatattaaccagcacaggagggccagggctgctatgaataagtgttcattcagccttcccctctttcaggctgtgcagaaccttcacctccttgtctgagaggagcccagggctgggtgagaggtaacctttctttctttctcttcagaatgacacctctggcgagtacaagaagactctgctgaagctgtctgggggagatgatgagtaagtggcttcttggcccctggctggagggcatggccttggggtgccaggcggggactctcctggctcgcatcctgatgggtggattggatgagctggggattcccctgagccaggagcgtcgcacaagtgaaaggcggcttttgctggtagctgctgtgcttgtgggtctgtgtgtctgagagtgtgggggtctgaacgtgagcgtggtctcctgtatatggagatgtctgctcttgtgaacttggaaagtcagtctggggttgtggactaggaaccagaatatgagcatccaatccctgctatttcatagccatttctcggtttcatcacctgttaaatgggaaaaggacacattcctgctctgcctactcatttatgcagcatatttgtgttaagtgccttctgggtgcagaccctgtgaggaagcccctgatgaaggccacagcgcagaagggtatagaccagtttccagaagggagcagtcctgtgctggggagaactggctgtgccacatagaaagcatatataaaagcacacagagatgccctagcccagaccaaggggagactctttggagatacacggtgagacccaaggaggaaggggaagagccaggtgaagagggtctggggacagtgtttgggtggaggaaatcacctatagaaaagccgaggagtgagaaggagtggcctgattcattcatatgtccgaagtcatgcatttatggagtactagagagagaaat

SEQ ID NO: 118337 - DNA, 1048 bp, Homo sapiens
agggccctttatcctagatccctgaggtctctggggatgagactagagcttgcgttcctttctgcagcctacgagcgggacctggaggctgacatcatcggcgacacctctggccacttccagaagatgcttgtggtcctgctccaggttggttcacagcctatttttttcctctggagcttgggatagcttttgtctggctcatctgggtgtagatctgaatgtccagggtctggtcagcttcccctggtttgcacaggcaggtgtatttggctaatcctctttctctttggcacacagtcctctcgtgcccaggagtgtcttctgctgtgattttcttcctctctccacactcgctcctcccgctcctctctgggcctccttcctgccattgcttctgcagctgcacatgcagcatttctggaccccagcattcctgtggctactgtgtggagtctcccacatccgagccttattgcctcctcaccgcccgcccaaagtatatcacaaagagactattaggaggctacaaattggtgtctgtggctgaattcaacctgccaagttggattttttgtttgttttcccataaaatgtgttttaagaaagaaagcaaaacaagtttgagttagttgctaacatttaaaaattgtgagattttgctcaaaaaccagatttctggattattttaatgtattgaaagttgcggtagcagcagacctgcattctgcacgactgcagtgggctggagagcatatgcgtcctgcccgtttcaccgtgaatgttatctacctggctctgtaggtatctctgtgaccacaggcacgatgggaacaggcattgagatgtctcaagctcagctccaaggaccaaatggttatgaaactttatatataaattaagccaccactatgtttcctcgttcccccatttcccttttataccagctcctcccaactctgttcctctcattgccataacaatcccatattaaccagctggggaatgatcaggagaaacctcaggagtgggacagtgtgacctgtgc

SEQ ID NO: 118338 - DNA, 1020 bp, Homo sapiens
atccttgttgacttgaaaagggggcatgcatggtgcagatagtatagactctgggatctagaaattgttgaattcagttctaagctgtgtgatcttggctcatttattgcgatgctccagcctcagtttcctctctataaaaaaggagaatctgatgtgtggaaggatttctgagagtagtaactgagacggtgctgagacaggtaccctgcctagtgtggaggagtcaaggggtcagtggtgggtcagtgccatgcccgccctcccttggggatccgcgtccctttcccatactgctgtgaatgtctggacaccatctagtctgtccattgtcttctgaaaaaaatgtgattggccttgagctgggtcattgggtctgatttaacctgaagggctgggggcagctggaaaacagcagagggaggaaatgtaagggaaagaaaggggatggttagagttggggggaatctcacatgctgtctttcttctctacagtggattctgctgcgaaccggagaccatggccaaaccagcacaggtaaggggcctctctttcctgaaggtggtactcagccttctctgggcctgggatcctcctggagccactaggcctgctacagagacccctggtaccttcagcttgaaaaaaggaggaaaggttcttaggctttgcttgctcctgttacaagtcatggctcttcagatgcaggtcaccataatgtaatataacccacaatatcctaagcagaaaaggatgtgtattggcttatctgacagagaggcccagggcttcaggtctggttgaatccaggggtttccaaatgatagtgtcaagattctgcctgtgtgagctgggcttcttccggtggcttcattcttgggtaggttcttccttgcattggcatggtagtcatcagcagctccaggcttccattctgctgtcttggcagcccagggagaaaacaacataactcatgcccagtgattccaggggaaggcccaggtctggttctcattggc

SEQ ID NO: 118339 - DNA, 1014 bp, Homo sapiens
gtcctggtggtccttaaataatagcaataaaatggtaaccactattacctctcgaacccttaaatttgccaggccccggctgaagccttgctatgttagacgctgttattaatgcctattttgcagacatggaaactccagcccttaacagtttaaggaagaaataataatgacaaatgcttataaaatatagtgcttcctgtgtgccaggtcctcttctaagctctagacttgtcttaattttttttatcctcatcataactcctatgagggaggtgctatttttatcccttttttttttttttaatatgaaacaggcacagagaggctcaatacttgcacaacaccacacagctactaaatatcaccctcaggcttcaatctcaggcagtctggctccagcatctatactgtgagacactactttgctgcctctcacaaaagtgacccaagctggggttcaaacctaggctagactagttccaatcctgaggcagagagatgatctcctgaggccttgtccagtcctaggatcaatggttctgggtcaggagaggaaaagacactgctccctaagaaaccccagtcgtcaagctggggggtgtgcccacgcacagagccagggaaggcatttaccccagcttcatcagaatcaaggctcctggagggttatggagcgggtcctgggtgtcttcctgcagaccgggggagaagccagcaagaaagggcaaagagggaaggatctagattttataggccaggggccttctaagtgggatggatataccccaggacgcactgaagatgatcttttgggggtacaggaagaaactattggactccttattaaatgtacttttaatgtcatattttaaaggtatatttctgtttatcatggtaaatactcaatttttctttggttatgggttgtgtatgggatcaatatatatatatatatatatatatatatatatatatactgcaaactgccatatgacatcaccttatcaccag

SEQ ID NO: 118340 - DNA, 1114 bp, Homo sapiens
cccagagagggaaggccttgacacctacgctagagagacaggctccaatgaaaagagcgagggggcggagccgggaggaatcggtccaattctcggccgggaagtctctggccgggacggggcagggcgaacctgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaaggtgagtgcaccctcttttaagagtctgtttgcagcctcctggcccagctacgggtgtgcgggtctggctgagatatgggggtggccactccgttctctagaattggttctctgcactagagccttccaaagtaactaattatgggattctggtctgtacaatgagggtggcctctaaagacttgttctgctccaggccctttttggagagattaatctcacgtctgcactctcctgccctccctccaagcgccggagtgaaaatgcagacagccttaaaactaaggcattgcccccagagattcagtcctgttaaccctgcaccttactcctgacccccactccttatgtcccccatgataaggcctgctgcctcatctcttcccctgctcgaatgccctgaggtcttcctgagagttgggagggtttgagagcttttccaggccagaggatccagatttgcccatctggtgacaaatacccaggcctgtgaccccgctgcccttggttatgagccactgagacaacagtccccgtaccctccaagcttcctccttcacttctcattgacaccgcttcttccttcacttctcattcacaccgtgctgcagatccctgggaaagggaagttctgtaatcccttcacctgaaaaagcctcgttcctggcttattgcagctagcccaatgtctttcagattcaatctatgttgttgcaaatgacaagatgttcccccttttaaaggctgaatagtattctgttgtgtatatatgccacattttctttatgcat

SEQ ID NO: 118341 - DNA, 1179 bp, Homo sapiens
gttcctggctctgggttgggcacggggtgtgacatgaacaaggtcctgggtgtgggctgcagaggtgaatcctccaggagcttgccctctgctgggattccaaggctggctggagaggagtgggcagcagggaggtgggaagtcagagaaggtgcccaccaaaggccaattaggtcagtctcctgtttggaagttccaggtctatcatatcctgccttatagtttacaatacacttttgggagattatgtcttttgagtcttttagtttagtcctgcctataaaatgagtaggataagtgttatcccagcttcataggtatggagtctcatagatgaggctcagggacgggggtgcctcacccaaggtcactctgccaggagctcatttttcctgtgatctgtgatagtttcttttgtcaacctttttcttcttctccttccttgctgcctgattgtccccagccatcccagctcagtagcttttcctgggataactgtgatgaagggaaggaccctgcggtgatcagaagcctgactctggagcctgaccccatcatcgttcctggaaatgtgaccctcagtgtcatgggcagcaccagtgtccccctgagttctcctctgaaggtgagcctgggggtgggtggagaaggggaggtgcgagggtctggccagcaggggtactggggcatgtatgcttggggaactgtgaagaatttcagaatcctggattcccagagaatagtacaggacatgtagattcagacactctttcacaggttcatggaatctcaggatcataagattgaaaggaatctctgatgtcagcgccagcaacttcctggtgagggcaggagtgacggataccttgcacctggcagaagcgtcctggccttctctgggcctggtggccaactgctcattattgtctgacagctctggttggccaatttggttttgttgttaattataaaattgatataccaattagccagtaatatatagtcactttagaaaacacaagtggtcaaaaaataaataaaataggccaggtgtggtggctcatgcctgtaatcccaacactttgggaggctgaggtgggtggatcttttgaggtcaggagtttgagaccagcctggccaacatagtgaaaccccatctctactaaaagtacaaaaatt

SEQ ID NO: 118342 - DNA, 2254 bp, Homo sapiens
gtggcatgtgcctgtctgtgtttcccacctacatgggaggctgaggcaggaggatcgtctgagcccaggagtttgaggctgcagtgagtgcagtgagccatgatacaaaaaaaaaaaaaaagaattctaagtctatgtatagttcagtgtagggggaaaattcacatttgattattaatgtctgccatgggcacaataatacactatactcacacatgggccacaatgttgccattcctagaacagactatctctaagatctcatccagttaaaaattctatgattaaaatatattgctgcttttttgaagacagaagagctggtatgtttgccctggaatttacacttataacctttttcaaacctttgttttatttttttttaccaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaagtaagtacttagggaggagagagcgttacccctgtggctaaagagatggggtttggagagaagggtctttgcattctccttctgcagatctgcatgtctctggatttgtaagccagtgtgacctatcaggaatcacttatcttccgggagcctcagttatccatctacgaaatgggagacttgaacttagatgtgatcttcagggccctttatccataataatccatgctctacagtgctatggccgtctctcatcttgtgcggctgttttgagaatgggaagaggggtggtagttcatggctgcaatcctagcagtggctctaggagaaagaccccatcagtaggctcccactgactggcggtccactggctttcccgcagggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactcttttttttttttgtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgctttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatctgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtc

SEQ ID NO: 118343 - DNA, 1170 bp, Homo sapiens
aatcagtattcatttgactgaagaagtgggaagagagaagaattaacttctgcacttaaaaaattcagggttggtaggaaaggaaagatagactttgcattctccaaagagggcttaatctcttgtctccagaaactgggaccccagactcatttgggctgagtttggcccgcttcaggtctcactttccccaaatgtaaagaaaaattgaggactccaccacaaagctatgctggctgtgtggggctcaccacttgaattagaaaattcagaggaagttttgctactccattgagttagtttcccagctactcctgatttcagcagacctctgacttttctctgtgtcccagcatctcagcttttgcagtcctgtttattcctcaagcttagctattaccttttctgtgttttcttgtggactgagtgtgacttactgagagatccttcatgtcctagacttatgccattcctgatgactgcccaagcggaccatggaagcttctgggctcatcactggagaagctccctctgcctgcactgtctgctggtacagggcattttctcttgcgaactggggtggaactagaagaatgtctgtccacattcctggcccgtcaccaccactagctgatttctatgcctcaggctggaagtactcaaccagtcctctaagattctgtttctgtagcttatttctcaggggtatgcttttgtagattccccattagcctgcagtgggagttagctggtggtagattgcttagagcacagctggcagcagtgtggatcaccctgcccctctttcctccaaccttatcagcattggcagcccccatgcagaagcatctccacacacagccaatggcatgtgatggcttcccttcagaggtcatgcttgttatcgtaagatacttctaagcttccttctctgtagtttcctttgcagtttttgctcctttttgatctcagatatcaacttgtctaagcaatatttagcagatgaggtctggatttttatgtttatagagacatctctgaagctcaaaacctaccaactagcaactttaggatagtagctcataggttttggacaaaattatgtccttgtttcttggaaatcgaacaaatcagaagataccttcctcaggcttgtattgtgacattttc

SEQ ID NO: 118344 - DNA, 1101 bp, Homo sapiens
acttcttcctgattgtcacccagctgggattctgctgtgtctattttgtgtttctggctgacaactttaaacaggtaggcacctggttaaaaaagaaaaaaaaaaaaaaaaccagagcgagaatggcaaaagatgattgaagtttttgtttaggattttttccaaatcagcttttgtcaacaaaagagttaaagttttcatattttacatagatctacgtcttctatttgattcccatggaaagagctcgggcatagagaaaccgccacatgtcttgtcgaccctcctgtcctaggtacatatgatcaaacctagctcagacaattgggttgctgatgatagtcgtgaagttctctaaagatggctcactggccacagattctaaaaggccttgttcacacacctgagcctttcctcaggaacctcttccagcagaggatccaccggcctctgttgtttgagaggtgtttccgttttcttccttcccctcattctaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcaggtacatgcctaggccctctcctatcatcttggttcaatattttaaaaaagccaggcgtggtagctcatgcctgtaatcccagcactttgggaggtgggggcgggtggatcacctgagatcaggagtttgagaccagcctggccgtcatggtgaaacctgtctctactagtaaaaatagaaaaattaggcatgggggtgtgggcctaatctcagctatttgggaggctgaggcaggagaatcgcttgaacctgggaggcgaaggttgcagtgagctgagatcatgctactgcactccgacctgggcaacagagcaagactctgtctcaaaaaaaaaaaaaaaatatatatatatatatatatatatatattttatatatatatatt

SEQ ID NO: 118345 - DNA, 1183 bp, Homo sapiens
tcctcagagcctcaggtatggtccaggctctgaggaaagtcagggttgctgtgtgggaacccctctgcctggcacctggataccctgggccaggtaacctgagggcaggggagaggtggggtggcagacacgcagaagtgctactagtgacagggctgccatcgctcacctgtacctatttacacccagaactttccagctccccctcatcatgcctcctccttcctacctgcctcccctctgctggtgcacctcgcccaactcattcttactgcacagttcactttatttaacaattttcatgtcccccacctcatgttttcaccttttctgggccaggcatagattaagtaactgggaacgccccctctttataaagctgggcttctttctcatctctctcccaaatgttgtatctcagtattcttcctattcgagtctccagggggtggctggacctacctggtcatttgaaacaggcccccaagctggagtttttaatctggactctctggcttgctgtgacccctaaggcaatgcttctcttccctggattccttagtgtgggtcacagtactgtgttcttagttgctttagctcttaaaacatacgaagtgttgcctaaactgaaaatatttatcttttatttaaaatcagatttttgtttttagactgtcttagatctggggctattacgaatcacttcttcttcagtaaactttgactcaacttctcctgctgaaaagaagctcgctccagatgtctgcatgggtcctcggcactcttggctgaggactcaaaggttttaatcaggatcgtctaaaaatgtacctcggtgaggaggcacagattttgcctcctgttgaccagcctggtttcataccgaaaagacattgaaggactgcagaaatgtatgggtgcaccgggccgagggaagggtggctgagtgagaggcgtataaaatggggctgtgtgcatgcaggcccatgtttcagcctcagcccacgccaggtgaaaggatcagcaatgctctgttgccatcgtgctgggacgacaccagctctattgccaccgatgagtagctgaggtcagtgtgcacagagtttgaaattaagttaatagactttacagcagctggtctgacactacgcgcagtgctcggttgtttacaatcagtggggaa

SEQ ID NO: 118346 - DNA, 1018 bp, Homo sapiens
gcacaatgctgcttcctcgaagagaagacacagagtccaagtggcaggacttgaggttggcttccactctgccttagaagttaattttccaaagtacattacaaatctctgaggccattaggggaaaaggaaggggtgtggtttgtctttgaaattacggttaatacttttagacagtaagtccggctggttgcagggctatttgccccgacagcatcagcctgtaacatttcttctctttcctttgtgccactgagtcgttccctggccagaggacataaatggtgctggtaggaggttatcagagtaaggaaggtagcagatataggtgcagggtgcctgtcattcactgtgttatttggtttaaatcaaagtgattctgggggaagctatgctctttcagtggataataaaattggtaactctattgtaaaacatgtcaatggtgtgtgaagaaaaatcaaccaatctgtaggtgttgataactagacagtactgtgtatgttacgtgcctgtgtggatgtgcacttccagcatggtatgtgtagcgatgtggatcatgccagagttcgtagatcctgttttggggtttgcacatggatcgtatgttaagctttttcttttcaataaatgaattttatttttatttttgagaggttgctatctgtgtcttttttttttttctttttatatcactcagatccctttactagatactgggttaaatgtttccggcttatgccacagagttcatatggcaaagtggcacaagcagtagacccatccatggaattaagagtcgcccaagaagaaagggactaggaatggttttttatttttttttctgttagacaatcctcccctccctaaacctcctcctgcttctctcgaaaacttgagtaagaattttcagccctctccttgcatagcagatgagcccacatgacagccagttttatatgtgtcaacttataattcagtcaaacactaatccaggtgttgctgcgaaggtattttg

SEQ ID NO: 118347 - DNA, 1080 bp, Homo sapiens
tttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgttattttctgtgtcctttagcctgtttggggtcaggggaacgatgcaagggtccacaggccgttccaagattcatggattttgggagctggaagggatcctagagattgtcaagcaacagagattcccaacctggcaacattacctatcccagacacaaaaccagaactt

SEQ ID NO: 118348 - DNA, 1043 bp, Homo sapiens
tgtttagtgtttttgattgcttcctatctctccactgttgtatagctatgcatcttagacatttatatagaattgaaatttgtttccctttaacttcctcccatgccttctgggccacaaaacaaaaaaccctgccttcagccacatattttgaagtgatgcttcttgcattgacaatttcattcaacaggaggcatttgaagtagaagtagcttcataacaccaaaaagtggactcagtgtagaatcgtgggttcctagttaaggaaggaaatgtttgctttcccaacaattctaaaaaatgcatccaatgggcagccacctgtgacacaaagcctagttcattcctattgcttggcttctgaaagctctgccccatctgtttagagggagaccccctgggccagtttggcatcagccaagttggagatgagtggaggatttcctcaaggaagaccctggaccgcgagcatacagccaagtacttgctcagagtcacagcatctgatggcaagttccaggcttcggtcactgtggagatctttgtcctggacgtcaatgataacagcccacagtgttcacaggtgagagcctggcgaggggtggagtgggtagtgaaggcaaggaagataagagtgaggggtgggagaacagagagtgaggagcaggagaagggagattgaggggcaggagaacagagagtgaggggcaggagaagggagattgaggggcaggagaacagagagtgaggggcaggagaagggagattgaggggcaggagaacagagagtgaggggcaggagaaaggaggaccgagggacccatctctgaggctggccatcactgacctcacctctcttgcttctccccagcaagcctcagactagctcccaggggcagggaccattctaggtaattccttggcccccatagggatataccaagctgttcaagactcatggcccacatctctccccctacattcccaacaaaggtctatttctctgcagaacatatccagaaggaaagtaacataagcattct

SEQ ID NO: 118349 - DNA, 1017 bp, Homo sapiens
ggtggctcagggtttggtcagagtctctattgaggatgtcaatgacaatccccccaaatttaagcatctgccctattacacaatcatccaagatggcacagagccaggggatgtcctctttcaggtatctgccactgatgaggacttggggacaaatggggctgttacatatgaatttgcagaagattacacatatttccgaattgacccctatcttggggacatatcactcaagaaaccctttgattatcaagctttaaataaatatcacctcaaagtcattgctcgggatggaggaacgccatccctccagagtgaggaagaggtacttgtcactgtgagaaataaatccaacccactgtttcagagtccttattacaaagtcagagtacctgaaaatatcaccctctataccccaattctccacacccaggcccggagtccagagggactccggctcatctacaacattgtggaggaagaacccttgatgctgttcaccactgacttcaagactggtgtcctaacagtaacagggcctttggactatgagtccaagaccaaacatgtgttcacagtcagagccacggatacagctctggggtcattttctgaagccacagtggaagtcctagtggaggatgtcaatgataaccctcccactttttcccaattggtctataccacttccatctcagaaggcttgcctgctcagacccctgtgatccaactgttggcttctgaccaggactcagggcggaaccgtgacgtctcttatcagattgtggaggatggctcagatgtttccaagttcttccagatcaatgggagcacaggggagatgtccacagttcaagaactggattatgaagcccaacaacactttcatgtgaaagtcagggccatggataaaggagatcccccactcactggtgaaacccttgtggttgtcaatgtgtctgatatcaatgacaaccccccagagttcagacaacctcaatatgaagccaatgtcag

SEQ ID NO: 118350 - DNA, 1089 bp, Homo sapiens
gcacttcacacactcccattacaatgccaccatctatgaaaattcttctcccaagacctatgtggagagcttcgagaaaatgggcatctacctcgcggagccacagtgggcagtgaggtaccggatcatctctggggatgtggccaatgtatttaaaactgaggagtatgtggtgggcaacttctgcttcctaagaataaggacaaagagcagcaacacagctcttctgaacagagaggtgcgagacagctacaccctcatcatccaagccacagagaagaccttggagttggaagctttgacccgtgtggtggtccacatcctggaccagaatgacctgaagcctctcttctctccaccttcgtacagagtcaccatctctgaggacatgcccctgaagagccccatctgcaaggtgactgccacagatgctgatctaggccagaatgctgagttctattatgcctttaacacaaggtcagagatgtttgccatccatcccaccagcggtgtggtcactgtggctgggaagcttaacgtcacctggcgaggaaagcatgagctccaggtgctagctgtggaccgcatgcggaaaatctctgagggcaatgggtttggcagcctggctgcacttgtggttcatgtggagcctgccctcaggaagcccccagccattgcttcggtggtggtgactccaccagacagcaatgatggtaccacctatgccactgtactggtcgatgcaaatagctcaggagctgaagtggagtcagtggaagttgttggtggtgaccctggaaagcacttcaaagccatcaagtcttatgcccggagcaatgagttcagtttggtgtctgtcaaagacatcaactggatggagtaccttcatgggttcaacctcagcctccaggccaggagtgggagcggcccttatttttattcccagatcaggggctttcacctaccaccttccaaactgtcttccctcaaattcgagaaggctgtttacagagtgcagcttagtgagttttcccctcctggcagccgcgtggtgatggtgagagtcaccccagccttccccaacctgca

SEQ ID NO: 118351 - DNA, 2592 bp, Homo sapiens
tgtgtccatagacaatatacagtgctgtgtcatgctagattttgatctacccatagcagaagtgctgaattttgattttaagtttctgtgtccccagttctcagccaattaggaaacaatcaaatacaccaaacagacctttgtttttgagaccctgaaaccttagagctggaagggccgttagtaattatggccatctcctcctctttgctggaaggagaaactgaggttccgaatggtgcactgctgttctctgagtctcagagcagtcagtggcagagctaggggtagacctgggattctggctttttgtcctgctttaaatatcctttcctccatgctctggggcaggctaactccccggttgcctcccaaggctgggtgtggagcttttccatgcctcaggccctcccctgcctccttccctgcaggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagagtgagtgtctgaacaaagaagcaaggggcatgggcagaaacactgctcccagggtgctgggttgtcatccccccactctccgctctcttggtctgtctgttgtctgtcctctctgcctgtctctgctctctctgcctatttgactcctgtctcttgggcgtcttcctgatccttctctgtccatccaactgtccctctctctttcccttcctcaagcgttagcactcacccgtgctaaacactattttgggaactggcaggcacacagagaggaaacaggaagtgtaacttggcagcgtgtgtaagagacagggacaggccagagacagagagagcgagattcctccgtcactgacttcctgggtgaccttgcatggccacctagacccctgcccctggggatgggtgggagtccactgactccttgggaagtgcgttatcatcgacacagccttatttttaaccgtgctcttttcttgctttgcagaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgc

SEQ ID NO: 118352 - DNA, 1026 bp, Homo sapiens
ttcaagtgattcccctgcctcagcctcctgagtagctgggactgcaggcatgctaccacacctggctaatttttgtatttttagtagagatggagtttcactgtgttggccaggctggtctcaaaactcctggcctcaggtgatctgcctgcctcagcctcccaaagcgctgggattacaggtgtgagtgtgtgcccggccttcgccaggtgattttgatgtgggtagctatatggagaattctttgaggtcatcccaggcttctatttttgtgaatgagatgctagtacccatctatgacacctccctcccctcgctgtgagctttggtctggctagtctctgcctgctctggccttctgggaggggtgggagggcccgactggtccagacaatctccatggacctcttgtcacacacagtctctactccctcaggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtaagaccccagaccctagagtgaacagagctcaaggctggcaggtgcactagctatggccagaaagcctctcagcagcctatactgctccaagccctggcatccacagtttgcctggggattggagcagaaggatgaggcatctggagaaaagatgtggacctgggacaaagaaaccgataagacactctcatgctgaggtgaaagtcagtaggagctcaaaatagctccataatcctgcaagtactaggcgtggatatctggataatgaaggagtgtgaattaagaaggagtaccaggctccaaggggtggcaggggacaaggttgggtcagccacacgccccctgtccttcagcagaacatccaggggcagagcagccacctggcactgtctaagccccctcctaaggctcagccccaatagggcccaactgaccctg

SEQ ID NO: 118353 - DNA, 1114 bp, Homo sapiens
ttcaggtccaacatttgggattctaagttccaaagaccaggttggaatcatttctaagaaggttctggtggttacacattcctgagtcctctactccccactccctgccaagctgggcctgtggatagatgtgatccctcagcctcccagcttcaaacacctgccagtggttgacgtgaacaacatgggctcagtctcagctaggatcacacccaaagcccagcacccagtaaggtgcaggagccatccatttccctgagcagagcagattaggctgaggaaagcagcagccatgcctttgcacaatgcatttctagggcattcttcccacacataatctcctctgctcattgtcctgtgaagaaactgtggcctggagaggttgagccactgtgccaaggccaccaatgcaggtggtatgtgggtgggtgggggcctggggtggggagcacggcccaggcagggtctgtgctgaccgcccttgtgtttggaacctagacatccccccttgcctggactctgagctgaccgaattccccctgcgcatgcgggactggctcaagaacgtcctggtcaccctgtatgagagggatgaggacaacaaccttctgactgagaagcagaagctgcgggtaagtggtctctctggccttgctggccccgtgctggtgaagatccagtcccattcctagaactgggcccccagctgcagggcggcatcctgctccggagcgtgcatttacccctgagcaccaggacacgtacttctcttcctgcctttggaggctgtggtgcacattaacatcttagaggctctgagaagtcctgcagcagagacctgctccctttgcttaacctaacgttaaacaaaagagacacaaacagccctattcctttttcctttggagtctgtggatcttaagctttaatgagcatattaactaccccaagaagctgataaaatgcagattccttggccccatctcaggccactgaaacagtgtctctagaaagcaaggcccaggaagctgcattctaaatactccccaggtgatttatgtttattttatttttttgaggcaaagtctcactctgttgccaggctggagtgcag

SEQ ID NO: 118354 - DNA, 1010 bp, Homo sapiens
ttcctttactgccacttaagtctgttttgttgggcctcagctccctggctcagtgtcaacagctgactttctaagccattctagaaagcttattctggaatccagaaatgccccactgtgattgttcaatggagacccaggaacacaatggttgcttcaatcttcaggaaagccatatggtatctagtgtttctgggtcccagactgagcctccagccccccagaagtgcctgacctctatctcaagctaaacctctaatccccaggctgaaccagctgctgccctaaatgttgactgtgaggctcagtgcaagagcaggcaggactcagggctgtccaaagcccagagtgggggccacagtcaaggactgtcagccctgagatctgtccaggtaggatgggggtggatgtgctagtccaggtgatgctaactcccttgtctttctgccctacagatccctgccagaaccaccactgcaaacacggcaaggtgtgcgagctggatgagaacaacacccccatgtgcgtgtgccaggaccccaccagctgcccagcccccattggcgagtttgagaaggtgagggctgagagacaggggcagggggaagggattgggcacttcggaatacaggatgtctgctcaggaaactgttggcttggtggttctatggggcagtgccagtctcagaagtccccttgctagacctagtcccagcaggaaagaggggatgagtcagagtgctctgcctggcactggatcttttcagcaaccagcaagactttaaacagcaccatcaggttccaagccctgtgccagactcttagagctaagagtataacagcatcagcaaagaatcaggtccaaaaatacgggttctggggccaaactgaaggttgacttcaaacctcatctccatcacttattaggtgtgagatttaagctaagttgccgaaccttttcaggtctcagttttctcacatccaaagagaggataaaaatagtccttaac

SEQ ID NO: 118355 - DNA, 1216 bp, Homo sapiens
gagacaaatggttgcattcctttgagtccttgatcagccttcccctgaatacacaatttaatctggctcagtgaatctgcatttttacataaacaataggggagaggaagcaatcagataagcgtttgtctcaggtgagcctcagagggatgactgcatagaataggaggcaggtttgtcctatgcagttctcagcttgacttttccccttagcttagtgattttggggtccaaggtatattttcctttcacactctctttccctaacacccctggtgacctctaaggcagctcaacagaatcccaggcatactgcaaaacacagcaggcctatagattaaatctggattcccaaccctgcgtttgtgctttctgtgacctggaacccttcagctacccttatgggtctgggatgggagtggggccatttcacccattcttctccctcaattccaggtatctgtgggagctaatcctgtccaggtggaagtaggagaatttgatgatggtgcagaggaaaccgaagaggaggtggtggcggaaagtatgtcccttccctgtaacttggcacatccaagctgcccttggctgcctgggcctggggcacgaggacagcctacatgaggctccttccagcagaaatgcagggtggggtcctcagtgggctatgaaggaaacacggctttgacttaacaagtgggaaactgtggcactcagtcccctgggatctgggcaagatcggtttccaggccatccatgtgtgtggtaggaaggagagttctccagctggaaatgggcttctcccctcatagctctttgccctgagtccaaagctgagtttcccagtcccacggaggtcgctgatcacatctggtcaccgaaatctcccattgcttctgtatcagcccgtgccccacagagaagtagaactgagagaagagatcaggaacttgcacactcataagctcattctatttcacacagtccaaggaaacgaggtcctgaggaaatgcaacctgacataatccgtaccatgctatccatgcgttagtgccctgggagagaaatgacctaggggctctggctccagccctaggtgcaaagcatttgtactcaaggggttaagagcaaggactttggaagcggtccaaccaagctttgaacctaggcttctccacgccagcttgcttagcatctcggagcctcagtttctcat

SEQ ID NO: 118356 - DNA, 1147 bp, Homo sapiens
ttatttagaaatgtttgcttttttgaaaaaaaaaaaaaaagtgtctatattacttttgcaattaaaaaaaaaaggtggctgggcacggtggctcatgcctatactcccagcactttgggaggccaaggcgggcagatcacttgagattaggagtttgagaccagcctgggcaacatgacaaaaccctgtctctactaaaaatacaaaaattaaccaggtgtggtggcatacgcctgtaatcccagctgctccaaaggctgaggcatgacaatcacttgaacccaggaggtggaggttgcagtgagctgagatcatgccactgcactccagcctgggcaacagagtgcgtctctgtctcagaaagccctagtatagaacagagatcagcacatgggccaaatcctgctcacagcctgtttttgtatgttcaggaatagagttataaaaaaaatacacagaatatacaacagagtctatatgtgacccacaatgcctaaaacatttgctttctggcctgttacagaagaagtttgccgatccctgctctagaggaaagggcaagggtggttgtgagtagtaatttagagcctgaactctttcttgctgtaactgggagggtctgtgcttcctctccccataccccatttcctcttcctgcaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggtgggtaaggccccagcacttgctgaacaaacctacagctcacacctctcatcagagcgaacaccttggcctttgagagcttgagtggagcgggagagccctctgggttcttttcaatccactgtccaccttctttggagtggttacaaatattttattattgtctaatgcaaatcacaagttcagggaattcttacagaccctgtgagtggacagagcactgtgtaatgtctcccagagtcctctttcagacttgagggttgcagttcatggttagcagggtttaagtttacagtatgtgaccctaagcagtgca

SEQ ID NO: 118357 - DNA, 1138 bp, Homo sapiens
actttgagaccagcctggccaacatggtgaaaccccgtctctactaaatatacaaaaaaattagccgggcatggtggcggacgcctgtagtcccagctactcgggagtctgaggcaggagaatcgcttgaacccaggaggcggaggttgcagtgagctgagatcgtgccactgcactgcagcctgggtgacactgtgagactcagtctcaaaaaaaaaaaaaaaaaaaaagaatcatcccacttactgactttaaaaacctactttaaacctactggcttttaaaatctacccattttataagtctttataaaagaccccagaggccatgaggaaccagaactacccagttatgcatctggtggtagagccaatcttgagattctcctataaagaagtgattactctgtccatgaaatagattttccatcaccctcaaatttatttttgcccctcagaggtggaggaggagagcactgaactgtaatgtttatacccagaagctggtttctggcttctgacctttatactgtgggggatgggacctactccctgtagtcagcgacagaaagtttcaggtatctgttgactttaggtccttgggcagcaaaaaactgtgctccctaaaaatgtgtttctagtttcagagcttctgctgagagtcagggttatgagggctggcggtgtactttgcttttccagaaccagcaagatttccctggagcgaagaaagcctaggttcatattccatactcagtagttatttgccacatgactgcaagctacctagtgaactcttgggaacttcactttcctcctgagtgaaataagataaatagctctctttccaggctcagtgaggactaacttagatactgtacaaagataatttgacatgtaatagacaatcagtagatttagctcttatgttgatcttgcaaacccttcaaagctttggctcagtatataagtacaaaccatagatgaattgattttctgctggttatcctagagcaagactcagcaaacttttttttttacacggcaccgatagtaaacattttagtcttcacaaaccatagggtctctggtacaactactcaactctgccattctagtgcaaaagtaaacaaatgagt

SEQ ID NO: 118358 - DNA, 1018 bp, Homo sapiens
actgacatctcaggtgtcatttcctgtgggtcttgccaggtgccttgagacaaatcctccaacaacaaagtatggataaggaatctgatagaatcagccctaccagttgggcaagtcagcctgtggcaatggtagaagacagtattaattgccctggggcttggggagtgaaggccaccaggattttttgtggggggtggcaatgaggaaaaggctagcttgatcatcactgtattctgtatcttctggggattttgacaaaaaaccctctggagcagatgatgggaatgaggagggcacttggcaccatgtaccacaagataacagctgaaggaaagagggtgttagtcaagggatttcctcaaaactggaaagggaagaaaaaaatatatctatatacacatactggaaggggaagagtgtgttacctgagagttttctcagacaaatgcccgagagcacagggtttggaatcccagaaacctctgaaaatctgtgccccagcttgccaactgggtgacctcaggcaagttgctttatctcactgccttgatttcctcatctgtaagatagggacaaaaactttgacctcacaggactgttgttagtattaactggaaaaatgccagtaaaatatgtcacacagccactgatatatctagtccccaagaaatggtagctcctgtgtagacgtaggacaggtgggctagagctataggcaggtgaggccgggcatggtggctcacgcctgtaatcccagcactttgggaggcccaggcgggcagatcactttaatgcaggagcttgagaccaactttggcaacatgatgaaaccctggctctacaaaaaatacaaaaaattagccagacgtggtggcccgtgcctatagtcccagctacttgggaggctgaagtgggaggattgctggagcctgggaggttgaggctgcagtgagccgtgatcgtgccactgcattccagcttgggtgacagagtgaaagtgaaaccctgtctcaaa

SEQ ID NO: 118359 - DNA, 1579 bp, Homo sapiens
aggggtttgtactatcctcggtgctgtggtgcagagctagttcctctccagctcagccgcgtaggtacgccggggtgtgggcggggcagggaggccagaggactaagccgagccgcagcacttgtgagagggagaagtctgagtggcgctcgcggcggccgcgccagtcgcgtcccccaccccaacccccaccccaacggccgcaggcgcgcgcggcggacggacgggcgcgcggcggctcctcgctcccgctcccgtcccggctggggcgcgtggccgtgtccgccgcgtgcgcgtgctgcgtccaacggcctcgcggggcaggagtaagccgcggccgccgcctgggccccagggcggtctctggggccaggggtcccgcgcccagcgtttcccgcccgccaccctctccgccacgcgcccgcggcaccttttcctcccctggccaagggatccagtcggttcggaccagaaggaggctttcgtttagggtgggggcagcactaaagtctgattggagtcttgcggtccgcgcgtcgcagaagcgccttcggttttgcagagagcaaagagggagcagcgagtgcacggagtggtagtaacaaccaatgttctttccacgccctcactgtgtgtccggcactgtgcggagccacttttctgcctttcatttgattcttgcagtgagctggcgaggtgggtacggctatcctccttccttagcggcccaaggcacgggtttggagagcggggtcacaggcacgcacgggaagggcggggatttgttgacgccgggccctctgactccgagctccccgcttcccaagcctgtttttagtctttgcccccagagcacttgtccctcggggcagcatcagcctcaaaaggccacctgccgagaaggctgcagcggcatttgtacttgggctagttctgggcttccagggagacaagggttggaagtgggaatgtgacaaaggaaaagggtttgggcttcctttctacgtgtacttgtacaggccctgggtagatgtgccgccaccgtagcttctggaaaaaagtagggaaaacgatgagtaagtgcaaatgaacatggactgtgttcctcatcgggtttgaatctcagattgctgatgggaaattcccgccagcgggaagttaggctccggttttagacgttgaatttttttttctctactttttttttaattggaggagacttttgcagaaagaccttgagaagattcactttatagttgaagggaatgaggtgcaaagcgacgaatttaagatctcactagcatctgtgggttaaaatacggaattggaatagaaaggttggcgcccagttacagtatactatttggacctctgtggagcgtgtcatgctggatgaattactggtgttggagatgtgttggaaaaaacaactgtgacagtcgagatctgtggatgaaagtttgtgtacactccgtttatttagcatttactctgctgggttcttgtgtatatgcagaaacaagatgcttttcttcagggactggagcttatatttttctagtagttaccatcttttaga

SEQ ID NO: 118360 - DNA, 1028 bp, Homo sapiens
gcattttaacttagacttaaagttgagcaatttaagttgtcaaatggaaaaacactagaatgacctacatttaaactgtttaagcttgagtccagctaattttattactgcttgaggcaaaatagaatgaaattaccttacacattattgagggaaaatttcgttagtttctacttaaaatattaaaaaaatacagttcttggcctcaggcaaatggttatcacttgggcaggaacatgaaaattacgtgattatttcacaaactggtgctctaactgattacttgtgcatttatcaggaacaagtgaattgaagcaaattgtggtaatgtaaggcttggcaaggctgccctacatccctaccaagtcatacgtcagttttgttggagctgcttaccggtacaaaagtctaagcttttgtacctcttacaggtagaaaagtagacagttctttgtttaactcagtttgctgttcctgagctgacactgcaccaggggaacattaggagattttggtaatgtttgtttgtgacctacttagagcagtttttcttttgtaacttatggtttttttttttcccactcgttctagtattttgcatagaaagtgaacggcagaaggcagttttaagtttttgtaaaagtttgtgaattttatatcgtccttaggactgatggggctagtgttaaaagataaaatttaacataaagcttacatttgtgactaaagccaattttatattttttttctttatttttgtcagtctgataaaactgcccacttggtcttttaacattttgcaaattgattttttttttaactttcagaatttaaataggcattgtatgtttgtttaattatattgtgctttggcttccttggacgaaactattactgactttacaaagaagaatggataattgtggaagtaggtaggtcaaaaaaaaaaaggaaagcctcgcccgccccccagtaatttgtcaaaagcaagtgggaaaaatctctggtagtgcagtactgcccttcca

SEQ ID NO: 118361 - DNA, 1338 bp, Homo sapiens
aagccataggctgtgccttaagtacacccttgtttctgcactgaggttgcctagatttccctggagtgtatccacctgtcttgatctgtttaagaattttgcggatgagcattagtattaactgtaacatatcttttcacgtgatgagaaagaacaaagatttttttaaattgtgaacctgagtaggttttaactttggagtggggaagggatacactaagataaaagatagttgttaagtattctgattcctgaagttttttttctttcaggaaaacagtatttttgagataaagtaagatttgtggaagagttgcaatagagaggtcttgaatacccattatccactgttaacatcttatgtaatccaagtacatttaacagaactgagaaattaacatcgataaaatactgttaatgaaagactttatttggatttccttagtttttctactaatgtcctttttctgttctaggatccagtccaagatgccacattgtatgtagtctcctgatctgtgtcagtttctgtctttccttttgtctttcgtgaccatgacacttgatctcatttggatttgatgttaaggattagactgaagttacagatttttgggggaagaataccacagaaattacccttatcacatcagattgggggtccataatatataactggttgaatttaacctgatgatttggttcaggtggtatctgtcaggttagtgtttttttcccctttagatactattccttagatgctagtcaccaagtccagctcacactcaaggagagaggggaattaggctctactttctagagggaggagaatgtgaatttgtggaagtatattaaagctactgttattattttgggggagatgcttcgaagccatggaaataaagttcccctccttaattttagcattttaatggatctcgtctgcagctattattacttcggggttctaatggtgattttttttattttcctcattccttctacagtataaattttctgtgaggaagatttgtgtattcttcatgttttttctttttttcatttatatcactatagaccacggatattaattttattctttgggttgtaatccacaattatccttgctgatgtttacttatttttgattattatttattttatatttttataaaatatcgtccaggctgtctcacactcctgggctcaagcaatcctcttgtcttggcctctcaaagtgctgggattacaggtgtgagccactgtgctggccacagtttattttgttgttcatgttgttccagcttttttttttttttttggctcctttgtcctttt

SEQ ID NO: 118362 - DNA, 1209 bp, Homo sapiens
tgaagggaggtgacaggtggtaaatgcgaagagtttggaaaaatagattgacagtaggcccagtgatgttgatacttttcttgctctgagcacagatgttggcttctgtattcatgttactccagttctgggaaaagattttgtttctaaattcccacgatttagagaaccagatatcaaatgtttgaatacatgacataatcctgaaacaaaatttacaaaaatttaatatattctcaagttagtacacacaaacacttgctgtttttccttggtgtttttgacaacttttttaaagtaaaaagaccacttaaatactatcgtactcagaattaacatttgacattttgcattgccctctaagactcctttttttctatacgggcttccattcccttccttccagggatctttttcacatctttccaggctgttttattgatggggaatttttaaaaatagctttattgaggtataattgacaataaactgcatgtttttaaaatgtactgcctgataatttcagacaccttttgtaatcccagcttctcaaaagactgaggcagcagagaggattacttgagcccagatgtttgaggctgcagtgacctatggtcatgctactgcactccagcctgggcgacacaggagactcttaaaagaaggtatacccatgaaaccatcaccacaatcaagattgtgaacctatccattacccccaaaagttttctcatgtcccttttccctctttcttgcttgttccttccacccttctccctgcaggaaatccttgatctttttatcactgtagattactttgcgttttttagaatttttttgtaaatacattatgttctttttttaattgctcagtgctagtctgttgtgtaggcatatcacaattttttggtttacctgttggtgggcattgaaaaacggcagaagctgtgtgtttccagctttttgactgttacaaataaagcttctgaactttgtgtacaagtctttgtatgggtatacgcctttatttctcttgggtaaatgcttaataggggaatgtttagatcatgtagtagatgtatgcctaacttttaaagaaactccctgttttccacagtggttgtaccattttacattgccaccagcgatgtttggggggttccagttctgccagtatgttggctaacagtgtgtatggtcagtcttttt

SEQ ID NO: 118363 - DNA, 1232 bp, Homo sapiens
tctagcctgtgtatctatgtacggtatctggtatttgtgtatactaaaaacacttttaaatatatgtaacgttatcacacagtacatatttggcaactgatttttctttttaataatgtttttgagttatgtgctcgctttctggcaggcataaatagggtgacatatgtcttggtttgccagggacagtcctgattcacttcagttaacctgacactattaatagtagttgttttcaatcttaaaagtgctctcatatggttgtcttaggtatagaagtttccctaatgtgaataaaccacaacttaatatccattccttatttgatggacatgtagattgttatcaatgttatactttacagatagggtggcagttatttgtttttgtcttgtgtgagtttgttttgtcttgggtgagtttcttttgtatatgtacctagaagagaactgctagattttcatcagagtgtttttgattttattagatagtgcaaaattgttctccactgtggttgtaccagttgagacttcatcttcagcagtcctgtaggctcttttttttacttggttgccaatgtttggtgttgactgagattttaatactttggcgcatctcttgtaaggtatctcctgtgagaagtgattttattaattgcattttcctggttacttactctgttttgtttgctgtccatttagtactttcctgagaattggctgctccatttcatttgcctgtttttctcttgggttactcttttagtgatttgtatgcaggtttatatacattctactaatcttttattatatgatattatattttcttactataaaactggcactgaaaatgggctatgaaggcatttggctactttttattttgttggagtgagctttgccattaaaaatgcaggtggagtatgggctgcctttatgtttccctgcccgtctgttaaaaattggaggataatgctcatagttatttccccctccgccgctagctgatggagtcttgctcattcgcctaggctggagtgcggtggtgcgatcttggctcattgcaagagctccgcctcccgggttcactctgttctcctgcctcagcctcctgagttgctgggactacaggcgcccaccaccatgcctggccagtttttttgtatttttagtagagacggggttttaccgcattagccaggatggtctctatctcctggcctcatgatcgcc
